United States Patent 9,328,346 (POLYCOMB-ASSOCIATED NON-CODING RNAS) - sequence listing, part 77

SEQ ID NO: 14404 - RNA, 920 nt, Homo sapiens
ggaggauacugacuaagucugagaaggaggagaaagaaaauuagcuacaggaagaguuuauauccccuucuacaagaaaacuuaaauauagcuaccaccgcuuugaaaggaaugguuuguguccaaacagcauuuuccagacaagcucuguacuuuuuugccaaaagaauuaacuuuaaacugaaggcaguggacaguuaaacaagagucggcacugggaacagcugugcguagaccagaccagugacuuauaagguacuguuuuuacucauuuaaaucuucaggguucauuuguuuuggggacaaguauuuaguggucauuugaccuuuuuuuccucccucuucaccucuauuuugagagaaaauauacccuugaaaauauuuuagcuuuuuaacuguauuauuuucuggcuguugauauuugaaacuacucggauuuugcuuuguuuuguuaguguuuuuaggaaccagaugauuguugcuguuguuuuauuuuaaagcuuaguuuagguuuguuucuuuguuguaucuugucaugugugguuuuuguguuuuauugcuuguguuggauaaagauaaauauacuuuagcauuacaaaauguacagaauguucuugacugggcaggagggggagcuuaaugaaucuucaacuugaaauauagaacuaauauggagccaaucagacaagagaaccugggcagggcagucuaggcacuuuaacugauucagucaaggcucacuaaacucaucacagcuugguagaucugaccugggaaacacaguuauuuugaauugggguuuuugccuccaguuugcuucuauauuuagcuguuaauuuuaauccuuccuucucuuuauucauuauuuuuuaaaaaaauucuaauaagccuacuuuucuuuuuuuaaugaagcuuaucuu

SEQ ID NO: 14405 - RNA, 920 nt, Homo sapiens
aagauaagcuucauuaaaaaaagaaaaguaggcuuauuagaauuuuuuuaaaaaauaaugaauaaagagaaggaaggauuaaaauuaacagcuaaauauagaagcaaacuggaggcaaaaaccccaauucaaaauaacuguguuucccaggucagaucuaccaagcugugaugaguuuagugagccuugacugaaucaguuaaagugccuagacugcccugcccagguucucuugucugauuggcuccauauuaguucuauauuucaaguugaagauucauuaagcucccccuccugcccagucaagaacauucuguacauuuuguaaugcuaaaguauauuuaucuuuauccaacacaagcaauaaaacacaaaaaccacacaugacaagauacaacaaagaaacaaaccuaaacuaagcuuuaaaauaaaacaacagcaacaaucaucugguuccuaaaaacacuaacaaaacaaagcaaaauccgaguaguuucaaauaucaacagccagaaaauaauacaguuaaaaagcuaaaauauuuucaaggguauauuuucucucaaaauagaggugaagagggaggaaaaaaaggucaaaugaccacuaaauacuuguccccaaaacaaaugaacccugaagauuuaaaugaguaaaaacaguaccuuauaagucacuggucuggucuacgcacagcuguucccagugccgacucuuguuuaacuguccacugccuucaguuuaaaguuaauucuuuuggcaaaaaaguacagagcuugucuggaaaaugcuguuuggacacaaaccauuccuuucaaagcggugguagcuauauuuaaguuuucuuguagaaggggauauaaacucuuccuguagcuaauuuucuuucuccuccuucucagacuuagucaguauccucc

SEQ ID NO: 14406 - RNA, 18389 nt, Homo sapiens
uauacuauuacuuuaaaauguauuaauuuauaguaaucuuaccaacauguauuuuuccaaaggauaguagcaguacaguuuacuauuauguaggaaccuaccaauuuuuucuuauuaacaagggguguucuuacucaaaaacauuaggaagcucacugcucuagccaaacgaaaccacugccuuuucaucaaguugucuauaaacauucacaccuguuccuuugcuaauauguguaucuuaacuagcaaaacuuuuuccugcccuccacuuuccaccccauccuccaauugauuuacuguuucaaauucuaaaucaucauuaucuacaccugagugagcauaugccuaagagcuggcaauaagacacaugaugacuggcuggggugaggaauggaaaggaagagccagaagaggaaaagaagugcuacaagauucaugugcuagaacucucaaguccaauuucaccugccucccaguuugccuacagucccucuuuuggggguauuaagcacauccagcaaagucuuuccaccagcaaagcccauccacucugcauccuccauaaauacaacacacuaauucuagacccugcacuauuuuuucauacuagucaaagugcucugcucacugcuuucuaccaaauagcaaccaucacauaauuguuuugguucaaccuucaccuguuucuggaacuuuucccuggcuagccaacagcacauucuuauuauuccucuauagugcuucagcaauuuaauacacauuuuuucaaacaaauuuucuacucuuugauaauuuauuuuuaaguuuccuuucagcaucaugcaauaugcccauauaaccugcccauguacccccugaaucuaaaauaaaaguuuaaauuauuuuuuaaaaaugggccaggcaagguggcucacaccuauaaucucaacauuuugggaggccaaggcaggaggauugcuugagcccaggagcucaagaccaaccugggcaacauagagagaccucaucucuacuaaaaauuugugguggcaugcaucuguaaucccagcuuaucaggaggcugaggugguguuugagccuaguucaaggcuguaaugagcuaugaucacaccaccacacuucagccugggcaacagagugagacccuguuuuuaaaaaaaaaaguuuccuuuuuucauuuauucucuuaaaugugaacuccugcgaagacaugagagccucagauauuucuuuucuuuuauaggugucuuuccauuauacaauaaugccuaguacuagacuaggaacagaagagauaaagaaagauauccuaugaaggcacugaauuagccuuuagcuggauucacaaaccuauaggccaauuuaaauuguacucauuuucaaauuucuuuaggucaugaacuagccuacuuauugcgucaauaucuauaaauuacuuccccaauucuguccuuucuaaaguguauaugcucuguccucuagcagaugaucuuguuccugaacuucaauccaaugagcucucauugaacuccuuaauguaaaacaugagcuaggcaauauagagacauacuccuugcccuaaaggaauucauaauaauuccuuaaagaaaacauuuuuaaagcaccugguauguguuaggcacccaagaacuauucuauacagcacagaaaaugagauauucacaccuauaaacaaaagacagcguauuacauuccaaaagaaaggcagucggucauaugaaaauccaggaagggaaaaauuaauucugaacauaauaccaaggaaucuuuuauugaggaacuguccucugaauaggaccauuaaggagaagaauuuucaugagaaaaugagugagggauaugcuagaaaggcaguuguuucugaaucuaauggucaaaaauauggguuuugaaagucagagggucuugguucaaauuguauuuuugucacuuacuugaugaacauccccaaguagcuuauuuaacuucaacugugguuucuucauuuacaaaauggagauaaugugauuacacacugcauaaaaacagacucuuagcugcugccuggcacagaguaagugcugacuaaaagauagcacuuaguuuguguucccccagaagaagaccaugacucaaagauccaacuacaaauaguuuauuugaaagggggccacaggaaucacugauaggaaggggaggaagggagucaaggaagggaaggcagcacacaaaguguguauuauuaaguaaauuaccacuacuggagccuaaucuagcuggaaacuccaggagccagugucgacucaaaggucaagaggagcagagaauuaaaaaccaaccacaacaaucaaggucagaacugcucccagacugaggagcagaaauuccucuucuccagcagaggagaaagcugucagggaaagacacacagauacaguuaaggcagcugugcuaagugguaagccucaaggggauuuggguaaggcucugcccacacuaauacaauauacauaaaaauaugaguauauauaugcuugaggcuauaaggaauauguaucagaaauuuaucuaauugauguauuaguuaaaaauaaaacauauaugauaaacaauauuccaggcaaaguuuuuagaagaugcaauaauccagaaaaaauuuuacacauguauaacaaauuaucauacugaauauaaaaaagaauuacuacauauccaacauaagaacaacccaauaaaaauagauuaaaagauaugaaaauguaaagaauaagaggcaagccccagaacaauagaugaaauagucauuaaacauaaaagaauaaaugaccagggaaauaaaaguaaaaacaauaauaaaauaccaguucuaagcuauuagauugaccaaauacaauuuggcuauaucaagugucagcagauguguagacagaguagugcggagaaaaaaccccuuucauugcgacugccacuuugaagggcaauaaucauuauccaccaaaaacaaaacuaagcuuaccuuuuggccuagugauuccacuucucaguaucucgccuagagaaauacccaugugcacaauaauguuuauugaagcauugccuacaauucugcaaacaagccuacaaaggagacagacuaaauauuauguaauaccauguuacuauuaaaaagaauaaacuggagauauauauauauauauauauauauauauauauauauauauauauauauauauauauaaaaucauguguaaauucccaagauauauugcuaaggguaaagagcaauggcauacagugguauagaauuauacugugaaaguugucagaaucaaaauggagccacuuguguuaaaaauccuaaaagacagagccucagaaggccaugaagagaggguucucaugcaccaaugccugauaacaagaacuaucaccaaagacucugaaaaaacuacaaacuugcacaaaggccauugcaacuguauaccaaaaagaaaaaaaaaauacuccuguagacaucuacccagcaauugucugucagccuuggacugucaucacccuugguauugaucucuguaaccaaaaauaauuaucucaaaccaauuauguaauucuucucauuuaaaaagaaaacauugucuucuuuuacccuccugaacacacacauaguuuacuauggcauguguauucccauuguauuccuauucgcaaaaaaauaucauuuucuuuuagagaaucuuccucucuguuauuuaguuucgcauuaauggugucagcagugaggccaaaguuagcucaccuuugauggauugguggccuguggaauugagugcaguacugacuucaauguugccuuuucuuccauagugaaucuucucuaggacucuuggacucccucccuuuggugaguucuuuuuuacuuuauuugggaucugauuugguuauaaggccaccuuaaauaaaggaccuugcaucccuccugggacuauaaaaguuauuucuggcgagcccuuucugguaaaagacaaguguccuucugguuugaguuaucugguuucuacggaguuuacauucugucugugaggcauucuuuucuggugaauucacuuuugauuuggugcauccggcuuaauauuuuguuugaucugcauggcuggguuaaaaauucugugagcacucugauuuugguuucauuuugguuagguuaugugugucuguaaaugauuuggcucuuuuucccuuacuuguuucugaacaucuuccaagagcaaaaauaaacauucuaaauaguaggcaugauauggccaauuaaaagccacugggauggucaccaugaucuaaaccaccaguguaaacuuccugacaggauuuauagaauuuucuuugcucuggagaaauuagucagaaacagaaugggauucucaaacauucaggcaugucaagcuuucugggacuccagcuggcuacauggcuuuuccucgugcauguuuuuaaauuaauggccaucaugaauaucauuugaaguccccaaccuuguuuuuuucuuagaauucaauuagaaacugcaaucaacuauagaguuaacauguagagucuuuuuaguuaucuuuuuuuuucuggauacucuaaaucuguuaacuuuuucauuuguguuaagauaacacacuguugcuaauuucaaaagcugcuuagaucuuuuuuuagagcauuuuaaccaggauaaggauaaaaaucuuaaagggcuuucaaauuaauggcuuuacaaauuacaaccgcuucauggcagccaacaaccuagacaccuuuuggaaauguaaauugagguuucccuaacuauuaauugcuuagggugaugaaacaguuaauugaaggauugauauucuauacggacauaaagagauauguguuuauacaaauuaaggucucagaucaaauaggucaaaaucuugaacuuagcgcaauaauacaagguaucucuggcauaaaaauugcuuugucugucuguuacacgggggccagaaacgcugaccaaaaaaaaaaaacaaacaaaaaaaaaccugccaaaaugcuucccuguccgcauugucuagucaagaaaaccagaucagcaaacaaaagaaagauuuguuacuaaaaaauuuaaggcaacuuggagauuuugacuuucuuacagaauuuagccagucccagcuaaaauguaaacaauugaaaauuuaacccuaaacucauuuaaaacuggaaaaaaagaugugagauuuauuuaaaaccaagaugcuuuaccuaaaaauuuugguccacagcuuuucuuagauuaucuauuagggaaaauaacacuuauccaccugaacaggucccauuuugucaaaaauacaauuuggguccaacuauuuuuuuauaaacuugugaguuuguauuacuaugcuuuacuaucuagugacugaaauucuaaaauuaaagcuauaagaucuuuauugugugcauguauauguguuuauguguguugacauguguuguaugcugugucuaaauuguaaaaucugguguacuuggcuagaaauuccuuaagaaauccuauucggauuagcucagauaaauaagcaaucauaaaauauauaguaauuaauccaaaugccuuuuaguucauacaacuuaaguaaaucuuugauaaauaagcuguugguguuuuauugguagggggugguuuguuuugagguggggucuugcuuuguuccuaggcuggagugcaguggugcucauuguagccucaaacaccugugcucaaucaauccucccaccucggccucccaaguagcugggacuacagguauguacccccaugccuggcuaauuuuuguauuuuuuguagaggcagaguuuuaccauguugcucaggcuggucugaaacuccuggccucaagcgauuaucccaccucagccucccaaaaugcugaaauuauagggaugagccaccaccccuggcccaauaaacuggccuugaauuuguugauaaaauaaaaacagaaauuuuuucaaauugucaaucaauagaugaaugaaaaugucauguauauaaauacacaugaauauaucuauauacauguauauaaauacacaugaauauaucuauaugcauguauauaaauacacaugaauauaucuauaugcauguauauaaauauacaugaauauaucuauauacauguauacagauauacaugaaugaaagaaaaugucauguauauagauauacucaauggaaucuaauucagccauuaauaaagaguaaaauccuguaauuugcagcaacauagguggaacugcaggucauuaugcuaagugaaauaagccaggcacagaaaaacaaauauagcacguucucauucauauacgaaagcaaaaaaauuggcucucauggagguagagaguaaaaugguuaccagaggcuaggaagaaaaguggggagggaggcaugaagagagguugguuaaggguacaaaauacaguuagauagaaggaauaaguucuaguauucaguaguacagaagggaaauuauaguuaacaauaauuuauucuguauuucaaaauagcuagaaaagaaaauuuguacuauuuccaacacaaacaaaagaugaauguuugaggugauggauaucccagguacccugauuugaucauuacacauuguauacagguaucaaaauaccacauguaccccaaaaaugugacaacuauuauacaucaauuuuuuuuuauuuuaaaaacagguuucggcugggugugguggcucaugccuguaaucccaacauuuugggaggccaaggugaguggauuacaugagcucaggaguucgagaccagccugggcaauguaaggagacauuuugggaggccaaggugaguggauugcaugagcucaggaguucgagaccagccugugcaauguagggagaccuugucucuacuaaaaauaaaauaaaauaaaaaaucagcugggugugguggcacauuccuguaaucccagcuacucaggaggcagaggugggaggauggcuugagcacaggaggugagguugcagugagccaugaucgcaccacucugcucuccagccugggcgauagaaccagaucuugucuucaaaaaagaaaaaacaaggaggaaagaagaaggaagaagaauacagaaggaggaagaggaaagaagaaggaagaagaauacagaaggaggaggaggaggaagaggaagaagaagaagaacaggaagaagaagaaggaggaggaggaggaggagcgggagcaggagggggagcgagagggaaagggggaggggagagaggaagagaaagaaggagaaggagaagaagaaaaggaaggaaggaaggaaacaaggaaggaaggaaagaaggaaggaaggagcaggaaugaaggaaaggagggagggaacaaggaaggaaagaaggaagaaaggagaagaaugaggaggaaggaaaaagaagaagaauuaaaauacagauuuuaauaacuaaaguugauuaauuaauuuuuuuagaauucuaaugaagaaacugcugaauucaugaaacuacucaucaagaucaagcagaacaaaaauuacaugacauuaaguaacugcugaagauaauguuuuuaugacuuuaauuugaaagauuuuugacuccuaaguguuuuguuuuccaaauuuaagguaacuuuuuucuuaagcuaucuauaguuuaaagcaauacgguaaagcauacuuuugagaacaaagguggaaauauuuacuuuuucuucuuacuugaucccuccaaaauuuggaaacucuucaugaguauucuuauggcuguaugguuauuuggauaaguucaguaaaaaucuacuuucucuuuauaacagaauacaauuggaagcauuggcuauauuaccaaggcauugacuggaauaucauauuugagaacgugcauagaaugccugguuucaaggguuuccagccuuauagugagugaguaaauauugucacuuccuggcaggccccaaaaaccuuaagaugguagguaaaaccuaaaaucuaccuugguuugacuuccuagccucaaaagguuuuaaaucugagauuuucaugugaucaauauagagauaaaaacuuauguuucuaaagaaaagcuauaauauauguguuauuagacuguagccuugugcauuguuuuugaguccuugcuaucuaccuacagacuagacuauauccugaauucuucuagaguccuccaauucaacuuucucccauggaauuacuaaaaaugagaccucuuuuguucugaagcccugaaaacuaaaacuagaugaauuuuaagggauaaguuucaugacugauggaugugucacacagaaaguuaaacaaaccaccugaugccauagccagggacauugaaacugcaaaccaggauaagaaguuaaugucuucauuccucagacagcuuuucccaagaccucagaacaacccuccauaucauaaugagacucuuaccucucuuaaugcccaccuuuuucacuuggcaagauaauggugacauuaaaaguuaacaaucagaaccuucugcugguaacuugacagaaccuauccuagaacauccuuuuuuucuuuucuuuucuuuuuuuuuagagauggguccuaaucugugaugcaaucauagcucccuucagccucaaauuccugugcuuaagcaguccucccaucucagccucccaaguagcuagaacuacaggcacauaccacuaugcucaauuuauuuuuuuacuuuuuguagagacaggaucucacuauauugcccaggcuggucuugaacuccugaccucaagugauccuccugccuugggaucccaaagaguuaggaauauaggcaugaaccaccacacccaagcaaggagauccuuuaguccaccuaguagaugacuuuggcaucauccccaguacaaugauugaucacucucugcuuucauuaaauccagucauaagauauuagaugacaaaauugcucaauauuaacuauuggcuaauaaggagaugucuguagcuauugcuaauacuacaugcuguaccuggguauauuccucugggaaaguugagauccauaaacacaaaaggagaaaacaggccacaugguuacaagucuuacuuaauuucccacaguaggauuucccacaauccuacuacuugauuuauucaaguaguagccuuuaagccuaguccaugacucaaaacuuuuauacaaacuaagcuuauuaauuuacuuugcauuuucccuuuuuaaaaccuuauaccuauugcuuguuaaguuuuuggagaaguaugacuccugauagaauaauacuggccacgcacuuugagaugauaacaaagaccuauggaacugacaaaauuaacuuaacaauggauuccagguagccuuagccugaaagccacucccuccuaagcucccuuguugcucaaauguggcuaaaaauguucugauacugacuccuacuugccaaccacuucccucaaacaugggaagaccagaccaaaccaggacuggucuaucccaggacugaaggacaaucaaacccuaacuacaggaugauucaucagugacgcuuuggagaaagauccugauccaaagggggaaaugugaaaguugucagaaucaaaauggagucacuaguguuaaaaacuaaaaaaauagacuuggggaaagccaugaagacagaauucucacgcacuaagcccucauaacaagaacuaucacaaaaggcucugaaaaaaacccacaaauuugcagaaagguuaucacaacccuacacacaaaaaauacuuuuguaagaacaucugcccagcaacugcccuuccaaccucagauuggcaccacccuuuguauugauccuuguagccaaaacuaauuaucacaaaacaauuauacaauugucauuuuuccuuuaaaaaucuuugucuuccuuuaccucucugaauauauacauaguuuacuaugguauguauauuuccauugcaaagccccauuccuaaauaaauguuuucuuuuagagaguccccucuauugguuuuuuaaguagacaauaguguacuuaaaacacucucauacauaauacaccucuacucaaguuuacaagaaguaacaaucaauuuucuauguguacauuuacauguauauuacagcuuaaauaauauucagaagcauccacaaaccuacaacuaugauuacugcuaggaggaaguaagagauuauggcuguggugcuagucaaagaaaaguuucaucauuucugugaaguuucaaucuggggaaagaagcauuguucauguauuauuuguguaauucauacuaaguguaaaauaaucaaugugugugggguuuacuucuauuuuugaaagugauuauuauuucaauaguuuugggggaacagguagugcuugguuacuuggauaaguucuuuaggugugauuucugagauuuuggugcacccaucaccugagcaguguacacugugcccaauguguagucuuuuauuccucacccccaccucacacacuuuuccuagggcccccagaguucauuauaucauacuuaugccauugcauccucauagcuuauuucucacuuauaagugagaacauucguuguuuggguuuccauucuugaguuacuucacuuauaauaauggucuccaauuccaaccauguugcugcaaauagcauuauuucauuccuuuguaaaauagcugaguaguauuccacaguuucuguauccacucuuugguugauaggcauuuaggcugcuuccauaauuuugcauugugaauugugcuguuauaaacaugcgugugcaagugacuuuuucauauagugacuuguuuuccucugguuagauacccaguagugagauugcuggaucaaauuguaguucuacuuuuaguuccuuaaguaaucuccacacuguuuuuuauagugguuguacuaguuuacauucccaccaucaguguaaaacuguucccuuuucaccauauccaugccaauaucuauuauuuuuugauuuuuuaauuauggccauucuugugggaauaaagugguaucacacugugguuuugauuugcauuucccugauuauuagugauauugagcauuuuuucauauguuuguuggacauuugaauaucuucuuuugagaauugucuauucauguucuuugcccacuuuuugaugggauuauuuguuuuuuuucuugcugauuuguuugaguuccuuguagauucuggguauuaguccuuugucggaugcauaguuugcaaauauuuucuccuacucugcggguugucuguuuacucugcugaauauuucuuuuguugugcagaagcuuuuuaguuuaauuaagacacaucuauuuaucuuuggguuuuguuuuuuguuguuguuuuuuuuuuguuuuguuuuuguuuuuguuuugcauuugcuuuuggguucuuggucaugaacucuuugccuaagccaaugucuagaagaauuuuuccaauguugucuucuagaauuuuuaugguuucaggucuuagauuuaaguuuuugauccaucuuaaguuuauuuuuguauaaggugagagaugaggauccaguuucauucuucuacauguggcuugccaauuaucccagcacuguuucuugaauaauguguccucugcccauuuuauguuuuuguuuacuuugccaaagaucaguuggcugcaaguauuuggcuuuauuucuggguucucuauucuguuccauuggucuacaugccuguuuuuauaacaguaccaugcuauuuuggugacuauaaacuuguagcauaguuugaagucggguaaugugaugucuccagauuuguucuuuuuauuuagucuugcuuuggauaugugggcucuuuuuugguuccauaugaauuuuaggauuauuuuuuucugguucuuuaaagaaugaugaugguauuugauggcaauugcauugaauuuauacauugcuuuuggcaguauggucauuuucacaauauugauucuacccgucagugagcauggaauguguuuccauuuguuugugucgucugugaauucuuucagcaguguuuuaugguuuucuucguaaagaucuuucaccucuuuuguuagguauauuccuaaggguuuuuuuguuguuguuguuuguuuguuuuuuguuuguuuguuuguuugcagcuacuguaaaagggguugcauucuugauuuuucagauuggucacuguugguguauagcaguacuacugauuuguguacaugauauuuuuauccugaaauuuuacugaauucauuuaccagauccaggagcuuuuuggaugggucuuuaggguuuucuagcuaugcaaucauaucacuggcaaacagugacaguuugacuuucucuuuaccaguuaggaugcuuuuauuucuuucuuuugucugauugcucuggcuaggacuuccaguacuaugcuaaauagaaguggugaaagugagcauccauguuuuguuccaguucucaggggaaauacugucaacuuuuccccauuuguuauaaaguugucugugaguaugucauagauggcuuuuauuaccuuaagguaugucccuucuuugcugauuuugcugagaguuuuaaucauaaagggaugcuggauuuugucaaaugcuuuuucugcaucuauuaagauaaucauauuuuuguuuuuacuucuauuuaugugguguaucauauuuauugacuugaauaccugaauacccgguaugaaacccacuugaacaugguguauuaucuuuuuuuuuuuuuuuuuuuuuuuugagacggagucuugcucugucgcccaggcuggagugcaguggugcaaucucggcucacugcaagcuccgccucccggguucacgccauucuccugccucagcuucgcgaguagcugagacuacaggggccggccaccgcgcccggcuaacuuuuuguauuuuuaguagagacaggguuucaccguguuagccaggauggucucaaucuccugaccucgugaucugcccuucucggccucccaaagugcugggauuacaggcaugagcuaccgcacccggccuauuaucuuuuugauaugcuguuggauucgguuagcuaguauuuuguugaggauuuuugcaucucuguccaucaaggauauuggucuauaguuuucuuauuuacuuagguccuuucuuaguuuuaauauuaggguaauacuggguucauagaaugauuuggggaggauugccucuaucuguaucuauuuacgcuuuaaggaaguuccauuuugguguauuuugagguuuuauuucaagauuuagaacuuuaucuuuuggaauaguuucaguaggauugguaccaguucuucuuugaaugucugacagaauucagcugugaauccaucugguccugaacauuuuuuuuguuggcuuuuuaaaauuacuguuucaaucuuguuacuuguuauugcucuguucagaguuccuauuucuuccuguuuuuuguuuguuuuuugguuuuggguuuuguuuuguuuuguuuuuugaacagagucuugcucugucacccagacuggaguacaguggugcagucuuggcucacugcaaccuucaccucccagguuaaagcgauuuuccugccucagccagccgaacagcugggauuacaggcaugcuccacuauacccggcuaaccuuuguauuuuuaggagagacaggguuuugccauguuggccaggcuugccucgaaauccuggccucaagugaucugcccgccuuggccucucaaagugcugagauuacaggcaugagccaccacaccuggccucuuucuggcuuaaucuaggagguuuguauauuuccgggaauuuauccauuuccucuagguuuuccaauuugugcacauaaagguguucauaguagccuugaaugaucuuuuguaauucugugguaucgguuguaauaucucccauuucauuucuaauucaauuuauuuggaucuucucucuucuuuucuugguuaaucucacuaacggucuauugauuuuguauaucuuuucaaaaaccagcuuuuuguuucauuuaucuuuuguauuuuuuugguuucaauuucauuuaguucugcucugaucuuuguuuuuuuuuuuuucuucugcugggcuuggguuugguuuguucuuguuucucuaguucuuugagaugugagcuuagauugucuauuugugcucuuuuagacuuuuuaacguaggcauuuaauguuaugaacuuuccucuuagcaucacuuuuucuguaucucagagguuuugauaggcugugucacuauuauuguucaguucaaauaauuuuuuaauuuacaucuugauuucauuguugacccaaacaucauucaggagcagauuauuucauuuccauguauuuguauaguuuugaggguuccuuuuggaguuaguuuccaauuuuauuccacuguggucugagaguguacuugauauaauuucgauuuuuuuaauuuacugagacuuguuuugcagccuaucauauggcaucucuuggagaauguuccaugugcugaagagaagaauguauauucugcagcuguuggguagaauguucuauaaauaucuguuaaguccauuuauucuaggguauaguuuaaguccacuguuucuuuguugacuuucugucuugauuauuugucuagugcuuucaguggaguaucgaaguccuccacuauuauuguguuggcaucuaucuuauuucuuacgucuaguaguaauuguuuuauaaacuugaaagccccaauguuaugugcauauauauuaaggaaugugauauuuuccuguuggacuaauccuuuuaucauuauauaaugucccucugcgucuuuuuaaacuguuguuguuuuuaacagacuuuaagucuguuuugucuaauaauagcuacuccugaugacuugugguuuccauuugcacggaauauauuuuuccaccccuuuaccuuaaguuuaugugaguccuuauguauuaggugagucucuugaagacagcagauauuugguuggugaauucuuauccauucugccauucagcaucuuuuaaguggagcauuuaggccaucguuaguauugaaaugugagguaauguucuauucaucaugcuaguuguugccugaauaccucauuuuguguguguguguguuauuguuuuguacgucuugugagauuuaugcuuuaaagaaguuccauuuugggguauuuugagguuuuauuucaagauuuaguacucccuuuagcauuucuuguaguacuggcuugauagaggcaaauucucucaggauuuguuugacugaaaaagacuguaucuuuccuucauuuaugaagcuuaguuuagcuggauacaaaauuccuagcuaauaauuauuuuguuuaaggaggcuaaagauaggaccccaaucucuucuaguuugcaggguuucugaugagaaaucugcuguuaaucugacagguuuuccuuuauaaguuaccugaugcuuuugccucacagcucuuaagauucuuuucuuuauucugacuuuagguaaccugaugacuaugugccuagguuauaaucuuucugcaaugaauuuccuggguguucuuuaagcuucuuauauuuggaugucuagaucucuagcaaaaccagggaaguuuuccucgauuauucccucaaauaagcuuuccaaacuuuuagauuuaucuucuuccguggaacaccaauuauucuuauguuugguuguuuaacauaaucccaaauuuuuuggaggcuuuguucaauuuuuuugcuuuuucuuugucauuguugaauugaauuaacuugaaagccuugucuucaaguucugaaguucuuucuucuacuuguuugauucuauuguugaaauuuuccaguguauuuugcauuucucuaagggugucuuucauuuccguaaguugugauugucuguucuuuaugauaucuguuucacuggaggcuuuuucauccauauccuguauuuuuuuuuaauuucuuuaaguugguuuucaucucucucuagugccuccuugaguagcuuaauaaucaaucuucugaacuuuuuaucuggcaauucagagauuucuucuugguuugaagccauagcuggagagcuaaugcgaucuuuugggggugugauagaaucucguuuugucauaugaacaguuacuuuuuggcuccuucuuauuuggauagacuuuuucaguggaagauucuggaacucaagggcugcuguucagauucuuucaucccacauggugaucccuugauguggugcucucccccuuccccuagggaugggguuuccugacagccagacugcagugauuguuauugcccuucggggucuagucacccaauggggcuacuggauuccuggcucaugcuggaaaaugucugcaaagagucaugugaugugauccaucuucagcucucccagccauacauaccagcacccggucugguggagguggcaagggaaugaaguggacucugugaaaguccuuuguuguaauuuuguuuaguguacuuguuuucucaaaugcugguuaugcuagcagugaagcuuucauguggacaggcucaggaccucugguuagccagguuguugcaggcaguggaauuagcuguuguuuucuccuucuuuggagcaggguuguucugacuugcuguaauguauugaguugguuggccuccagccaggagauggugcuuucaagacagcaucuaguagaagggggauauaaucuuacccuauguuggccagaaugaguacuuggguuucucaggcaauggguagggccauagagcauagagcucccaagaguuuuugucuuuugucuucagcuaccagggcagguagagaaaagccaucaggucagggcaggguuaggugggucugagcucagauucuuucugggugaggcuuguuguggccacugucggggaugggggugguucucaggccaaugggguuauguucccagggggauuauggcugccucugcugcaucauacaggccaccagggagguaggggaaagcuagcagugacagacaucacccagcuccuaugcagccacuaaggccagucucacucccacuaugccccccaaccacacugaguuuauauauaggcagcuggugggcagggcugagaucuugccccaggcuacaauccuccccacugagaaagcacacagggcucucaggcuuugcugcuuccugccugcccacgccaucagcuguggcuuguauacuuguaucggcacuucccauucaccaucccccuaccaccaccaauuguggucaggaaaauuugugcucaguugaaauuauuacaaaguucagcugggagcuuccuucacccuguggucccuccccaguucugcuggcugccuucccuuccccaaggaccucugugagauuaggccaggaauggcuucccuggguugagcuggggacugggagugccuacagggcucuucacacugcuucuucuacuuuuauauuucaccugggucccuaaauccauuucagcucuagguaagguuaacuccuuuucccaugaucuagauuuucagguuccccagugggguguguguucagagucugacuuaucccucuaucacacuuuggaaacucaguuuuuuggcugucuuguggcauuuuucucauuauguguuuugauggcaauuaaagagucacuccuugaaaguaggugucaagaaugauggguuuguacuucccagaaagcccagacauguaaaacauaauacuguuugccuauuaggcucuaguauaagcuuguuaaaugaaugaugaaacgagguuggagcuagaauaugaacuaccuuaauuuucauguucaagaguugguaguuuauuuggcagggcagauaaauuaaaugagaugauacguuuaacacaguuccuauugauacauuuuagcuuuuaugauuaauagugcauuucaauucuaucccgcuucauaaccagaagauggagcuccaaacauuuaaacuuaaaaaaaaaaauucuccuguuuuguuguauucuugguagaggcugugcucuuauuucguugguucugguucuuuuuguuccccaccuaaauccuuccauucuaauuuuguucucagguuaucaaaauccauuugcugacuacagauaggaggagugaucugugugagaagcuacacauagauccucuuuuucuaccucuggggacuuauuugauucaugcaccuguucauacauauuuuuauccaacucuccccacu

SEQ ID NO: 14407 - RNA, 7639 nt, Homo sapiens
agggcuugguugucagcagcagcaggaggaggcagagcacagcaucgucgggaccagacucgucucaggccaguugcagccuucucagccaaacgccgaccaagguacagcuucaguuugcuacuggguugugcauucagcugaauuucauggggaaguccaaauucuaaggaaaaauauuuuuaauuguaaugcuguuaaacagacuuaaauuuucuagccuuuuuaauaagcagauuagauacauugcaggucuccuggaacaaaggugucuagauauuuugaaugccaaucaaauuuaaaacuuaaaaauacuuccacuggguccucaaaagaacggaaaccaccgaugcuaaucagaaaauaguaaaauuaaauuccccuuuggaauaauuauaccuauauaauuuucagugggugacugugcaggaauuuaaaagaaaagggaucuuuuaugcuaauuaaaccaauuacaaugcuauuuuuuaaaugauguaucucacuuuuaaggggaagaaaacccuuucugaauaugccacugcuaaauuuagcuguuaaaauauucaccaagauaccuguaugacacuguguaggcuuauuauuacaaauagaaaagcuguuggcuauuuucaauguuuuccuuugaauuucaaauuuuuagaacaucuuacuuaaauaacaaauuucagagauaguuugauuucaccuaaguagcaccuacuugauaauuaagcuaaaagucacauuuaaaguacauguuggaaaaauggauaaagcaaauuuuuuucauuuuuuucugugaguuuuuucuucucuaaaaaauauucccauacuagcuuauuaauauaauuaaguuacuguugaucuguuuguagguuuagagagcuagauauauaagguaguaaugguauaauuucuggaacucuaaauuuuaaaguugaauaaauacagacuugcaaaauuucccuuucccuugccuaauagugaaagauggauaauagguggcaauauaaauauuaacuugaaagacuauaauacuaaaaagaaaaggcaucucuaagaaguagaaaagauucuauagaaaauauauuuuauuugugaucauuuuguaaugugguaguauaaaaagguaucacuguuguaaccuaugaagaugucagcuauuccuuaugaaauauuuugcaggaaaacucacuaccaugagaauugcagugauuugcuuuugccuccuaggcaucaccugugccauaccagugaguacaguugcaucuuaaagaaaauuccugaaaauaacugaauugugugcuuccaugugcuaggaggacauucuuguaaucuuucuucaucuuuucuguuucuaagguuaaacaggcugauucuggaaguucugaggaaaagcagguaagcaucuuuuauguuuuuauauaguuaaaucauuuacucaauuauggcgagaggugcaagaaacguauuugcugcgauauuacuuaucuucucagucaaauccauugguuuacaaguauugauugacugccugcuaugaaucuaggccaguaccaagcacaguauaguuuuuaauaaauauaaguuuauaaaaccaacccagauauuuuaaauauaauaauaucuaggcauguaugaugaguuaucgcauguaagauaaguuauaugaaguugugugacuuuuuuuccauuaguccacauacugaucuaaaagcagaaaauuccagcuuuugcuuuguuuaguggauugcuaaguuuaaaauucacauuggauauuagucagaacuguuuguaugaccauaauauucacaauauugucugagauauuagcugagaagcccauugugaaaagaaagucuaugugugcuguuuguaucuauugugauugucagcugauguuagaucacauuuucuaaccaaacauaagaccaaccaaacucuuuauuauaauuauuugaccagcacuaaagauguaccuaccccuccacaacagaugaaacugugccagccaaacaacaaaugggcauuguccccagaagcuuggacaaaaaggcacacagaguucaauuccaguugaacagaauaaaggccaaaauagagcugccuugggggucacugcaauuagacugcuuaaugaagacauuaaaagaaguauucuguguucguuuguguguggaggggugugugugucuguuuuucaacugauuugaaaauacagguguugaauccuaauaauaaaccagaaaaauuaacaucuccagagaagauagaggucauacuauuugaggcaagaauuagcgucuuuuuaauaaacgaaaauauggcaaagaugcauuuuagaaggcacguggagcuauaacaauuuaagaaauacgugaagagcucaaggcucagccuucuagaaucccagaaacuuaaagcuaguaaaaaauuggggaagucucuaaggauauaugccugaaaauacacacugguuaucugugaguguuaggauuacugggugguuuuuagucuauucauuuugcuuaccuuuauuuucuucauauuaguuuuuaaaaauuauaaauguaacuuauacauccauucucucugagccuguauuacaugugucaugagaauagauagauagauaugaaaaagugaagagaaaaacucugaacucaucuggucucacuguuuuuccgccuucuuuuuuuuuuuuuuuuuuuuuuuuugagacggagucucgcuccgucgcccaggcuggagugcaguggugugaucucggcucacugcaagcuccgccucccagguucaccccauucuccugaguagcugggacuacaggcgcccgccaccacgcccggauaauuuuuuguauuuuuaguagagacgggguuucaccguguuagccaggauggucuccaucuccugaccucgugauccacccuccuuggccucccaaagugcugggauuacaggcgugagccacugcgcccggcuguuuuuucaucuucuuaaagcaaggaaccccuucuuucagcaaaaccuuucggagaagcccaauacuaagcuccucugguuagagccagccaugagagaaacuccaaguacuucugacugguucucucucuacucauccaccccuuagguggcugcagaaggaacucugugcaacccccagaguucucauucucagugacagggaaauguaaugauuggcccuggaugauucagcagaucagaugauacuuacucagagcaauuuccacuccuuugcaguagcauauuaucaguauuuuccagauaaauaacuuggcuaaagaaaaauccauuucauuuacaucuuuggcaccuuacagcaauagaacuuuugugcaaugauuuuaauauuauauuucuacauuggcugauaagauacauauggcuauugagcacucaaaaugugggcuagugcaacugaggaacugaauuuuuaucuucuuuuuuuuuuuuuuuuuuuuugagauggagucuugcucugucacccaggcuggagugcaguggcgcaaucuuggcucacugcaagcucugccuccuggguucacgccauucucuugccucagccuccccaguagcuggggguacaggugccugccaccacgcccggcuauuuuuuuuuauuuuuauuuuuuuuaguagaaacgggguuucacuguguuagccaggauguucucgaucuccugaccucgugauccgccugccucggccucccaaagugcugggauuacaggggugagccaccgugccuagccauuucauuuuaauuaacuuaaauuuaaauagcuccaugugguuagaggauacugaauuagcacagucuuagagaguuccuucuuguuccauggacuggacacaaugaagauuaacaguaauuaaggucacuucugguuuagaugugcuuuaucugagaggaaaauucagccagcaaacauacaaaaagaaagcacagugugaaguucgguguuaagagcuaguuugccugcguuugaacccugccuggcucugccauuuccuaccacuuaacugcacuguggcugaguuuucugaucuguaaggugggaauaauaaugauaccuaucucauaggggaaugaaaggaucaaaugaguucauauuuguaaagcaauuugaaagagugccuagcccacaguaagugcuacauaagaguuuguuaaaugaaucugcaaaaaaaaaaaaauuacaaaaagguaccuaaggguccgggugacuauaugcuuccaucaagacuagugaagaaugguuguuuuuuccauucaucccuacauuucuuuuuuuaauaaugauaaacaugcaacuuuuuuguagcuuuacaacaaauacccagaugcuguggccacauggcuaaacccugacccaucucagaagcagaaucuccuagccccacagguauuuuuaaacuucucauaauuaaacuacagugaugaaagauagccacacucaggccauuugggcugcucagaugaauccugccugccugcuggcaaacaugugcuuaggacauugacugaucugccauguuggcuucucucuguguuaagccauccacagaugaggcugaaaaauaaaaacugcuuuggauuaaaaagguuaacuuuugaauaaaaaagcuaggcaugugugaugcgcacuaacacgugccauuccuucuucagaaugcuguguccucugaagaaaccaaugacuuuaaacaagagguaaguucucauuuucaaucagaggcccaucaugccuugaagagaugaaagaaggcauugccuggauucucuucugaugaaauuucauuagcaaguuuuccagcuaauuggcagucuaaaacuugcucauaaauaaaacauguauuuacuaaauaucagaaauacuagguuuccucggauaaguuuagcauuacagaagauguuuauuaaugccuguuauuugaaacauuaaucugcuugcaauuuauuuaagguauuuuguagauaucuaauaucuaauaagcaucuaauuaaugcauaucaaagcuaagauuuugccuuuaggaaaguuuucuuuccuaauaaaauaguuuauuugacaacuauucuuuuuauuaggaucauucauauauuugcuaagcaaagaguaaauuuauuuuccuuaagauucaauuugaauauacuaagaauauuaaagcaaguuagauaaauuacccaauauauuugucaauuugaaauuugauagacauuaguuguuuaauucaaugggcaguuuugagcugcaguuuauacacacaugcauaacagagucaccuuucaauuauccauguuaauaggaaagugguuauagauuuuaguacacacauuaaaauauggauacucuucucuuuugauaaaucucauuucaaauaaaaaaaccagucucauaauuauguaucuguaucuauuacaucauugaauuuaguaaauaauguuuaauauguauaaggaaaaacaauguuauugacaugaagauuauacucacauauuuggcuugaaaauaucuauaaaaauaauuucuguugcaaaguaagaaauguucuucagaauguuauuaaucccuguguuaaaagagaaauuggaagaugcucacuuuagcuccuaaaagccaugguauguacugugaaugcaaagauucugaaacuaaauaaaaagaaagauaguaaaagacuaaugugcuauaaaggcuaagggaaaauaaaaacccauauauuaauuuucccggccaucuuaauuuucagacccuuccaaguaaguccaacgaaagccaugaccacauggaugauauggaugaugaagaugaugaugaccauguggacagccaggacuccauugacucgaacgacucugaugauguagaugacacugaugauucucaccagucugaugagucucaccauucugaugaaucugaugaacuggucacugauuuucccacggaccugccagcaaccgaaguuuucacuccaguuguccccacaguagacacauaugauggccgaggugauagugugguuuauggacugaggucaaaaucuaagaaguuucgcagaccugacauccagguaaauccuuuaacagacacaccugaugguucugacuagcgcucaagucuaggaaaccacaguuugcauauucauucauucauucauccauucauucauccauucagcaagaauucauucauauucuacuuuaugaccauugaauacaaaucuuuuucugcuuggcgguuuuuguaagucuacauaauuucucucuagauuugauucucaaacacaauucuacuuuuugaaauccuggaucacuuauuuucagauuaaaauaaauggaaaacaccaauuauuuaaaaaaaauaauggucauguuuugaaguuaaauaccuaagaggaauuguaguugcaaauuacacugaauccuuagucacagaaucuggauuugacauagccuugccguuuacuauucucuuuacuuuuuaacuaacaauucacuuccucuuuauguagguuucaauauaaugaaaccuaccucauagguuucauuacauauguaagugauguaguuauuaaacuaaaugagaugacauaugugaaaggccuugguaaaguacuauacaaaguaacaugcuaguauuauuucagccagauuuagacaauuuuuaguauaagaugaccuaaaagcuagagaguggaaaaggauuaccauauucccaucccuagccguucauauaauuauucuucauuugugccgugauucaguacccugaugcuacagacgaggacaucaccucacacauggaaagcgaggaguugaauggugcauacaaggccauccccguugcccaggaccugaacgcgccuucugauugggacagccgugggaaggacaguuaugaaacgagucagcuggaugaccagagugcugaaacccacagccacaagcaguccagauuauauaagcggaaagccaaugaugagagcaaugagcauuccgaugugauugauagucaggaacuuuccaaagucagccgugaauuccacagccaugaauuucacagccaugaagauaugcugguuguagaccccaaaaguaaggaagaagauaaacaccugaaauuucguauuucucaugaauuagauagugcaucuucugaggucaauuaaaaggagaaaaaauacaauuucucacuuugcauuuagucaaaagaaaaaaugcuuuauagcaaaaugaaagagaacaugaaaugcuucuuucucaguuuauugguugaauguguaucuauuugagucuggaaauaacuaauguguuugauaauuaguuuaguuuguggcuucauggaaacucccuguaaacuaaaagcuucaggguuaugucuauguucauucuauagaagaaaugcaaacuaucacuguauuuuaauauuuguuauucucucaugaauagaaauuuauguagaagcaaacaaaauacuuuuacccacuuaaaaagagaauauaacauuuuaugucacuauaaucuuuuguuuuuuaaguuaguguauauuuuguugugauuaucuuuuuguggugugaauaaaucuuuuaucuugaauguaauaagaau

SEQ ID NO: 14408 - RNA, 7639 nt, Homo sapiens
auucuuauuacauucaagauaaaagauuuauucacaccacaaaaagauaaucacaacaaaauauacacuaacuuaaaaaacaaaagauuauagugacauaaaauguuauauucucuuuuuaaguggguaaaaguauuuuguuugcuucuacauaaauuucuauucaugagagaauaacaaauauuaaaauacagugauaguuugcauuucuucuauagaaugaacauagacauaacccugaagcuuuuaguuuacagggaguuuccaugaagccacaaacuaaacuaauuaucaaacacauuaguuauuuccagacucaaauagauacacauucaaccaauaaacugagaaagaagcauuucauguucucuuucauuuugcuauaaagcauuuuuucuuuugacuaaaugcaaagugagaaauuguauuuuuucuccuuuuaauugaccucagaagaugcacuaucuaauucaugagaaauacgaaauuucagguguuuaucuucuuccuuacuuuuggggucuacaaccagcauaucuucauggcugugaaauucauggcuguggaauucacggcugacuuuggaaaguuccugacuaucaaucacaucggaaugcucauugcucucaucauuggcuuuccgcuuauauaaucuggacugcuuguggcuguggguuucagcacucuggucauccagcugacucguuucauaacuguccuucccacggcugucccaaucagaaggcgcguucagguccugggcaacggggauggccuuguaugcaccauucaacuccucgcuuuccaugugugaggugauguccucgucuguagcaucaggguacugaaucacggcacaaaugaagaauaauuauaugaacggcuagggaugggaauaugguaauccuuuuccacucucuagcuuuuaggucaucuuauacuaaaaauugucuaaaucuggcugaaauaauacuagcauguuacuuuguauaguacuuuaccaaggccuuucacauaugucaucucauuuaguuuaauaacuacaucacuuacauauguaaugaaaccuaugagguagguuucauuauauugaaaccuacauaaagaggaagugaauuguuaguuaaaaaguaaagagaauaguaaacggcaaggcuaugucaaauccagauucugugacuaaggauucaguguaauuugcaacuacaauuccucuuagguauuuaacuucaaaacaugaccauuauuuuuuuuaaauaauugguguuuuccauuuauuuuaaucugaaaauaagugauccaggauuucaaaaaguagaauuguguuugagaaucaaaucuagagagaaauuauguagacuuacaaaaaccgccaagcagaaaaagauuuguauucaauggucauaaaguagaauaugaaugaauucuugcugaauggaugaaugaauggaugaaugaaugaaugaauaugcaaacugugguuuccuagacuugagcgcuagucagaaccaucaggugugucuguuaaaggauuuaccuggaugucaggucugcgaaacuucuuagauuuugaccucaguccauaaaccacacuaucaccucggccaucauaugugucuacuguggggacaacuggagugaaaacuucgguugcuggcagguccgugggaaaaucagugaccaguucaucagauucaucagaauggugagacucaucagacuggugagaaucaucagugucaucuacaucaucagagucguucgagucaauggaguccuggcuguccacauggucaucaucaucuucaucauccauaucauccauguggucauggcuuucguuggacuuacuuggaagggucugaaaauuaagauggccgggaaaauuaauauauggguuuuuauuuucccuuagccuuuauagcacauuagucuuuuacuaucuuucuuuuuauuuaguuucagaaucuuugcauucacaguacauaccauggcuuuuaggagcuaaagugagcaucuuccaauuucucuuuuaacacagggauuaauaacauucugaagaacauuucuuacuuugcaacagaaauuauuuuuauagauauuuucaagccaaauaugugaguauaaucuucaugucaauaacauuguuuuuccuuauacauauuaaacauuauuuacuaaauucaaugauguaauagauacagauacauaauuaugagacugguuuuuuuauuugaaaugagauuuaucaaaagagaagaguauccauauuuuaauguguguacuaaaaucuauaaccacuuuccuauuaacauggauaauugaaaggugacucuguuaugcauguguguauaaacugcagcucaaaacugcccauugaauuaaacaacuaaugucuaucaaauuucaaauugacaaauauauuggguaauuuaucuaacuugcuuuaauauucuuaguauauucaaauugaaucuuaaggaaaauaaauuuacucuuugcuuagcaaauauaugaaugauccuaauaaaaagaauaguugucaaauaaacuauuuuauuaggaaagaaaacuuuccuaaaggcaaaaucuuagcuuugauaugcauuaauuagaugcuuauuagauauuagauaucuacaaaauaccuuaaauaaauugcaagcagauuaauguuucaaauaacaggcauuaauaaacaucuucuguaaugcuaaacuuauccgaggaaaccuaguauuucugauauuuaguaaauacauguuuuauuuaugagcaaguuuuagacugccaauuagcuggaaaacuugcuaaugaaauuucaucagaagagaauccaggcaaugccuucuuucaucucuucaaggcaugaugggccucugauugaaaaugagaacuuaccucuuguuuaaagucauugguuucuucagaggacacagcauucugaagaaggaauggcacguguuagugcgcaucacacaugccuagcuuuuuuauucaaaaguuaaccuuuuuaauccaaagcaguuuuuauuuuucagccucaucuguggauggcuuaacacagagagaagccaacauggcagaucagucaauguccuaagcacauguuugccagcaggcaggcaggauucaucugagcagcccaaauggccugaguguggcuaucuuucaucacuguaguuuaauuaugagaaguuuaaaaauaccuguggggcuaggagauucugcuucugagaugggucaggguuuagccauguggccacagcaucuggguauuuguuguaaagcuacaaaaaaguugcauguuuaucauuauuaaaaaaagaaauguagggaugaauggaaaaaacaaccauucuucacuagucuugauggaagcauauagucacccggacccuuagguaccuuuuuguaauuuuuuuuuuuuugcagauucauuuaacaaacucuuauguagcacuuacugugggcuaggcacucuuucaaauugcuuuacaaauaugaacucauuugauccuuucauuccccuaugagauagguaucauuauuauucccaccuuacagaucagaaaacucagccacagugcaguuaagugguaggaaauggcagagccaggcaggguucaaacgcaggcaaacuagcucuuaacaccgaacuucacacugugcuuucuuuuuguauguuugcuggcugaauuuuccucucagauaaagcacaucuaaaccagaagugaccuuaauuacuguuaaucuucauuguguccaguccauggaacaagaaggaacucucuaagacugugcuaauucaguauccucuaaccacauggagcuauuuaaauuuaaguuaauuaaaaugaaauggcuaggcacgguggcucaccccuguaaucccagcacuuugggaggccgaggcaggcggaucacgaggucaggagaucgagaacauccuggcuaacacagugaaaccccguuucuacuaaaaaaaauaaaaauaaaaaaaaauagccgggcgugguggcaggcaccuguacccccagcuacuggggaggcugaggcaagagaauggcgugaacccaggaggcagagcuugcagugagccaagauugcgccacugcacuccagccugggugacagagcaagacuccaucucaaaaaaaaaaaaaaaaaaaaagaagauaaaaauucaguuccucaguugcacuagcccacauuuugagugcucaauagccauauguaucuuaucagccaauguagaaauauaauauuaaaaucauugcacaaaaguucuauugcuguaaggugccaaagauguaaaugaaauggauuuuucuuuagccaaguuauuuaucuggaaaauacugauaauaugcuacugcaaaggaguggaaauugcucugaguaaguaucaucugaucugcugaaucauccagggccaaucauuacauuucccugucacugagaaugagaacucuggggguugcacagaguuccuucugcagccaccuaagggguggaugaguagagagagaaccagucagaaguacuuggaguuucucucauggcuggcucuaaccagaggagcuuaguauugggcuucuccgaaagguuuugcugaaagaagggguuccuugcuuuaagaagaugaaaaaacagccgggcgcaguggcucacgccuguaaucccagcacuuugggaggccaaggaggguggaucacgaggucaggagauggagaccauccuggcuaacacggugaaaccccgucucuacuaaaaauacaaaaaauuauccgggcgugguggcgggcgccuguagucccagcuacucaggagaauggggugaaccugggaggcggagcuugcagugagccgagaucacaccacugcacuccagccugggcgacggagcgagacuccgucucaaaaaaaaaaaaaaaaaaaaaaaaagaaggcggaaaaacagugagaccagaugaguucagaguuuuucucuucacuuuuucauaucuaucuaucuauucucaugacacauguaauacaggcucagagagaauggauguauaaguuacauuuauaauuuuuaaaaacuaauaugaagaaaauaaagguaagcaaaaugaauagacuaaaaaccacccaguaauccuaacacucacagauaaccaguguguauuuucaggcauauauccuuagagacuuccccaauuuuuuacuagcuuuaaguuucugggauucuagaaggcugagccuugagcucuucacguauuucuuaaauuguuauagcuccacgugccuucuaaaaugcaucuuugccauauuuucguuuauuaaaaagacgcuaauucuugccucaaauaguaugaccucuaucuucucuggagauguuaauuuuucugguuuauuauuaggauucaacaccuguauuuucaaaucaguugaaaaacagacacacacaccccuccacacacaaacgaacacagaauacuucuuuuaaugucuucauuaagcagucuaauugcagugacccccaaggcagcucuauuuuggccuuuauucuguucaacuggaauugaacucugugugccuuuuuguccaagcuucuggggacaaugcccauuuguuguuuggcuggcacaguuucaucuguuguggagggguagguacaucuuuagugcuggucaaauaauuauaauaaagaguuugguuggucuuauguuugguuagaaaaugugaucuaacaucagcugacaaucacaauagauacaaacagcacacauagacuuucuuuucacaaugggcuucucagcuaauaucucagacaauauugugaauauuauggucauacaaacaguucugacuaauauccaaugugaauuuuaaacuuagcaauccacuaaacaaagcaaaagcuggaauuuucugcuuuuagaucaguauguggacuaauggaaaaaaagucacacaacuucauauaacuuaucuuacaugcgauaacucaucauacaugccuagauauuauuauauuuaaaauaucuggguugguuuuauaaacuuauauuuauuaaaaacuauacugugcuugguacuggccuagauucauagcaggcagucaaucaauacuuguaaaccaauggauuugacugagaagauaaguaauaucgcagcaaauacguuucuugcaccucucgccauaauugaguaaaugauuuaacuauauaaaaacauaaaagaugcuuaccugcuuuuccucagaacuuccagaaucagccuguuuaaccuuagaaacagaaaagaugaagaaagauuacaagaauguccuccuagcacauggaagcacacaauucaguuauuuucaggaauuuucuuuaagaugcaacuguacucacugguauggcacaggugaugccuaggaggcaaaagcaaaucacugcaauucucaugguagugaguuuuccugcaaaauauuucauaaggaauagcugacaucuucauagguuacaacagugauaccuuuuuauacuaccacauuacaaaaugaucacaaauaaaauauauuuucuauagaaucuuuucuacuucuuagagaugccuuuucuuuuuaguauuauagucuuucaaguuaauauuuauauugccaccuauuauccaucuuucacuauuaggcaagggaaagggaaauuuugcaagucuguauuuauucaacuuuaaaauuuagaguuccagaaauuauaccauuacuaccuuauauaucuagcucucuaaaccuacaaacagaucaacaguaacuuaauuauauuaauaagcuaguaugggaauauuuuuuagagaagaaaaaacucacagaaaaaaaugaaaaaaauuugcuuuauccauuuuuccaacauguacuuuaaaugugacuuuuagcuuaauuaucaaguaggugcuacuuaggugaaaucaaacuaucucugaaauuuguuauuuaaguaagauguucuaaaaauuugaaauucaaaggaaaacauugaaaauagccaacagcuuuucuauuuguaauaauaagccuacacagugucauacagguaucuuggugaauauuuuaacagcuaaauuuagcaguggcauauucagaaaggguuuucuuccccuuaaaagugagauacaucauuuaaaaaauagcauuguaauugguuuaauuagcauaaaagaucccuuuucuuuuaaauuccugcacagucacccacugaaaauuauauagguauaauuauuccaaaggggaauuuaauuuuacuauuuucugauuagcaucggugguuuccguucuuuugaggacccaguggaaguauuuuuaaguuuuaaauuugauuggcauucaaaauaucuagacaccuuuguuccaggagaccugcaauguaucuaaucugcuuauuaaaaaggcuagaaaauuuaagucuguuuaacagcauuacaauuaaaaauauuuuuccuuagaauuuggacuuccccaugaaauucagcugaaugcacaacccaguagcaaacugaagcuguaccuuggucggcguuuggcugagaaggcugcaacuggccugagacgagucuggucccgacgaugcugugcucugccuccuccugcugcugcugacaaccaagcccu

SEQ ID NO: 14409 - RNA, 71276 nt, Homo sapiens
cugccagaagcccacagaggugucuaagcaucaacgugacaaauaagcagcuuugguucugcaauauaaccuggaaauagugaggacaccgacguggagaauagagaugggaguugacagggaucaauuguucuaaugcggaauaaugcaagacauaagaucaagccagcaggagugagaaacagagaucauaucagggugauaucuguggggcaaaaguaacaagaagauaagguguaggcgguggaggguaaaccgcgaggcuuccaugaagaagaguggccugggaagugaggaggacagcgaagccccaaaccucaccuugggauacgggaagugaagcagguuccagagaaggggacaagauaaugacuuaggguaggauaaauuucagacaauugcagagcaucacauuagauguguucagaagaguggaaauaaaguucugugccuaggcccucaugcaggauucuguugcuagaagucagugcuggccgcagggagaccggagaucacaguggaggcaccagcgauccgagaguccuaugacgaaucccugggauccccacaauguguggagacagaagccaaccaaagagcgagaaagcaucuccaaaccagcagaaucaggggcaggaggcccgccaaaugcacagcaagucagccuugguaguuugcaaauggaaagauuucuuugacccgcuggagacuucagcucaggcuggaugucgcuaauucacaccaucucaccaaaagguucuuucccugcccuuuggugaaucgaggcagaaguggcugguggauaacugggacccaagaguuaucucagcgucgggcaggcaucgacagcuccaggagcccuuucccugcaggcgggcuggcgggugagcgauucccucccuucccaggccuucccgggaauggaacgugggcgcccgcgcccgggcuccgguuccacuuggaacgcggacucgggagccgccgggcgagcgcgcagaccgcgggggcggcucccucgcaccuccccgcucagcgcgccgcggcggaugggcgaggcggggcgaggccagagggaggcgggccaaaggggcgggcgagaggacgcgggaccgcggggaggucgggggcggggagcaggcggcggcgggcgccgggaagaaaggaacauggcuccugaggcgcacagcgccgagcgcggcgccgcgcacccgcgcgccggacgccagugaccgcgauggugaacuccagucgcgugcagccucagcagcccggggacgccaagcggccgcccgcgccccgcgcgccggacccgggccggcugauggcuggcugcgcggccgugggcgccagccucgccgccccgggcggccucugcgagcagcggggccuggagaucgagaugcagcgcauccggcaggcggccgcgcgggaccccccggccggagccgcggccuccccuucuccuccgcucucgucgugcucccggcaggcguggagccgcgauaaccccggcuucgaggccgaggaggaggaggaggagguggaaggggaagaaggcggaauggugguggagauggacguagaguggcgcccgggcagccggaggucggccgccuccucggccgugagcuccgugggcgcgcggagccgggggcuugggggcuaccacggcgcgggccacccgagcgggaggcggcgccggcgagaggaccagggcccgccgugccccagcccagucggcggcggggacccgcugcaucgccaccucccccuggaagggcagccgccccgaguggccugggcggagaggcugguucgcgggcugcgagguaagagcgcgcgacccgcagcggcagaugcacgaaccagaacggccggcgccggccggggccaucgcccgcugcggcagcuccccgggcuccaucucgcauccccucugcguuccgccucccuuggaagcgcauuccccaccuccgcuagugcugcccuauuuccgguacccagcgcggaauuccacugcucuuuuguuggugcauauuuauuggauaccuccuucuucaggauaugucaccauagucuuuuuuacugaaaauuagugaaagccuaauuagagugaaagaguacaucuggguuuuguuuuuuuuuuucuuguagaggaaaaaaugaacauuacuuguguaacugaugguaguugcaacugcauauuugccaaugucacaaaaucuaaaggaaaauguuauagucacccgugguuuccuucuugccuggacacuccauugucccgggcugaaaaggguagcaguacagugcauauaaugucaaguugugggaggaguguggcagauugucauuggugcauuuuuuuggugaugugugugguuguuuugaggagugggagcuguuaagaacaccacaaauagaauaaaauaauaucgugaaguuauuuggccguuucuaauucuagacauuuuucuaaaaacaguugcaaaggaaagauuacauuguuuuaaaaaaauuugaaguauguuuuuaaauaacuaaauuaauguucuuugaaauuccaccaaaaugaugaagucaccagauagcagcugauaaaugugucugagcccagugcgcccagcucuacaaaaggcagaagaggaauuuucaaauuugccagugcccaguaagaggacaugaauuuucuaguaccagaggaaauucucuuuuuacaaauuuugucagagguauccuugggaaaguauuucauuugcuuuuacccuccaaauuauuuuaaucuauauuuuuaagaguuuccauucucaguugaguuuuucuuguucuucuccuucugucaguuuugaaagucuugcacaaaaacaauccagguguuguuacagcagugugauuaaaaccaggucaggccuacacugaaaucccaguuccaccacucauuagcuguacgaccuugagcaaguuacuuauccucucugauacccaauuuuuggauuuuuuuuuuuuuuaaagagaugaucauaacgcuuaggacuugacucuuugggagaauuaagugaguuaagacauaaaaugugcagcauguauuugucauguuauuagcgcuucagaaauauaaauguaaacauuuugguacuucguuuauggagauucuuauacuaguuaauuuuauuaaaagcaugauggggaacagaagauccuuuucggauaaccugugugaguaaauuaauaaaacacuaacacuuuuuaagauucaaaacuggauuaauuauguuauuuuacaccauuuaaaaugugcauuuaaaaaauauucacugaagugagagagaaguuccuuuuaaguuaauaaauaaugguaaguugcaugauccuuuuaacucaguuuaagcauuugauaacaccccuaaccuuguuugaauaaacucaauaacagaauauagagaaauaaaauauauauuucauaugaguauguauguaaauuuauuucuuuuaaaggaaaauuucaggaaacaaaaugaauaagcucauagucauaaaaccucuagccaaagugugucaauggucugauuuguaggagagcagacucaggaaucgggaauuuuuuuuuuuuuuuuaagagucgggguuucacucugucacugaggcuggagugcggggaagcaaacguagcucacugcggccucaaacuccugggcucaagcugcccucccaccucagcuucccaaguaguugggauuacaggugcaagcugcugcuccuagcugaaaaguuuuaauuauauaaaauguuuaaauaaauuguuauuccuuucuuuuaugaagaaauauaauugauauucuugucacuuauuaaauaagcaacauuuuaaaauguuuagcaccuacugugaagauagcacugugcuagcugcuaugaauaaacuagaauagcauaucacuguuuuccuauggacaaaaacccagaaauguaaaauaaauagccaugaauggguugagauucccccugcccccuuuggauacugaugacagaaaucuuauaugcacuauguaagcagugcccuaggaucagaacagaaaguaacuugcaauuuuuaaaggugggagaaaugacugaaguuuggaguggucaggaguuucccuggaagucucuugccuuugugacuuuguauagcucccucaaacuaccugagccugagcuccucauuuauaaaauggaagaauugaaccuagcuuccaagguccuuucuagcuucaccaugcucuggucuguuguuuaaugacaugaauccaagauggacaacaaauggucgauuuugcuccuucuacaguaaauagaucuaucuucuuagcagaaguaaaauaguaaagaaagaagacauguuugaggccuguugaggccuguuugcuguaugcauuguaucuaaucaaggaauugagaauguagcccuaaauauuaggaaggaguugaaaguuucugagcaggaacagaacaugcugaaaggaaauugugucagcagcaugguguacaggagagcuuggcagagagaaaggaggcaagaagaccugugggaggcagccaguaaggaggugaagagggccuggaccaaaggaagccaaggaugaccgaaagauuuaaagaugaagcccagauuuaaaaguauccucaaguauuuguuuauucuuuucuuagcaaauucuuuuuaguacaaagauaaaauauggcacucugagucauaaaauuuucugaauuucagaaguugaauguuuuucugaauguaucaaccuguuaaagucaguuccuguuuguuauuuuaggcguauauucuugggcuuuuuuuuuuuuuuccuagagaaacuaugaaguacuagcugugcaagucagggugggcuaagcugcuaaaacagauaccucccuccccuucaauacccugaagaacaagaaguuaauuuuuugcucguguaacauuuuagagaggguauuccagguugaauaccuggaauaaugaaugaaauaauaagucgacucuuauuucuccuaaaauaauuggaucuugacauugaaauuggugugcugauuguauuuaauaagugaccuccaaugcaguuauuucauuuugccauacuuuauguaauuuuuauuuuuucugccuucccuuucgaugucuaaagggaagcauaauuaguuauuggaaagguuauugagacuuaaaaaaagauuugaacauggcuuugguugaugcuaccacacagaaacugcaaacauccaacucaccgcucuuaguugcuguucaugauagucuaugcacagugacugaugaauuuagccugucuugaggcuucagaacuuagucuuaugucaucacgagcagagcuuuauccuaaauuacagguuuucaaugggggggggggggaggggcaguuuugccccucaggggacauuuggcaaucucuggagacauuuuugauugucauaccuggggggaugccccuggcaucuccuggguugagguuaaggaugcugcuaaucuacaaugcacaguacagccaccccacacacacacacuacaaagcauucucccacccaaauugccaggagugaggacuuugagaaacccugcccuagacuguuaaauucaaaaggaaauaaugguuuauugcucacagugugccaggcacuguguuaaacuccuuauauucauaguuuuguuuuuauccucacaacaaccugugaagaaagaacucucauccgucaccacuuuacuguugagggcacuaagccuucuaaagguuaaaugacuugcccagggccgcaacuauuagauguugcagucaggauuuaauuccaggcacuuuguguucaaaguguuucucauccacugugcuauaugccaguagugcccaaaccuaacuuuagccagcaauugucugcaucucuucaguuuaugaacauuuauuuauuaggacaugcaggauaaucauaccaacacaguccguguauccagaauucuaauugaucuagggagugggagagccugccucucuauuuuuuuuaaauuggugugaaauauacauaacauaaaauuggccauuuuaaccauuuuaaguauauaauugagugacauuagguagauuuauuauauuauguaaauggacuuaacacaauuuauuuccagaacuuuuuuaucaucccaaacagaaacucuguacucauuaaacaguaacucccuguuuccccacucccccuugccccagacgcuaguaaccuccauucuacuuccccuuucugugagucucccuguuguagcuaccugauguaagugaaaucagaccauguuugaucuuuugugucuggcuuauucacuuagcauaguauuuucaagguuuauccaugcgugcaaauucccuucuuuuuuaugacgaaauacuauuuaauuguguguguacaugugcacacacaaugaaauacuauuucaucauaaaaaggaaguuuguacacauauauacacacacaccaaauuuuguuuauccauucaucaguucaugggcauuugcgguuuuuuuccaccuuucgacuguugugacuuuccguuuauuuuuaaucugaacuuuacuccaucacuuccucccuuuccuuuuuuauucgcaccauaauuuugaacaagcagacuuuguauuuucauuacucuggggauuuuuuugagggaggcuugcuacccuuugggguugugguaagguugugccaguaacagaauucaugcaguaaaaaacauucaugggacuuucuuuugugauagguacuagggaugcagagaugaauaauacaaggucucgaccuucaaggagcucaggguuuaguagggaaaacagagguauaaguaagucauugcaaugccaggucccagauaugggaggauuccagcaaagagaggauaaggccaggcacagccgcucaugccuauagucccaacacuuugggaagcugagaugggaggaucacuuaagcccagcaguucaaggcuacccugggcaacauagugaguggcaaaaaauacaaaaauuagccaggcaggguggcacaugccuguggucccaguuauuugggaguuugaggugggagaaucaccugagccugggagauugaggcugcagugagcugugaucacgccacugcacuccagccugggugacacagugagaggugagagccuguaucuaaaaaaaaaaaaaagagaggaucagauuuaccuggagaggucagagaagguuuccagagggaguaaaacuugagcuucauuuugaagaaugagaggggaauacaaggagggaaaaauaauaggaacaagaccuguuccuguuacagcaaaccuguaacucccaccauggaaugggcacguuuuccuguagacauuuggagccagugugggcuucaagccuagggggcugauaugaucauuugucaaucugaagaugacucuuggaacaacguagaggauagggugagguggguaggcugguggcugacagacuaggucaggagagggcugaccaagaggaggaggggugacgagggcuggaacuaaggcauaugagcugggauggaaagaagcuagauagaaaggaaacaaaaaccaucagaacuguggaaccaacuccaugggagggauaagaagagggccuauucuagggugaaacccaaauuucuggcaugguaccauuaacccaaacagaaagaggagauuuccagagaaagaaaagcaaauuuugcgggaggugagugugagcugucuagagaauaugcagguagaacuacauguuaacuguaacauauacuugucugcaccucaggagauggcugauuaagaauucaggauucaggccaggcacgguggcacacgccuuuaaucccagcugcuuaagagacuggggcgggaggauugcuugagccugggaauccgagaucagccugggcaacauagcaagacacugucucuaaaaaaaaaaaaaaauucaagauucuggagucaauauuacuuaagguagcaacugucuauucuauagaaaauggacaaauauagauaaaaagccacuucccuuucuaaaagugucccugcaauucaagugaauacuaggaaggauuguguucauucuucuaaacaagacucacauguaucuuagcacaaaaagaggauucuuuuaugauacaaaugcacugagaauuuggucaggcuaucacaaugaacugauaguucagauggauuugagucuuuauaccacucuggaaucuggaccaacugggccuccuaaggccauuuugcagaucugggcuuguuucugaagcuacagacaggccucuuccaagcacucuaagugcuccacaaauaauauuucuguuucccagaacaaccccacaaaaagguacucuuacuccauuuuuagaugaggaaguggaggcucaugaugucagguaagcuuucucagcucccaagugguuaagcccucaguuuaaugucauuugacuccagagcccuauguugcaccaugccuugauaauaggccauauggguuucauguauuucagauggggaagguuagugugaggugaaagauacacaauuaaccuuuuaaccauggaacugaaauauuuacagaugaagugauacaauagcuggaauuaauuccaaaauaauuggggugguacugguccauggccuguuaggaacugggccgcagagcaggaggugagcagcaggcuagugagcauugcuacccccuaucauaucagcaguggcaucagaugggugaggauguaaaugaacuaggauuggcauugaguugauauuguuggaucuaggugauagauuuaucauuauaauauucucucuuugugauauuucugauauuuucuaaaauaaaaaguuguaguuauuuauuuauuuagacggaguuucacucuuuugcccagguuggagugcaguggugugaucucggcucacuguagccuccgccucccggguucaagcgauucuccugccucagccucccgaguagcugggacuacagccucccgaguagcucaccaccacacccagcuaacuuuuguauuuuuaguagagaggagguuucaccauguuagauaggcuggucucaaacuccugaccucaggugauccacccaccucggccucccagagugcugggauuacaggcgugagccagugugcccagccaauaaaaaguuuuugaaaggauuuagauaaaauaguuggggaaauggcauuuuuguucaaagccaauuauuuauguuuggaauaucuuuugugcuuggaguucuccauuacagaguuccccaguguuccuauuaauaaguaacauugagcagaggaaugcacuguuuagaucagcaguccccaaccuuuuuggcaccagggaccggcuucauggaagacaauuuuuccacagaccugggguaggaaguguuuggggaugaaacuguuccaccucagaucaucaggcauuagugagauucucauaaggagcaggcaaucuagauucuucacaugcgcaguucacaauaggguucucacuccugugagaaucuaaugccaccccugaucugacaggaggcggagcucgggcgguaaugcucacuugccugcggcucaccuccugcuguggggcccgguuccuaacaggccauggaccaguacccgucugcagccuggggacuggggacccugcuuuagaugauguacucuggcuuugcauucuggcauuagcuaagcacccucuuaaaggaaauugggucuauacucucaguccguguucucccuaacaccuggaaacauugaauaccuucaaugcugggaaguuaacucccaccacaacuagaacagcuaugggaaagacaacaguugauuuugaagagugucaccaauuugcacaugauuccauccuuaaccauucuuauccuaucagcucugccaaacauggagaauaguuggcugcaggacagcuauuuuuccuacuuguagaugcaacuauuucucacccaccaggauguaaaaggucccuguacccuaagauugguccuacauacacacccaaugggaaaaugagaugaaaaauuuaaagcaguaaauauuugaggaaguagauagaguaauuuagaaaaagaaaauacacagggccaagcacaguggcucacaucuguaaucccagcacuuugagaggccaaggugagaggauugcuugagcucaggaguuugaggccagccuaggcaauguagugagaccccaccucuacaaaaaauuaaaaacuuaguugggcuugguaguauguaccuguaguuuaagaaacuugggaggcugagcugaggcaggaggauuguuugagcccggguggucaaggcugcagugggccaugauugugccagaguacuccagccugggugauagagugagacucugucucaaacaaaaaaaaaaacagagacagaaaaaaagaaagaaaauauauggauguauaucauauaaaaauauaaauaagggaggccaagugcaguggcaugccuguaaucccagcacuuugggaggcugaagcaggaggaucacuugaggccgagaauucgagaccagccugggcaacguauugagaccucaucucugcaaaaaaucaaaaaaugaggcggaaggauggcuugagcccaggagaucaagccuucagugagcugugaucguaccacuacacuccaggcuggguaacagagagagacccugccucaagauaaauaaauucauacauacauacauacauacguacauacauacauacauaagaagacuuguuucuuuccauuugcaauguuucauucaaaggcuagaauuaaauugccguaggccaucacaaguuuagcuugaauauuauuauuuuuucaagauggagucucacucugucacccaggcuggagugcaguggugugauuuuggcucacugcaaccucugucucccggguucaaccgauucuucugccucagccucccauguagcugggauuacaggcgcccgccaccacaccuggcuaaguuuuguauuuuuaguagagacaggguuucaccauguuggccagacuggucuugaacuccugaccucaagugaucuacccgccucacccucccaaagugcugggauuauaggcuugagccacugcacccagccuagcuugaagaaaauuugauaggaguuuguuuuuuucuauuuauaggccaagcaauaccacguauaaauauuaagaaucauggcuguuccuuagugccuaguuguuuauaaaccaugggaaagaaugaaaucauugaccaaaugagacaggguaacagucuucccugggaguaaagagacuagcagucucuauugacauauauuuuaggccuggccuccaaaauaaauuuacccaaagaagugauguauuuguguccagggcuaccgagccuaaucuuuggcugccucuguguuauucuaaguuguaauuuuccaugucaucuaaauuuguaauaauucuuuaauaugauaguguuucagugaacaaacauucugcuugcugcauuucuucugagugaguaauucccugacaacuaccagaucuuggcagaagcaaaguuggucauaaguuaugcuccacucucagugcuggugaaacguaugaugcguaacacaguguuuuugaauucagugcugauuuuccuaaaggacauuuggaaggaaaaaagaaaaggaaaggaaauacccaaauucaggaauagaacuuacauauuauuauaagacuuaaaaaauacaugaacacuaaugaugaacucauuucuucgaaguaaaaggccuuaugcuauuuuuucccauuucccuauguggcuugauuguggcgaaaguggcugugugaguuuccauuauugaaggaguuaaggucuguggaaucaaagcaugagacaacaugcaaggaccagguugguuuccauuuaacagccaaccuaaucuaacugaaaggauugagagguuugucuuuuuuggaaaguguuaagguucuuccaaguaaccagcaaugugacuuuaccacacuguucauuaacggggcuuuggauggccaccaugucugcugcuggcugaguccaaaacugcggucacucucuccagcaagcucauggaggguuacgucaucuucacucagccagcccaacgcuuuuuccaucugcuaaaauguagaacaugguuguugauucuacucuuucuacaaagaaagagagggaacauggaugaguugcugcuuuuaaagauuauauguuaauugcuguuuuaaaaaucugcucagcuaagcacgcuuaguguaaucagucaccauggaguuuuuuaauaggacagcuucugcucuuacagagcagaguuuuuaugccaguagguuagaagcauaacauguuucuauauugaagugauucuccaacaaggacuucuuuucaucaggggugaccuaaaaguuauuacuugaaauauaauuacaucauguucuuaacuggguuuaguaguaggauaauuacaagguuguauccaccucaaauaggaagaacugauaaguuuugcacaauuauuuaacuccucuguuaggccuuccuuauuuccuguucucuuuuuaaaauuugacuaagauauugcuaaugggcuugggagccuauaaaaugaucagaauuguugccuuauguuuugcauguuugggguaacauuggagccagauguacucuuaaauaaaagguaggccuacaaaaccaguuucucaguugcauucaaaaugugauuaaaaaaaaaaaaaggagaaucucccuuauaggugaacuuuuuaauuugugcuuuauuuucccuuuugccauucaugagauuucuuaaauaaaaugauaucuuuucuuuucuucauuauuauuuuaaaggucucuggggaacaagacucauggaggaaagcagcacuaaccgagagaaauaccuuaaaaguguuuuacgggaacuggucacauaccuccuuuuucucauagucuugugcaucuguaaguagaauauuuccuugcacuaaugggaaaguuuugaaaagauuugaccuauccaaaucauaauuaaaaggaaguguguaugcaccagaggggcaacugggaaguuaccuucuuaccuuuguuuuuaauucuaauauuuuuauuugggcauuuguuuauugacuaucuuccuaugguagaaugcaagcuuuauaagagaagggacgugauuuguucucugcuguacccccauuucccaaaacugcagauggcaacagaaggcucugaaaaauauauaagaaagaauuuuucuaauugugacuaaauugugaccaaaugcuaagugacuguggacuugcguuuaacacaggacgggagaggcaaagaguucaauuccaauuuagaauuuggucaaguucucuucugcacucugguaaacauuaauuaaaaaucagcauuaucugaccagccaguucaucgucagugguggugauuuucacuaugagauacgcguggcaacuugccagacaccaagaaaccaaguuagaggauuuuuguauuagauuccuuaacaaugaauacaguaucaccauuauuacaguaucaucauuauugucauacuauuauuauaucaguuaacauaaagucugcauaagaauuguuuccagaaaaaugacuuuccaaauuuaacuuucaggaaauacaaauaaugcuacuaauauugcuuuuauuggcguauacauguaauauccccuucuuuuggauuuggauauguugugucauugccucauuuuaauucauuauuucuucucaaucuuuaauaauugcuggacuuuuacuccacaagaaacuugcuauaggcccaucucuuucgucuucuuuccuucuuucaguucgucuucccauccucugguagggggaggggagggaugccugagcgagagacuagcuguaggaaccauuugucucaaaguccagaaagccacaggugauggauuuguccucugaaucaaagggcguucgaugauggauuucugucaugucucaucuaaagucuucacgagaacagaugaggaagcaguuuuaugaccccagagccuccuaccaaacuccucugagaaaagguuuccuuuuuuuuuuuuuuuuuuaaauuagagacagagucuugaucuguuucacaggccggagugcaguggcacaaucauagcucacugcagccucgagcuccuaggcuucagugauccucccaccucagucacccacguagcugggacuacagcugcacaccaccaugcccagcuaacuuuuaaaacauuuuuguagagguggggucucacuuugcugccuauacuggucuccagcuccuagcuucaagugauccuccugccuuggaaguucugggauuauaggcaugagccacugcacccagccuggaugugauauuuuuauguuuuaaauuguuagaguuuagaaacuugagauugaguuugcugccugcauuaaaaugaugcuuaaacauuaaacugcaguggccuuaaauauuaacaaguugauuagaauuacuaaguucuuuucaagcuuuacauauacagacaaauuucuuaugcaaaauagaagguaaccccuguacguaagucuagaauuucagcaguccccaaaacugacugagcauuagaaucacucugauuuuaaaauacauaugugguuuuccgagaucuacuaacagagccuccauaauguagccuagagaaacgaguuuucagauguagugauaaauuuggaagguaagucagagaaguaagcugaagacagaguuuuaggaaauaugccuaaagucacauaaugaauugguuuucuuguuuauuugagaauauugucgcuuuuuguucuuuuucaugcaaaucacauuuuauuucuuaugugaguagcuauauauuuaaaaauuuuguuuuuggaauauuguagaaucucuacuuaagaaaguaucuuagcagucauauggucugaccucacugaaugcuaaauucucuuuaaaacauccgucucagaugguuacucauacugccucugauugaacaagagucccagguuaagggacuuacuucuuugaaaucguucauuucauuuuucuacagcuauguuagaaaguucguccuuagcagugaagccagagucuaucucuuauaacuucuacccaguugcacccuccaagccuaccuauaccaaguaucuuuuuuccacguugcuuuuccaauucagcucuucgcaaguuuggagacaaauaccuaaucuccucuaagccuucuccagguuaagccuuuccaguucauccagcuguugauuaugugauuggagacacaaguuugaguaacucccaugauggaaagucccucuggugaauguucuguucaucagagucccuaagaaagcacaugagccucaccauggugaguggggccaugagauuccuaaaccagacacuacacuguggcuugugcaaccuaccauggccagacucaugaggcuguuucaucauauaaauaauuccuuagucucuucaccaaaaacugugaagcacugugucccccagcuguaugugagcuagccugggaccauaguggaggacuccucuuucaacccuguuaaauuucaucuuguuaggaucugcccauuuuuccauucuguugaaauuaucuuggaacuggauucauucaucucacaucagcuacuccccgaagccucacaguaucagcagaguuauuaucucuauccauauccuuguaaauuauuaaacuaaaaaagauuggucuaagaacaucaguccauuaaucaaggcucuuugguuggaguucacuucauuauauuaucauccagcucagaguguucauaaacaagaugauaggaaagacuuuuccaaaugccugucugaguaauucccccauuccugugaucugugagcuguugaccagauuaaaaaggaagugagaauaaccaggcaagauuuacuccuagcaaaaccuuacuggcuucuagugacugaguccuuucccuauugcuuaccagcuaucuuuuuaauuacuaguuuuaaaaucuugccagcaaugucaauaucaaaugaccaagaauaucaaacucauuacucuguauguaaaugagauaguguacuuaccccuauggcuuaaguauuaggcuguucuugcauugcccuaaauaccugagacuggguaauuuauaaaaaaagagguuuggccaggcacuguggaucaggccuguaaucucagcacuuugucaggcugaagcagguguaauggugagccaagaguucaaacuuagccuggacaacaaggugaaacccccucucugcaaaaaauacaaaaauuaucugggcaugguggcaugcaccuguagucccagccacccaggaggcugaggugggaaaauuguuugaagcugggagucagugauugcagugagccaugauugcaacacugcacuccauccagccugggcgacagagcaagacccugucucaaaaaauaaauaaaugaauaaauaaauaaaauaaauaaauaaauagaaaagaaaaagaaagaaaagagauuuauuugccucaugguucugcaggcuguaagggaagcauagcuccagcaucugcuucuggggaggccucaggaagcuguuacucauggcagaaggugaagcaggagcuugcacaucauguggcaaaagcaggagcaagagagagagaauggggcagggaagaagccccacacuuuuaaaugaccagaucgcaugagaaaucacucguuaccucaaggacaguaccaagaggaugguacuaaauuccugagaaauccacccccaugaucugaucaccucguaccaggccccgccuucagcauuggggauuauguuucaacaugagauuuggauggggacaacauccaaacuauaucaccuugcauaguagguaggguuuuaaaaagcaguuuggcacaguaagaaaaguacagauuuuuuuugcaucagacagaccugaguuaaaaucccagcuucacugcuaacaugcuagguaaaugugggcaaguuaauuaacauuucuaagccuuuguuuccucacugguaaaacaaguauuuggaaauaucauugugaagauuagaaauaauacaugaaaagauccuaggaugcugucugucauacaguaguaguaguaagaaguuauucuugccaaagauuguugagaauggcagaauuaucucaguucuaagagcuauaguuucuaauuauuugagccuagacucagauucauuuggagcagcuaacugcucaccaagagcuuauuuuccaucuuaccaaugagguuaugugcccuguguuuuuaaaaucagucuacuuaaccaagagaacagaaaugacaugagaauuaaguaaucucacuuucucuguuauuuaggauuuauuccuacucaaaaccugagaguugcuaugaauucaccauuaaagcacuuauuaauauacauggguuacuguuauaaauagcaauaguauugcuauugugugaguuagguguugaaguucaagaaaggaauaaagaauauuuagaagaucuuugaaaacagugucuggguacgguggcucaugccuguaaucucagcacuuugggaggccgaggcaggcagaucacuugaggucacgaguucaagaccagccugggcaacuuggcgagaccucgucucuacaagauauacaaaaauuagccggguauguuggcaugcaccuguaaucccagcuacuuaggaggcugaagcacaagaaucacuugaaccugggaagcagagguugcagugagccaagauuguaccacugcacuccagccugggcaauagagcaacacucugucucgaaaaaaaaaaaaaaaaaaaaaaaaagaaagaaagaaggaaggaaggaaagaaaaaaaaaggaaaaaaugcaaggaagguauuuggugaaucuauaauaauaaaaauguauuugucauuuccuuuuucugugcucucauucuauaaaauugaguaaaaaaucuauauauaguuuaaacacauuaauagaaaucacaaaaguuagcugagucaacauuguagaaacauaauauuucuguaugucaaagaaauagacaacauuaaaaagcagaaagcaauuacaaagaaugauuauaagaaacaucacaaaggguuaauauuuuaacacauuugaaacucaaaaaucacugagaaaagcaguagacuuccauaaauauuuuauagaguagaaaaaauaggccaagcacaguggcucaugccuguaauuccagcacuuugggaggccgaggaggguggaucacgaggucaggaguucaagaccagcccggccaagauggugaaaccccaucucuacuaaaaauacaaaaacuagccaggcgugguggcaggugccuguaaucccagcuacuugggaggcugaggcagggaauugcuuaaacccuuaaacccgggagguggagguugcagugagccaaguucgcaccacugcauuccagccugggcgacagaacgagacucugucucagaaaaagaaaagaaaagaauagaaaaagaauccaugggcaggcacaguggcucaugcuuauaaucccaguacucuaggaagccaaggugagaggaucaauugaggccaggaguucaaggccagccugggcaacauagcaagacuuugucucuauuaaaaauuuuaaaauuagccaggcauggugacgcacaccuguagucccaauuacuugggagccugaggcaggagaacugcuugaggcugcagugagcuaugauuagaccacugcacuccagccugagcuacacagugagaccuugugucaaaaaaguaaaaaaauaaaaauuagccaggcaugguggcacaugccuguagucccagcuacucaggaggcugaggcaagaggaugacuugagucuggaagauggagacugcagugagcuguggucaugccacugcacuccagccugggugacagagcaagacccugucucaaaaaaaaaaaaaagaaaagaaaagaaaaauaaauaaaauuuauucaaauacaaaagugaugugguuugacucuguguugccacccagaucucaucuccaauuguaauccccguguauugacggagguuccugguaggagaugauuggaucauggggaugguuuccccucugcuguucucaugauagugagugaguucucaugaaaucugguuguuugguaggugucugucacuuaccccuucuuuuucucucuccugcugccuugugaagaagguacuuccuucuccuuugccuuccaccaugauuauaaguuuccugaggccuucccagccauuuggaacuguaagucaauuaaaccucuuuccuuuauaaauuaccgagucucaggcaguuuuuuauagaagugugaaaauggucuaauacagagacuugguaccaggagugggguacugcuauaaaaaauaaccugaagauauggaagcgacucuggaacuggguaacaggcagcaauuggaacaguuuggagggcucagaagaagacaggaagaugugggaaaguuuggaauuuccuagagacuuguugaauggcuuugaccaauacacugauagugauauggacaaugaaguccaggcugagauggucucagguggagaugaggaacuuauugggaacuggaguaaacgucacucuuacauguuuuagcgaagagacuggcagcauuuuuccccugcccuagagaucuguggaacuuugaacuugagagacaugauuuagaguaucuggcagaagauauuucuaagcaccaaagcauucgagaggugaccuggcuuuuccugaaagcauacaguuauaugugcucacaaagagaugguuugaaauuggaacuuauguuuaaaggggaagcagagugcaacaaaaguuuagggaguuugcagccugaccaugugguagaaaagaaaaacccauuuucuggggagaaauucaagcuggcuggagaaauuugcauaaguaacgaggagcugaaugugaguugccaagacaaugggguaaaugucuccagggcguuucagaaaaucuucagggcagacccucacaacacaagccuggaggccuagaagggaaaaauggugugagccaggcccaggcccaggccccagcuguucugugcagccuugggacauggcacccuguguuccagccacuccagcuccagcugugguuaaaaggagccaagguacagcuggaccauugcuucagaggguacaaaucccaagcauuagcagcuuccaugugguguugggucuuugggugcacagaagacaaaaguugagcuuuggaagccgcugccuagauuucagaggauguauggaaacaccucgauguccaggcagaagucugcugcaggggcagagccuuauggagaaccucugcuagggcaaugcaggggggaaaugugggguuggagcucccacacagaguccccacuggggcacugccucauggagcugugagaaaaggaccaccauccuccagacuccagaaugguagauccaccaacagauugcacucugcgcuuagaaaagcugcaggcacucaaugccagccugugaaagcagcugcaggggcuguacccugcagagccacagagguggagcuguccaaggccaugggagcccaccccuugcauuagcauggagacaggggaucaaaggagauuuuggagaucuaagauuuaaugaaugcccugucgaguuucagacuugaauggggccugugaccccuuuguuuuggccaauuucuccuauuuggaaugggaacauauacccaaugccuguacccccauuguaucuuggaaguaacuaacuugcuuuugauuuuacagacucaggcagaagggacuugccuugucucagaugagacuuuggacuugaacuuuugaguuaauguuggaacgaauuaagacauugggguucuguugggaaggcguauuugguuuugaaaugugagaaggacaugagauuuuggaggggccagggguagaaugauaugguuugacucugugucuccacccaaaucucaucuccaauuguaauccccaugugucaagggagggaccugaugggaggugacugaaucauaggggcaguuucccccaugcuguuugcaugauagugagggaguucucaugagaucugguuuuuugguaagugucugggcuucccccuuuucccucucucuccuacugccuugugaagaagguacuugcuucuccuuugccuucugccaugauuguaaguuuccugaggucuccccagccauucagaacugugagucaauuaaaccucuuccugccuauucucaggcaguucuuuauagcaguaugaaaauggacuacuacagaaaguguguaacuuuaaacucaguaguauccaaagaaguaaugaaaauggagaaacgaacaacaaaaucauaguacaauaugguguauguacuaggacaggaagagcccuuuuaagaagagaucuauguauuuccauuuguuuaucucugaaagaaagcaacuuugccuuguauucugaaaaagaaaggaauauuuuauuuuacuuguaaaaaucuuacaaggaugcuagucuaaauauaguuuuccuaauuugccagagaauccaugaagaucgaguugauaacaagaucagugaaguaaaggucagugaguuaaucucacagcagcugcaggcuaauuccauuuccagugaaaaacgucuugauugcucaccacauaucuuuucaccacaaacaguuucagucuuaagaucacauguugcaauccaugagaaguaacuauuaagccuucaacuaugacuggagggcuccucgcccuuucugauaaauugacuggacaaaaacucaauuuuaaaaugacaagaaauagaagauguauaaauguacuuuaaaugugaccaaaauggguugugaaaacacaagacacaauauccaaaaaugcuggcaacacaguacacuguagaguauugguuguuuauuuacccuugcuauuguguggcugagcuuacugccacugcccagcauugcaagggcaucaaacugccuaucacuagccuaggaaaagaucaaaauucaaaauucuaaguacaguuucuacugaaugcuuaucacuuuugcaccauuuuaaaguaaaaaaaucaguaaguugaaccaucauauauccaagauugucuguauauaaauauuauacaucuuucucucacuuuuaaaacaaaauaauacuagccaauacuaccauucucaaaagcacuugugucaacagccuuuaccccuuaaagauuuuccucacaauuuuaaaauuguuacuuacuauuuucuuugaaauguugaccaaaccuggauuaaaagauuuggggguuuuagugacuguauuucacaaacucucuuauugauucugcagccucacuucugccuccuaaaaagcccucaccaaggucacgggggauggcucuuuucagccucuuccuggcauuugguccaguggcauuuggcauucuaggacuucccucuuugucuuugauaacucccucucuuccuguguuccuccuugcuguguucacuugcuucgcuuucuucuuucugaagcauguuuacacaguguuuucucugauugggccugugacguucuuuaggucaucuuuuccacaaauaaugcuucaacuaguacuugcgugccagugacuccacgucccacucaugagcucugaaccuaguaccagcuucugcuggacaucuacaaugggaucucucacaggccucucucauugguaacaugccccagccugaacucaucucccacccaucuauccagccaugcucucuaguucaccugaacacuugggugucauccuagaugcuuucccuucccagucuucugugaucauucugccucaucagaggcucucuaaucugucuucuuuccuauaucgcucuugucccuauuuuaauccuaaucaucuauuuccugacuuauucauuccuuaaguuggucaguaauuuaauuaaaaacagauuuaggcccugaccuuaaaugugauaagugauaugaaaggagaugacuggggaaaaggauuucccucaaggaaggccucugugaagccugaagcaagaaugaaaacgagucagacgaagagagaauuguaugaaugaaggcucugaggcaggaaaacacucagaucauuccagaaucacuuagaagccaagugaagccaguuccuggagagcagaucaucaaaugaagauggaaaggugaccaggggccagaccuguaguuuuggugggccuuggugagggauuuacaguaggacaccccaugguuuaaguaugaaagugacaagauuccuuuaaguuuuaagaggccucgaaauaugaaccacagauuagauggaagcuacucucccugugucuggacuuuuuagaauuuccaagagcugcuguuucuggaaccagauuaauacaagucagucuuccauuuauuuauuuauguauuuauuugagacagggucucacucugucacccaggcuggggugcaguggcaugaacacagcucacugcagcuugggggcucaagagauccuccugccucagccucccauguaguugggaccacaggcaccuaccacccagcuaauuuuauuuguuguagaaaugaggucucauuuugcugcccaggcuguucuugaacucuugggcucaagcgauccuccugcaacaucuucccaaagugcugggaucacucuuccauuuaacaugcuaucucaacgucaagauaaacuuuaaaaucuuuagauaauaggcuggcauuuuacuuaaacgaucuuuacuucuucagaacugccauucccuauaaauaucugguucuucaaccacaucaaaccacuugugaucucaaaaagccucagcguacacuguccuuucugucauucuaauuccuccucauccuucaaaaucaacucaaggaccagauccagggagaagcuuaguggugcccacccgaaccggcccccuccuucgaguugugcugccauucgggcccaccucuucacacaggguugucagaccagaccagcucaugcguucaccgcccuugcagggaugggaugcagcugugcaccucucagugccgacaccuggagagucucacgaaauguugacaacauggccuguuuccauuucuuguucacuaggacuucucauuuacuaacacacagaauuuccuguaguauguccacuuaaucaguucaagccuaauaauuccuugauuuggguauagugcuuugcauuuauauacugaugguccccaacuuacgaugguucgauuuaugauuuuucaacuucauggugaugugaaagugauacacauucuauagaaaccacacuuucaauuuugaauuuuggucuuuuuccaggcuaccauacucuaaagauagagccacagaucccagucagccaugugauuaugaggguaagcgaccaauacucuacaguguauuguauugccagaugguuuugcccaacuagccuaauguaaguauucuaaacauguuuaagguaggccaggcuaagcuguguugcucauucaguagguuagguauauuaaaugcauuuucaacuuaugauauuuucaauuuacaaugaguuuaucaggauguaacucuacuauaagucaaggaucaucuuguauagcacuuuuaauuuauagagucccuucaaauguuuguuuguauuuuauuuccacugcaucccugugaggauaccauaaguuauacagcuaacaaaacaguuaguuuuccugugcaaagugauggcuucaucuuguggcagauuaccuggaauacuguggccaaggcaucuuaguucuacugucuuuauauaucuaguacaguuauauuuuuauggcagcucugauuucuucuuuggcccaaggguuauuaagagagggaaaaaauuuaauuucuuaacagauauauauaucuaugucaagucauauauuuaauucaaacccuuaauauuccuagguaauuuuugucuacuuucucugucaaagauugaaagauacaggguuuuaaguuuccaacuguaauuguaguuuugguaauuguuuuauuacuaacagguauugcucuguauauuuugauguucuguuauucaauacauaagaauucauuacaguugaaucaucauguauaguauaauuuaccaauguaaaauaaccuuuuuaucaaacugaguauucaccuuauaauguccucugucagaggauuauaauaccacuuaaaaccuuuuaaaaaauauuuuguuccugauaauuuuagcuuugagugguuuucuuauaacaauucuagagaugcguuuuuauuuuuuaaccaagauuuaaagcuuugugauuuaguaagagucuaaaccauucacaguucaugcuuuuuugucaaauuucuauuauuuaguauuuuccucucuuuuauauuuuccuguuauuuuccauuucuauucuuuuguuagacuggaaauuuuuucuuugcuuucuuuuauccuagugauuugaaauuuauguaauauauacuauucuacaauacccuuuauuuguuuucaauauuugaaccuauauuuuucaacauuauuaagaauaaaauaguauuuguugcuauuuugaaaugauagaccauguuuuuaaggcagguuggugguuguuaaggcaccaguaucggccaggcacgauggcucacaccuguaaucucagcacuuucggaggccgaggugggcagaucguuugagcccagcacuuuggccgauacugugguuuacuguauuuuguucuaguuuauuuuauggaaaaugggaauucagugguuaagacaaggauuaaauagcagaagaaagauguguacauauguacagauguauguguccuuuauauguuuuuuaguacucuugucuccuuucugguccucauuuaagguuaucuauuucaugcaguaaauuuuucuucacaauucauuucauuuagagagugaaugcuaccuuccaagugggcuuucuccaguuuuccuuucagggacuuaaaggagaagugauguuaacaguuuuauauuuccauugcauuuuacagugugcagaugucuucacauauauuuccccauuugagcuuuacaaaagcccuuaguauuauucucauugucuagauuccaaaaucaggcuuagaggaguuaaauaguuguccaggaucucaagaugcaagacccacaaucaugaacagaggcagauguucaggauggaggcaagcugaaacucaaaaccaaaucauuaugacuccaaauucaggagucuuuuagcugccaccugcaugggcucuugguguagcugaccaccagaguuuguagagcugucauucaggugugccauggacuuuccugggaccuggcacaggagaaggacugaguuaauguuugcugauuaaauaucuguuacaggcugggcgcgguggcucacgaccguaaucccagcacuuugggaggccgagcagggaggaucacuugagcucacaaguuugagaccagccugggcagcauggcgaaaccccgucucuacaaaaaauuugaaaauuagcuggccauggugaugcaugccuguagucccagguacucaggaagcugaggugggaggaucacaugagcccaugagauugaagcugcagugagcugagauggugccacugcacuccagccuuggccauagagccagaccuuaucucaaaaaaaaaaaaaaaaaguuacaauaaucuucccuucaaagcuggaaggcauuauuuaccugucuguccagcagauggugcuacauaaccaagggaaucuguugcuugcccuuggugaagcuauuaaagccaauacagaucuugagaauuucaaaagcaaaaaucaauacuggauuaugagugcucuaggaaaauaaagagauaaauuuucaauuuacauacuuauauauaguuauaccauauuuguaaauaaaaauauauaaauaauuuaucaaaauuccuuuuuaacagcaacaaccacaguaaacccacagguuaaaaacuccacaacagucuauauuaaucagucaaugcaaaguacauuccaauuccaaguuaacugaaaauaaucaacuuaaucauuugguuggcucugagcagccuucacugcuugcucuugugucauguuucuuucuguccucgauuggcuauagacuuacagacggcuuuugcagaggacaguguacucauguccauccuuugcauccuuugugggaguuggcuaggcagcacucucccuggggacacuaugaacuccucuucuugagugcagagaucacgucuuguucaucuucaugcccaauaccuuguuccauaaauaugaauggauuagaauucuaaacucuuaacucugccccaagacaguucugagagguaguaagucauauaacaccugaagaggacuguucuuguccuaauuacauuagguuauaagaugacaggugagggagccaaaccagggggccuggaaauuauucauacaucucuagauacaguauacaaguuguguguauuauguguauuuacucuguaauugauugcuugagaugaacccccaaacacacucguguuuggaucauuauuaucuacccuucuccuuaaauaaucuuaauuuccuaugaugcuugaaagggaaagaggggccagguguggugguucacaccuguaaucccagcacuuugggaggcugaggugggagcaucaccugaggucuggaguucaagaccaaccugaccaacauggugaaacccugucucuacuaaaaauaaaaaaucagcugggcaugguagcacaugccuguaaucccagcuacuugggaggcugaagugggagaaucgcuugaaccugggagggggagguugcagugagccgagaucacuccauugcacuccagacugggcaacaacagugaaacuccgucucaaaaaaaaaaaaaaaaaaaaggcagaguggggaagagagcugcaugaaggagagauuuacuaaauaguacuuaaucccaaaauaauuucuauagguuugaauaugaucccugaaauuuauuauagguucagguaaguauuaaucacggguauucagaacugugguuuaaaaaauguauagaacauguuuccuuccccuugaaacuuuuuaucagcuaauuauaggaauuauauuauaccugcaaucauuaaaguccagaaugagacaguacuugguaaagugcugaaauuuauaauaaaugcauuauagcaauccaguuaaggaggaagagccaccauuauugaacauuuguuaagugucagccauuguacuagauaaauuuuaguuauuauuuuuauuuaggcaccaaaaaauccaugggauaguugguuauccccaucuuacugaagaggaaacugaagcucagaaaguuuaagcaacuugcacaggucacauagcaaguaaggagcauggccaggaaucagacccugaucuccuuuggucuacuaagcuugcaaaggaucuucccgccuccuuccaagaccauucaauauuaucaguaaauguccauggcaaggauguaguucgaguuauaggguuccauucaagauaugauugguaggugggaagcagauaugucugugucaaucaguauccuggaagaaggagaugaugaacucaaguggugauuaagggaaguuuaaugaagggacuauuuacagagauguggugggguuaagagaaccaacaaggggaagugaugcacucaaaaaguuacuaccuccaggcuuuaggggauugggggagggaguggcacagugugaacccagugugguugugagaaaagggauucccucagcagccauggccaagguuagagucuccacugccaaacugcauccagguggugagggaauggagaauaggggugggguaacaaacucugaccucgguauccccaaagggcaaaggauuccaggugguacaguucguaaagauuagccucagggcacagaacagggcagagaagaauggagaauugaucuggaggaaacaaacaauggcuugcccauguuauugcagggagaguaggcuggugugcacagcaggaggguggggagcccagcauauagcuguguuggggccugugcagaucagccucacuggcagggaggaucugagccgagaggugguggaagaugaaaucgaguaggcauguugguaguccuaaauaucaaguaaacguuccugaucuuacauugauacucaauaguaagccaauuuuguuucccauaagccaauauuaauauuacguauuucuuuuauaagccagagauauagagagauacccuagaagaaugauaggggaaaggaaggcaagggugagagaagaccuugugugaauuuguccaaaauguuuauccacaggaacaaucccuuugugaaggcugcugguaugugaaugugugccgguucccuuggggcguucauuuggaucuuucuguguuccagugaccuacggcaugaugagcuccaauguguacuacuacacccggaugaugucacagcucuuccuagacacccccguguccaaaacggagaaaacuaacuuuaaaacucugucuuccauggaagacuucuggaagguauuugcaaauaacuuugaaaguaccucucuaucacagaaaauuguucauuuggcuucaucauuucaaugcaugaguaucgacaggaccugcuuugcauuuaacacugugugagacguaaguuauggugaguuguuagaaguuacuguuccuacucucaaaggggguaaacuaacauugagaacuuugccugugccuugcacugugcugaguguuucauaucuuaccuuauuuaauuucuauagucuaacucuauaagguaaguacuaagacuaugcccuaguuuguuaaugaggaaaaugagauucaggauguuuaaaugcguauggucacauggcuagggaacaagaaaaauugauuuuuuucuagccugacagcuacuucauccuaguuuguaauucauuccaugagucaagauucaauaaauauuuauugagaaucuccuagaauguaaggccaaugaagggcagugugguucuucugucuugcuucgccuuuuguguuuugucucuuuguugaugauggcauguauccccagcucuuagaacagugcuugauucaaaguaagcacauucuuucaaaggucugcuguugguggggcuugguggcucacgccuguaaucccagcacuuugggaggccaaggcaggaggauugcuuuagcccaggauuuugaaaccagcugggcacaacauaguaugacuuugucucuccaaaaaaguuaaagaauuagcaggguguggugguacacaccugcagucccagcuacucaggaggcugaggugggagaaucacuugagcgauugcuugaggucaaggcugcagugagccauggccaugcuacugcauuccagcuggggcaacagagugagacccuuucucaaaaaaaaucccccccaaaaaaaaacccaaaaacaaacaaaaaaggucugcuguugugaaguucaacccaauccagccccuucccaaguugucacaaauuccaacguaguuaacaguauaccaaugagugauaccacaggaaaaauauuaaacugaucugagggauauggggcuuggaaucuaagaaaauuggaagggaaauugaaaaggaaauuauuauuucuccuuggggagauaguuucuaaaauucuuacuacacccuggggucagagcuguugauuuuaaggauagagacaacugagucacaggaaacuauucauauauaaaaguaccuggcauccaaaaccacacuuguauaauaugaaucuuucaccaucugaguagggcaaaucagucuaucucuguugaucaucugacaaggauagcacacugagaaauagaucugucuucccuacaggcauagcuaguuguacaaacuaacaagagacuuuuguauacacauuccaugaugauaaaugccaaucacuaaagggacgaggagggauuggagaguucaccauacagcaaaauaguccagacaggugaaaggucuaucaaaugccaggcugguaaucaaaacuguagccuuuucucuaaacaaaguuuagaaccaugauugugugggacauuauuuuaauaagggaaagugcaguuaaucaugaccccaccuuuaguccaagaacaaaaaucagagcugccacguauuaaguacccacucugugccaggugcaguaacuaugcaaaagauggguuuuccagaugcaagaaccuugguucagaggacccugcucaaggccucauagcuaacaaaugauggggcaagaugcuaucccaaaucucucugacaacaaaacucauucuuaucacucuacuauuuucauagaguugccaaaugcuugguuaugcaaacgaugcaggcaggggcaagacagcggcugagcuuggaacuuuuucagagauguuuccuuugcuuuuaguucacagaaggcuccuuauuggaugggcuguacuggaagaugcagcccagcaaccagacugaagcugacaaccgaaguuucaucuucuaugagaaccugcuguuagggguuccacgaauacggcaacuccgagucagaaauggauccugcucuaucccccaggacuugagagaugaaauuaaagagugcuaugaugucuacucugucaguagugaagauagggcucccuuugggccccgaaauggaaccgcguaagugucugugacucauugccacucggugauauucauucauuuauucucugaacucccaccauucauucauucauucccugacaccuucaccaaggcaaaaauaaguucagugacucuucagugcuuauauuuaaaccuuggccaacuugaccuuugacuucuuaaguuuucacuacuucuuagccuucuuuuaguuucuacaugcauauuuuucagaagacuaaaucguugaccauauaaccccucaaaaauuaauuaucugagcguuugaaaauuucauuuaagaugcccugggcccuguuuuuacaggugcaguaacaucauccacuaaguuauuuaacacaaguuuucugguucaggaacucuuuuuauaggucuugcaaacagguuuuuguucagaauggaguuauuuaauguguaagcuugugaggcaauuuuuuguuagguuuaaagcccauuuuguucaaauguuugagauuuuagguauauauuuguacacgugcauauuuacaggggcuuuuuguacacuuugguacuccuacuucaaacaucuuguguauuaagggaggucacuuacuauuuuagaaguauuguaguuauuauaaagaaacaagaagaccuccaaggccguuucagggugggccuuugcgguugcugucccuggguacgucacuggucggagucaucuucuaagcuuugcucagcuaauucugucgguucaucuagguucuuuucuuggaaacugaguugcccagaauccacauuuguuacuauacaaugggcaaucaccuuuucaauuaguauauucuucuuguaccuuccaguauacacucuauuuaauaccagaacccauaagaaacaaauuuaguaaaaauccagguugggcacaguuucucaugccuguaaucccagcacuuuggaaagccaaggcggacagaucacuugaggucaggaguucaagaccagccuagccaacauggugaaacccugacucuacuaaaaauacaaaaauuagcuggguguggugacaugugccuauagucacagcuauucgggaggcugaggcaggagaauugcuugagcccgagugguggggguugcagugagcugaggucucaucauugcacuccagccugggcaacagagcaagacucccccucaaaaaaaaaaaaaaacaaauuuagugaaaauccagagcuuuagaacaaaggaacuaaauagucucaaaggacauuaucauccaaguuaugauagugauuucgcuuucuuuaaaaaaaaaauuauuacagauagaguuucuugauguugcccaggcuggccucaaacuccugggcucaagcaguccuccagccucagccucccaaguagcugggacuaugagaauaugccaccaugcccagcuuuauuuugcuuucuaaugugccuuuuuguaguuccugcaaagcauaagcaugccuucaucugugguacccuuuccaauauuuuauuuaucucacaucacuaauaagauaaauuuauacagccacugcucugugccagacauuauuuaagaaguuauuucacgcauuaucucaucugccuucacaaaacaacucuaaaauagguaucaccuccauuuuauagaugaaaaaacugaggcucacuugcccaaagugucacagcuaacaaauuggacugaaccaagauuuaagcagccugacuccaaaacccauguuucgccuacuaaaccucuuccauauuaauuccuccuccauauuaauugcgucguuaggguggcuugucgacgcucucagcuccccaucaguacucaagcuuccugagggcagggauucuauuuuguuaacugcuguauucucaaagccuugaacaaugccucauauguaaagauacuaauaaauaugugcuggaugcauucgagugauuucuacuccaggguggauugccaaaggggaccuucccugucauaucuaaacuauccuuuuauucuucuacauucucaagucacucccauuucuucuucccuucaacuccaaacuucuuggaagaauagucuucauuugccacuuccauuuccuuaccaucaauucacgucuuaaagcuuagguucuugcuuuugacaucucaccaggaagcuacuagggaccucuaguuagcaaauccacugaacaaaucucaguuuuuauccccuucauacugucugcagaaaguggcaguguugaccgcucauucuuuugacuuccaugaagaacucuacacuuuggguucuuuuaacucugaaaccccuuucucucacuucucuuauucccagguucuauauucauaucuccgucuuuucuuucuuuucucucuuucccaugacauucagauggcuuccacugacaucuuuauuuggugacucaucauuucuucaacaaugugccaggcauguucccauugcuagaaguccccccucuucuaguagugcccuugaugcuggagaaacaaagcagcaggaaacagaagaaacguccuuucuucacagagcuugcauucuagugauacaagacacaucucuauuccaccuggaugucccacaccucuugugauuuaauaugccccaaacuaaacucaucguuuucuuaugagaucugcucuuuguucuguuaauggcacugccgucuuccuauugcccugaaagagacuccagagucauuuuugagccauguuuccuccuugccccaacuuccaaaucaguuaccaaguucugcuggcagucacugugguuacgacacucucucacuccuuccuuucccuucccaucuucacugagugacuucaggccucauuaccucuugguuauugcagacuuugcuaagggagcugugucaggggucccuaagaccacccccagguucagugauucacuagaaggacucagcauagaggcauccuuacagcuaagguuuauuauggugaaaggauacaaaagaaaaggcacauggcaauaucuggggaaaaccugguguaggcuuccaggagcccucucccagugaggucacauaggaugugcugaauuucuccaggaacgaguuguagcaacaugugugaaaugucuaucagagagauuaauuagagacucagugccugggguguucacuggguacugguacugguuuaugacuagcaugugccaaaauucccgacucucagaaggaaagcagguguugaguguaagccacauugcuuauacaaauagcacaggcacagcaagccucucuuaccggucagggaaaguugaauacuggugcagggagcuguuuaucagucaaguucccagaugccagccaaaguccaaccuugcaaacaggccuuccuaaagaaaggccaucucaggccugcuguguuaacucuuuucugcacaugagcccucuguuccuccccacuccagucuucccugcugccaccagaccagcccuguugugugccucuuagaacuuucccuucacagacuccuucauguuugcccuucacaagcugaccacagaccaccuuucaaucugccauucuuuaucuuaugggagccaaacugaacuacuucuucucuugaccaauggcucacgguugaaaaugcccuucccauuuguauuagucuggucucaugcugcugauaaagacauaccugagacugggcaauuuaccaaagaaagagguuuaauggacuuacaguuccacauggcuggggaggccucacaaucaugguggaaggcgaggagcaagucacgucuuacguggauggcagcaggcaaagagagagagcuugugcagggaaaaucccacuuauaaaaccaucagaucucgugagacuuacucacuaucaugagaccagcaugggaaagaccugcccccaugauucaauuaccuccuaccggguuucuccaacaaaacaugggaauugugggaguuacaauucaagaugaguuugguuggggacacagccaacccauaugaccauucaccugugcaaguccagauccuacucaccuuucaugguucagguccaacacagcuucuuccuaaagccuuuucuaauccaucccuccacugccagauccccaaauaaggacagcuuuccucugaucugccagccuuauuucuuuucucuuuugcuucuuauuauuauccaccuuguauuuuacuuguuuaauuauaacucuuauuucccuacuuguuauaaauuugggagggaaaggaccuuuauauccccauuagugcugaagaagcaucuguuuucuaagagauccucugaauauuuguggaugaaauucccaaaugcugacaaugccacuugaugaacuugucccucuuuuggcuguaauuuucucuggggaccucaagucgucuagucccugagcacaguuacccagagaaggcagccguauaaacugagcagaggcucuagagcagagcagaggcucuagggacaaacagcccuggcauugguucccgagucugcccucaaaagcuuugggacuacauugaccucacuaagccucagggcccucauuccuaaagaggcuaauaacaguaugagaauuaaccaagaaaacaugaacugccaggucaggcacaguacccagcuugauaggccuuaauacauacuuuauuuuacaaggaaccagcuguccuuguaauugccucaaguguuccacugauuguaacuguuuguuuuuugguuuuguuuuuaaucaguuggaucuacacaagugaaaaagacuugaaugguaguagccacuggggaaucauugcaacuuauaguggagcuggcuauuaucuggauuugucaagaacaagagaggaaacagcugcacaaguugcuagccucaagaaaaaugucuggcuggaccgaggaaccagggcaacuuuuauugacuucucaguguacaacgccaacauuaaccuguucuguguggucagguguguacugaggacaugcaucccuccuauuucugugugguuguacauacauccuauucugggguuagccagaaaaaccuuugccugcaguuagcuacaugaggaugccaaggacccagacggauagcaagggagggguaaaaacugaaggcuuaccgaaauaaaggauauuugaggaagggaguugggauccuagaauauuacgaguuggaaagaaccauaacucugguccaaguucaucucaaugcuggaaccuuuccagaaaaaguauuguguuuuucuaacaucugucuuuacccauuauaaggaugguuagugccacauguuccaucaccaagucccccggccaucaaaucuugacucauuuccuggaguuucucacucucagaugagccucugcuauuagcacacaagcacaguaaccggagugcuuguaggaugcucaguaggauacccagguuaccugcucgugcucagggcuaccaaaggcacguaaaguuccuuccacagauccugggauguugccaugaugaccccucugugagauaguaacaaaaaugacaaagauuccacuggcuugucugggacucuucuucauucauuuauucagcaaacauucauuggacacuuaauaugggcuaggcauuguucucggcucuugggacaugucagcaaacaaaauaaagauccgcaccuuggcagagcuugcauccaaccaggaggagacuagagaauaaacauuaaacaauacaaauaaauaguauaguauauuagaagguaauagguacuauuaaaaagaaagaaaaagcagagcaagaggaagucagaguucacccacuuuaaucuuccuggugagcaugucagcaacacccaaacaucacuaacauggauuauugcauguauauuuacacauaagauaagaaguguuuauucucauaauagucuuugucaucauucuugagguuaaguucaauucugcuuuauguggcuuguuggauugucccaguccuuguauuuaacaacauuugcagaaaauaguaccacauuaaaucaauuauagauuaucccuuauccaaaaugcuuaagaccagaauguuugagauuuaagaaauuuuucagguuuuggaaugucugcauauauauaaugagauaucuuggggaugggacccaagucuaaacacaaaauucauuuauguuucauaaaugaaacuuaaugcacauagccugaaggaaauuuuauuuuucccuuagggauguugaaucaacuguugugugccagcauguugacaaugaccugucacaugaagucggguguggaauuuuccacuugugcguucauggcggugcucagaaaguuugggauuuugaagcauuuuauauuucagauuuucacauuagaaauacucaagcuguccuugcucacaguggccaaaaaaaaagaaagaaagaaaagaaauacucaaccaguaguccaguaguaguuaucacuagaaaugaaugaaaaucuauugcaguauuauugaguuuuuccuaauuauuccagugcagauaaaaagaaaagaauaaaaaggaagagaauaaaaacagagaggcaacucugauauuuuaguaaauucuauuuauagaaggucuugaguauuucuucugcuuccucccuuacuuuaaggaugaacauuguuaagacaacugcuucauuucucuauacuguuuuucuaaguuucuggaagugguugacuacugcagggccagaaugggccagagaaaugacuugacacuugaaggccacuuccuucccuuuugaguucccaaugaagcugucacauacaaggcucuuggcuucagaguugcucuccugaguuuuugauucucaccccuacucucuaacacaucaaauaggaaagaaagaacaggagaacugacaaugaaaaggaaggaaaauuuucacacuucucugaccaguucuaauuuaccauaguccuguuuuuacuugauuauugcucaugcauguguccuguaugcucagguuccaggugcggcuaccuguccuguaauggcagagauagugauggcuaguagcugacuaaagggcuuuuaaaugucucaaaaugaagcagcuagagauucuauuucuaguuagaaaagaagucuguaucauuaacugaaucacccagcuuucucagugugacaccuacaaaaugggcauuugacaagaaaaaaacccucaguccaguuaugguaaagcaguaaagaucagagccaucaguauggauguaaaauaguguauguuuuagacaaucagacaucuauugaguacccaccuauuaacuauaaggcucugggaagaagagagaaaacuacccuggaggacaaacuauuugaugcuauuuagguguuacauaaugaaugaaugacucaguuccuaucuuuauauauguacaaaauauauccuacuucucaaccagauuacacauguuuugaguggaugguuuauauuucuuuauauucuucauguugccuaguagaaggacuugaauuuaauagaaguccuagggccaggcaugguggcuccuuccuguaauuccagcacucugaaaggcccaggcaggaggaucauuugagcccaggaguuugagaccaaccugggcaaaagggcaagacucagucucugccaaaaaaaaaaaaauuaguugggcauggugcugcacacuuacauucccagcuacucaggaggcuaaggcaggagaaucccuugagcccuggaauuugaggcagcagugagcuaugauugcaacacugcacuccagccugggcaacaaagcgagucccugucucuuaaaaaaauaauaacagaaguccuagaaaaguuuguguguugauuuacuuuuacauuaaaaguauauggcauguugagcagcguaaauauagaaaaguguagggaagacugagcaggaaguacuccuuugggacugaaagaccucaggaagucuuauuccuuugauggcacaaaauucuccaaguauggaauuauuagcuaugauaaaaauguuuugccgcuaguuuggggggacucaugguagcaguuucauuaccuuguaaugcaugaacagaacagauggacauccauuccuggcuguauucauguguuguuguuguuauuguuuuaauuguucuuauuuacaugcagguuauugguugaauucccagcaacagguggugugauuccaucuuggcaauuucagccuuuaaagcugauccgauaugucacaacuuuugauuucuuccuggcagccugugagauuaucuuuuguuucuuuaucuuuuacuaugugguggaagagauauuggaaauucgcauucacaaacuacacuauuucaggaguuucuggaauugucuggauguugugaucguugugguagguuugagaacaacaccaaauuuccuauucuauucuacaagcauguuaacuagagucuuugaucuccucagcauuguggaucuugauauucccaaaaaagaaucuaaaagucccccucaauuauaucaacuucuguuacuaauuauuuucucauuuugcaugaguaacuuugcugaguaugaaguggagagguauuuacaguaugcucucagccacgcuaauaacaagaguaucucaguaauucauauuuggcuuuaguaugccguaugagauguggaggagaaaacaguuuuuuuucuuuguuuuuuuuuccacuaaugauauuuuucuucaacugcugguaaaaaucaauuuauauuuuccugcacaugugugaaguuacagcaauaaaaaaacuugucggccaggugugguagcucaugccuguaaucccagcacuuggggaggccaaggcaggaggaucacuuaagccccagaguucaagcccagccaggguaacauagugagacccugucuuuacaaaaaaaaaaaaauuuaauuagucaggcaugguggcacacaccuguagucucagcuauuccagaggccgaagugggaggaucauuugagcccaggaggcugaggcugcagugagcuauaaaugcaccacugcacugcagccugggugacagagugagaccuugccucaaaaagaaaagaaaaaagaaaaaucauccugaaaauauuuugugcggcagagaaaacuuucugcaguuuaaaauuuucugcaaauagucugcagaguacaaauguaaguuauauucaucaaaguuuucuguaugagguauaagaaaucaaaggcaggccaugcacaguggcucauaccuauaaucccugcacuuuagggaacugaggugggaggaucacuugagaucaggaguuugauaccagccugggcaacauagugagaccccaucucuaaaaaauaaaaauaaaaaauaaaucaaaggcagagucauaaucaagaccaugacaccauguaaauucugugucugcucuugacucuauuauaacuucuaagauuuuuuucaagauguuuucccuucauccuuaucacuuaauuaagcauccgucacuuccuuccugugguuucaguguauaaaagaauuuuuacaagcuuuucucccuucagcaauaacagguaacauuucgcuaaguccaguuguacauuuaagcauauaacaacaugcuuaauuauuagaugcuuacaagcuuugcuuggcauagguguaccauguauuauucuaugucuuuccuucccacuguccuaugauagccauuaccuucugaaaucucaguaaaugaugcacuacccuauuagcauucucucuucuguuagcccuccuuaugagaguuauucuuucccucaucccacuccuaaaaauucauuuggccuuuguggaguauuuagaucaagucauuauuaaacuauuccccacuagaauuauuaauaguugauaaaauauggaaaauauauuauucauaugugagugaaagaacacuuaaagcauaaaaaagaacuacauggccauauauugcauggcaauaacuauauuagcagcaauaauaauuguaauaguaauaauaauaauggcuaacacuuuagaagcuucuguguuaggcauuuccgggugcuuuucaugguacagaagcucauuuguuccucauacuaacccucuucacuacucugccacugccucucaagccauggauaugugcacuuuagaguuuuuacuuaaaguaaaaauuccuguagaauagaugguguugaccccaucagaccgugaugcaguuagaagugcaucccgucuuuuacgauggccauacaacaucacacaaaucaagguaaacccuugauccccaaauucucaauguauuaauaaugaacagaguuacacaagaauuuuagcauuuaaggaaacaggagagacgauaauacuggaaauaauuuuucagaauauuucuguucggauugauggcagagugcaggccauauacauugacaauuauuccagaacacaauuauuguuuggagcuaaaaggaugcaaacccugccucuuggcuuauauggauuuauuuauguuuaggccauugaaauaaugguagaaagguaaguaugauaugcuaauuaagaacagacuuccuuuuuauauuuuaaccaaagaacucaauaucaacaaaagacuagucagugguauucacccuuuuugaucauacacaccuaucagugaaagcuuugacuacuacacacccuaauuuauuaucuuuauuuguaaauugugugccuacuuugguguaacagguacauccguaaaacauacacauacauagaauuuuaaagauuggaauaaaaguuaauacaaauagaauuccaaaacuuucuuaccaccuaccuagaaguuguaacauuuucuucccauagcccagugaauugccuugcaccugcuuuggcgaccaauaggaagaaaggcaaugauaucauggaaauugucucuuuggcucaacagccacagcauuuugcaaguguuucuuugaaaacuugcuucacuguguuuuucaauuuuuuuuuuaaacaacacuuaauacugccagacaacaauucagacagugugcuuuuuguuuauaaagaacaaggaagggcuacuggaaucucacuuguccuuugaaacuuuugcugaccaaguguagaagugagggcaugccuucugcucacccacaaaacacacccugugcuccacuggaccuucaaaccaguggaaagacccaacgcuuuuuguuuuaucuagccaaaauuugcuuaugcuuacccaaaaccugaaaagaaauuauauucuuaauauaaauacaaucacaucuugaaaucacuuugaaauuuucuuuauuuuccuuuuuucuuuccccaacauauguucugaaguacacaggcugcaucagucagccauuuguccugagcaauagucuuucaaaacuagaagaauuacuugaaaaaaagaagacuauuaaggaauuuaaacucaaauaauuuauugaccacuugcuagguuguacaggguaaauuuuuuuuuuuuuuuuuuuuuuugagauggagucuugcucugucacccagacuggaguacaguggcaccaucucggcucacugcaagcucugccucccggguucacgccauucucccuccucagccuccugaguagcugggacuacaggugccugccaccaugcccagcuaauuuuuuguauuuuuaguagagacaggguuucaccgaguuagccaggauggucucgaucuccugaccucgugauccgcccaccucagccucccaaagugcugggauuacaggcgugaaccaccgcgccuggcccgacuaauucauuuauucagcgaguguuuucugagcaccuacuauguacuugccacuguucuaggcacuggggauacaggaaugaacaaaaucacccaaaucucugcccucccaauuuucugguauggagagaaaguucuuuuguagauagggaugagaaucccacagaaaacucaggagugauguaacaaugcaaaugcucacaaaaucucuuuccucaucuuucauucccuauuuggaaggaaagguuucaaagacauugauguuguauaaaugaccaucuucuucauuauuuuauaaacauuuguccugugcagaguaaaaacaacuggacugcauaacaaauuauaccuauugagaguuggguaaagaguuaccauuggauccaguccaccaacccaaauguuuuucuacauguauuagcugagaugagcuccucaucucaggagaagccuauucccacugcaggccuucuugagucugcuguguucaucauucccaccaccaacacaaaaauacaagauuggcucuggaaauccuucacagagaaggaaggaaaggaagauggugagguuggcuuuuuagcugugaucagcaaccaagcuggucuuugcuaugagaaucagugggaccaugaucucuauggucaucucaggaagggagggcuaaugaaguggucucuggccaugauuccuaagaagagagaauggacagcaaagaucgcagcaccugccacagcccaccugcugcagauucagacccccugguggggccagguuguuaugacuaaccccuagcacugucuacauuuaguggugauggaugccaaggagggggcaguguccccuuggaucugauuguaaagcuuagaaccaaagcauauguggaaaguuguagggucaugaguuaagggacagaaaugagcaagagagaagcccuuggcucauauauucccacugcaggccuucuugagcccucuguauucaucauucccacugucuuucaagcccaagcucaugcuuuguucucaugggcacucauuuuuaggauaucuuuugucccucuugacuuuauguugugugauaccaacucuuuaguaguuuuuuguauuauuuaacuucauguguuuaucugcucuugagucucgagggcaggauuuaugcaguuuacuucuguuuauuccucuuagcccuugcacagugcuguauacauagacaucuacuauauuuuuguuaaacagagcaaagaauggcuggcaauuggagaaugcagagaaaccgaaaaauuuuaaauuuaaaaaucacaaauaaaaacagcaggaugaaggcaagaaagcaaaaggguggaaagugauuaaaaugaagguggcagaaaaaacagaaagcauuccucuuugaguuugagucuguuauagugugaucucuucuguguaugcauguauguguguguaauguauaugugcacacacaugcaugcaugccuucguugaguuucuauuccgaacuaaggaaaugcaagcaauauacuguuuuacuuauuuuauggcagggcuuaacacuuuccauuugagugagugacuuuuaagaaugacaucggguaaguauaauggugagcccuuauaauuaauacauuggugaagaaaaauauacuagucauauuaagguaaguuucauauuucuaaaacacuguaauaaaauauaaauauuuugcuuuucagcugucagugguagcuauaggaauuaacauauacagaacaucaaauguggaggugcuacuacaguuucuggaagaucaaaauacuuuccccaacuuugagcaucuggcauauuggcagauacaguucaacaauauagcugcugucacaguauuuuuugucuggauuaagguaauuuauaaauuucauguucuacauuuuaaauaauauuuucuuuaaaaaaaaugaguuccacaaaaucauggaauacuugaauuugaaauucaagugaccagccaaagcugcucaauauuuacuuugagacagggucucacucugucacccaggcuggagugcagugguaugauuacagcucauugcagccucgacuucccaggcccaagcgauccucccaccuuauccuccgaagucacugggacuacaggcaugugccaccauacccggcuaauuuuuaaauuuuuucguagagacaaggucucauuauguugcccaggcugguuuugaacuccuggguucaagcaauccucccaccucagccucccaaagugcugggauuacaggcaugagccaccgugccaggccucauauuuuacauauaaaguaaacuauugagacucaugugaucauuccucucacugucaaugacauacuucugcuaucugaauuagugcaagaucagucccuauagguuuuguuuaacaaaugcaguaagaggccuuucaguguguuagcugggccuggggccccaggcugcuaacagaugagaugaacaggugaaggaaaaggaacuuagagaaagagagggaaggagcagguggagggaaggggagaguugcugcacuuggaaaugcuugcuagaagggaucgccucuuuuccagguagaggcuguaagggaagcuuuaccuagaauuaagguuggaacagacacugcuuccaaauaguuccuugcucacuauuuuccuuauugucccaagauauaaugugcauuuccaugugugugaaagguuaugacauuucauauacaacaagccucaauucuggagaugcaggaaauuucaauaauucucaggcagcagcugccauucggucaccagcacaggcucugauugugcuguccagacaguaaguacuagccacaugugccuauuuaaauucaaauuuaaauuaguuaagcuuaaauacaauuaaaaacgcaguuccuugguccuacuggccacacauuaaguguucaauggcuacugucuaggacaguggaaauguagaacauuuccaucaucacagaacguucucuugaaaagcacuguucuggaagguacuuacccguuauguacuuuucugaguugguauucauaccuagaagaccugagguuuaucacaagacauagacuuggaccaggcgcaguggcucaugccuguaauuccagcauuuugggaggccgagauagguccccugagcccaggagucugauaccagccugggcaacauggcaaaaccucaucucuacuaaaaauacaaaaauuagcugggggugguggcacgugccuguaguccuagcuacuuaggaggcuuaggcgggaggauugcuugaauccagaaggcggagggugcagugagccaagaucgcaccgcugcacuccagccugggcaacagagugagacccugucucaaaaaaaaaaaaaaaaugcauagacuuuauccuguauuucucaugcuauuuauuuauugacaugcuuguucaagagaaaccaucacuaaagcacaaaaccuugaucauaacauaguaauaauaaucaaacagcaaaaauaauaauaguaauaagaauguucuguggugauggaaauguucuauauuuucauuguccuagacaguagccacuaaccauguauaggcauggaacacuuaacauguggcuaguaggaccaagggacugaauuuuuaauuguauuuaaucuuacuuaauuuaaauuugaauuuagauauccacacauguuuggauagcacagucagagccugugcuggugaaaggauggcaggugcugccugagaauuacugaaguuuccuugauuauuauuaguuuaauaauaauaaucaagauaguaauaauaaucaagauaguaauaauaaucaagaucucagcugggcacaguggcucacgcacuuugggaggcugaggcgggcagaucaccugacgucggguuugagaccagccuggccaacauggugaaacccugucccuacuaaaaauacaaaaaaaaaaaauuagcugggugugguggcacgugccuaugaucccagcuacuugggaaucugaggcaggagaauugcuugaacccaggaagcagagguugcggugagcugaaucaugccacugcacuccagccugggcaacagagcagcacuucgucucaaaaaaaaaaaaaaaagaucucaaaugaauugggauuguauuaaguaaugauuaaguaaugugauuacagcaauccucaagaaauauuucacuguggccaguaacaauguguaacagaccuuuaaacuucuagagauuuuccuacaacaugugucucaggcugauguguuuuauuuagugcuucucuuggaaaugucuugccccucgauacuuuaucauuaaggucuuuaaggcagggaucaugacucuacuuuuuuuuuuuuuuuuuuuuuugggacggagucuugcucugucgcccaggcuggagugcaguggcacaaucuuagcucacugcaaccuccgucuccuggguucacgccauucuccugccucagccucccgaguagcugggacuacaggcggcugccaccacgcccggcuaauuuuuuauauuuuuaguagagacgggguuucaccguguuagccaggauggucucgaucuccugaccucgugauccacccaccucggccucccaaagugcugggauuacaggcuugagccaccacgcccggccucaugacucuacuucuaauaucucaucaugugcucuuccacugaggcuucuacuuagagcuacacaaucugggcagccauccucagugccuuaucuaccaacaugcucaauauggcuuugcaggguucacugucuaccagcaggguucacuaucuaccaacaugcucaauauuucuuugcagucaggcagagcaggcuuugcaguucaggcagggcagcuggcugcaggccccagcugacuccuggggauagaaugccaauauuucagacauugcagagauuugaggcaauguacauaaagcccuccacauauaacugaugcacaauaaaugacaguuaauauuaugcaacaagaauuuccugggggguuuuauaauuaauuuuuauuugugugaaguuuuuucccucccuuuuacuuuaauccuuuuuggggggaaagcaucacuagucacaguucacggcagccucgaccucccaggcucaagcaacccucccaccucagccuccugaguagcugaaaccacaggugugugccaccacaccugacuaauuuauuuuuauuuucuaaugaaacagaaucuugccauauugcccaggcugaucuuaaacucaugggcucaagcgauccuccugccucagucuuccaaagugccgggauuauagaugugagccacugcacucagccuuuuuuuuuuuuuuuuuaauuguagauagcauaaaaccuacuguuuuaaccaugcuuaaguguacaauucaguggcauuaaguacauucacaguguugugcagccaucgccauuaugcugcauuauuuucagaacuuuuucauuauucuaaacugaaacuuuguauccauugaacacuaacucccaauucccccagucccugguaaccuccauucuacuuucugucacugugaguuugacuauucuaaguaccuaauuuaaguggaaucauacaguauuuguccuuuugugucaggcuuauuucacuuugcaugauguuuucaagguucauccauguuguaaccugucagaauuuaauuucuuuucaggaugaaauaauguuuuauuauauacagucacaccauuuuguuuauccauucaucuauugaugucuucucucucuuacagcucuucaaauucaucaauuuuaacaggaccaugagccagcucucgacaaccaugucucgaugugccaaagaccuguuuggcuuugcuauuauguucuucauuauuuuccuagcguaugcucaguuggcauaccuugucuuuggcacucaggucgaugacuucaguacuuuccaagaguguauguaaguauauaugaaauuaagaagaaaaauuuaaucagaguugucacugcuucucaagaauaaaucuucauaugagguugcuauaugaccaccaauuauuuaaaaccaguuauuuuaaguaagaauuaauuaccuuuucccaaaacauugaucuacccaugcaaagaagacaaugcauccugaaaugcugaugcuuaagauagcagcccaaaguaguaaaauacaguuaacagacauaggaaaccaacacuguucugaagacugaguuuuucuuugcaccaaaugcagaugguagcuucuagaaggcuguuugccuauauucuuacuccuguugaauauuguugccauauauuuagaacuucaaguuauuuucuaaggaaaaaaacaagauauuucuaauauucuaagguaaacucagaccaguacaagaauuuucaguuuuuuuuuccaaagaucccaaaugugaaauaaaacaacaaaaagcagccagugucagauuucuaugccauuuagaaaggaguuaguuuaaaaaggaauggaaguaauaggguuuugugcauagauaucucgaauuaauauugcuguugauaaaagugauuuugcuaagacccagcacugacaacacuuggccacuuugaucccauuuuaaguacuugucagaauauuggaucuuugaacucaaaccauuuuggguuuuugggguuuuuuuguuuuguuuuuuuuuguuuuguuuuguuuuugaggcacggucuugcucuguugcccaggcuggagugcaguggugcaaucauagcucacugcagccuugaacuccuaggcucaagcaauccugcugccucagccugcugaguagcugggacuacaaguguaugccaccaugccuggccaauuuuuaacuuuuuuuaugagaagggaucucacuguguagcccagggugguauugaacuccagggccucacacuguccucucaccucagcuuccaaaaguacugggauuacaggcaugagccaccacaccaggcccuguuguuuuuuuuuuaaagaaauuuuuaacuuuagaccgagggugacuguugucaagguuuaggguuaagauguuuuaccuagauuauguguugaaauguuauagccaauugcuuuauaaguuauugaauaauaauuguauuuucuuuuuuuuuuuuuuuuugagauggagucucguuccaucgcccaagcuagagugcagcgguguaaucucagcucacugcaaccucugccucccggguucaagcgauucuccugccucagccucccgaauagcugagauuaugggcgcacgccaccaagcccagcuaauuuuuguauuuuuaguagagacgggguuucacuauauuggccaggcuguucucgaacuccugaccucgugauccgcccgccucggccucccaaagugcugggauuacagacgugauccaccgugcccagcuuguguuuucuuuuuaaccaaauggaaauaaccucuguagcaugaaagcauuuuauuauuauugcagaaggcuuuaauugcugauacaaguagcaagacuuuguaaaugggauugacaauuuucuguuauucggcagcuaccuauacugcuaaaagguccaaaaauaaugaaaucaucuuuaagaaauguugcaucaacuaguggacauucuuuguuuuuguauugugguguuuuguuuuauuuuuauagcuucacucaauuccguaucauuuugggcgauaucaacuuugcagagauugaggaagcuaaucgaguuuugggaccaauuuauuucacuacauuuguguucuuuauguucuucauucuuuugguauguacauuuuuauuuauagugagguucaauuuaaacuucguaaauccuugucuucucuuuucucucacacuuuauguccuaucaauuuuaaauaaagacccaggaaguagaaaaaaguguggauguuggaaaacuuauuuuccuuuuauuaauucacaguuuugagacucauaucaaaugucuuuucuguggucuuucauugauccauguauaugugucuauucaaugcaaaaaaaauuagaucucuuccauggucuuucauuucucucucuauauauguaucuauuccaugcaaaaaagaaauuagaucaaguacaaauuuauaaagauaccuaaaauagugcuuugccuaaaaaguagaauaugcuuacaugcuuuuuaaacucauaugucagcacuuucguagucacuugcuagcaugacuuuucucucuuucuucuuuucuuuuuaaaaaauaagaacggaaaagcaagcuagaucuaagaugucgaguaauaguugagugaaucauugcaugucaaaauuaggauauucuguuuuaaauuauuuauaucccauucaucuagagacugccuacagagaauauucaaauaauuaaguuuaaaacuaaauguaacaaugaauggaaauugcauuaaaauuauuuucaaaaauaauuuuuuuauucucuugauuugguacaaaugaacauuuuuaauguuuuugcccuaagucaauuaaguuuuuuuaagguguuuuguucuuuuucuuaacauuuauauauucaauugucuacugagaagguguuaagccagcuuaauuuaggcaauauuuuucaucuaaacacuaacagucaucuuaagaacaauuuucuuaagaaaauaacauuuuuuccauuucaguaaauuguguaaagaucccuugaggaagguuaagugaucacauuuucaguaauucaguguaauaacucuaaagucaguccagguauuacugguuaaguauaugguauuuauugauuggguauuagauguacuguauuaauuuccuguuuaaaaaaaauuuuuuuuccggggagacacagccucugguguaaaacaaagguguguucccuagcuguacuuuaacaggacugaaaaggucaggaauaucauucaaguucauauguaucuugcuguaugcaugguuuauggcucauuuuuaaacuuacaccucuuaagcuucuucuuccuaucauauauuaaaacaauggagagaagaauaagccucuguuacucuaccauugauaguacuucggauucuagaguaccugaaucucuacuaagaaggcaaaaaccaggaauugagaguccugcaccugacccuucaguugaucucaggccaccuaguuuucuccguuuaucaaucugccaaacaaggauggauagagucguggcaacuggaaaggcucaaauguggaauuguuugaaugugguccuuuaguaggcagccaucuuaccagaucuagaguauucagucaucuuaccagaucagucaccagaacaugaaaagaagcucuuaguuucuaucuuuauacuaaaauuguuuuuuuguacgacugcacaaaaaagaauugcucuccuugcaccucccagagauauagguggauagauacauacauacguacauacauacauacauacauacauacauacauacauagacacauacauagauagaagucuacuuucaauacaaaccugucuuuuaaggaaaugacaagcugagcauaggguuggccaccuuucugagccgauugccugguauuaguuuauugccccuguuuagcaagaaggcacaguguuaagaaguggcucagcugaaccaggauaaccccacucuucccccacaucaacaggaaagacauccuggugcagauguccaucugauaauucagggaaccucgggagacaggauggagaggagggugagcuagcuuccucuucccacaccuucaagagccuuucucaagcacuuucuauuuuuugaaaucucuuuagaggucccagacuuugaucuguuucaauuaagguauuggcaggcauuaguuaacagccacuuggaagcaaaaauagaacauuagaucccugaguuggaagagagaagguagaagguguuacuuggacugcaauuaucugcacuuggaauugagcauuuagucaaaaacuuauauguauucuauauucuauucucauuucugcuacagaauuguaaacaauauucuuccuuaauacagaaauucauagcccacuaaaauaagagcguucucauuuguucauuucucaaucauuuaauaaguauuuacuaagccacuauauccauauauauauauauaucauauauacuguauaauacacacuguaguguuuuuuguggauuguguacuaugagguaguauguuagauacugccaguacugggguaaggaaaacagccugauuaggcccuuacgaagauuccucagacuuguggggaaaacagacauuaucaaauagaaauacuugcaaaccacaguuauguguuaaaaaggaaaaacaaaguaaaaaaaaaguuggugggggggaaccugaucuccuggauacagugcuucgagaaaguuuguuguuggaaaugcaaaccauuacuacuguggaagggaaaggucagaaaaaugaacucaccauuacugaauaguaauaguagcuaucaauuagguggcacuuaccugcaucaggaccuguccugagcacuuuacauagauugucucacuaaccagcccaacaaauauguaagggagauacuauuauuuuucccauuuuauuaauguaaaacaauuaaauaauucuuuaaaauuagacuuagaaaaguggagcaacaaucuuagcagugcuaggacugaaauccaaguuugcuugacuccaaagucuaucucucuuccagaaacuuuuucuuuacuaucugccuaguaggccugcuguauuccuauuugcaacagccuuuuaaacucuuuaaaaauguguccuguaaauuucauauaugauuauacaaaaaaacuuggaauaagcauacaauucuacuuaucuguguuaacuguugaaauuugaagagcuuuuuggaauucuauacccuucaguaguguauguaaaaguuucuaaauauagagaacauagauaagcaaaaauaauauuaaauaaaauaaucgcaccauuaguagguaaauauacuaauauuuuguuguauuuuauucuuguauguuuucacaaaguauaucauaaaauuuuuccuguggcaugacuuaacggagaaaauaaucuucccaaaacauguggcagcaaaacuguuaauuuauuacaucaggcugggcacaguggcucacgcuugcaaucccagcacuuugggaagccgaggcgggcagaucacuugaggccaggaguucgagaccagccuggccaacguggugaaacacugucucuacuaaaaauacaacaguuagccagguguaguggcacaugccuguaaucccagcuacucaggaggcugagacucaagaauugcuugaacccaggaggcagagguugcaguaagcugaggucgcgccccugcacuccagccugggcaacacagugagacucugucucaaaaaaaaaaauuuuuuuuuaaauaaauaaauaauaaauuuaugucuucauaaagcacucagauuaggaaaaaaaggauaaacaaaaaggcaugugucauuuuuuugauugauaauuccaaauuauguuucuuccuuuaauuuuugcccuccuuucauuuacaaacagaauauguuuuuggcuaucaucaaugauacuuacucugaagugaaaucugacuuggcacagcagaaagcugaaauggaacucucagaucuuaucagaaagguaggaaaaaccuuaauucucagaauucuucuguuucugacauaaaaugagcauuguuucacccagauuuucaaaucaacauugauccauugaaauuguuugaaauaaagaauacauugcuauauuucaggaauaauuuaaauguucccuaucuuggagucuugauggauauacugcuaucuugaauuuuaauucugggaauccuuuuaugcccuggaauuaaauucucaacaaucuuuugacacuuuaagagcugagcugaagguucaucaccuucauuauuuugacaucuccuguagcuggcucucacuucaggauccugaguugagaauaaacuagaagggaagauuauauaaagggauuuccaccucuucugucucaauuaccauuuuaaaaaaauaaaaaguuuuagaggaaaacacuuaguaguucacccuuuacccuugaccuuccacggcaguuuuaaaauaagcaaaggaaaagauucaugaauucaggccauagccuggggccugagaacuuuuacuuaugcaccuucucaggaaggguuucauuguuaaauagaagggcaggacaggaaaguugggccucuuuguucuucucaauguaacuucuuuauuugguuuaaaguauaaaauguauacaacaacaaauaaccacauuuaaaauacacaguuuguuucccaacaucauuuugcuaagucauaguggcuccuuaacuguaauuuuuuuuuuuauuaguccaagccuuaggauuauguuaucugugauauauguuauaauagaaaacuuaagccucuuaaaacaaaguccuugggaugggaccuaagauucacauuaucuugauuccgcauaacaguugcuuacauuuuagcaaaucuccaguguguaugcaagcacuccucacuuggcacaauucugauacacacaaacuuugguuaccccaguuuuguuauguaacaccaccuucaacaacacaguucaaauuucaguuaucauaguauauuaacucugaguaacagcacaaaguacaaacuccacugcuagcucuucaguguauagaucaguuaccugaguaacagaugugcaggcugagcaggcucacuggucagucaugacacuauuuucagucuguuacuaauuggucacugagcaucugcuauccaauucacaaacaaagaaagcauguaguguugcuuccuuguguuccaguaauaagcccaugugacauuuuacaaaaauggauaauugaaaaagagaaugggugcaguggcucacgcauguugggaggccaaggcggauggaucaccugaggucaggaguucgaaaccagccuggccaacauggugaaaccccaucucuacuaaaaauacaaaauuagcugaguguggcgacagaugccuguaaucccagcuacuggggaggcugaggcaggagaaucgcuugcaccuaggaggcggagguugcagugagccgagaucgugccauugcacuccagccuggguaacaagagcgaaacuccgucucaaaaaaaaaaaagaaaagaaaagaaaagaaaaagagaaugggcuagcaaagaaaugaaaaaugguaacacuggaagugaaaaucaaaacagaguaauggauuuauagaagaaauagcugagugaagaagaaauaggaguguugacacugcgaucauucaagagauccagauauggagccagaagaacuuagggcaggucuaucaacuuaaaugaggaaaauagcugugauaaaacagaugaagaugucuugaggaaaugaugccugcaaaaaacuucacauuaagggaagucuuauuagagauauuucacaauaaugaaaguacaaaagaaaaaauguuggggcuggacaugguggcuuacuccuguaaucccagcacuuugagaggccaagguggguggaucacuugaggccaggaagucgagacaagccugaucaacaugaugaaaccccgucucuauuaaaaauacaaaaauuagccagacaugauggugcacaccuguaauuccagcuacucaaguggcugaggcacgagaauugcuugaaccagggaggcggagguugcaguaagcugagauugcaccacugcaauccagccaggugacaggguaagacugugucucaaaaauaaauaaaagaaaaauauguuggaagcucauccacauuuaagaaggaauaugacaauucacuaaugcauagaaaagaaguucacuccacauuguaaaguguacaguguaauauuauacaaugaaaacaaggcaagugcuguuuaaacuacucuggauacauuuuuuacaaagaaauaaaacacuuuaguuuuuaauguuucuaauguuuuacauuuuaguguauuaaaucaauauuaguuuucuucuuuuuuaagcucccuauacauuuauaacugacacuaagggaguguuuaauguuuugauuaaaaguuguaaagaucacagaacaauuguaauucuucccacugauuauucagaucauuuugcacaauuucagcuugcauggucacuuacagugccgcacuaugugcaaagcaaggucaggucuaaaguucgcuaaugaaaaauccucggccaggggcaguggcucaccccuguaauccuagcacuuuggaaggcgaggcaggcagaucgcuugagcucaggaguucaacaccagccugggcaacauggugagacccugucucuacaaaaaaaaaaaaauagcaaggcguggugacucacaccuguagucccagcuacuuguugggggcugaguugggaaaaucacuugagcucaggaggucgaggcugcagugagccagaaucacgccacugcccuucugccugggugacagaguaagauccugucucaaaaaaagggaaaauccucaucuacauuucacuggguuuuuuguuuguuuguuuguuuguuuauacacacuuaaggaaauuacugucuagaagauagauaauauaaaaaauaaaaaugcaauucaugauucggguuucuugguauuccuaagaacuguugcacaguacuuuaugcucugaggcagacagcuauagcauauauaguaauuuuuguuucuaucacauaaacuugaauacacauaugaguaaaagaccuuuaguucuucaugacuuacugaaagacccugacuuuuuccauguaacuguuccacaaguguuuuauggaaaacuggauacauuaauucuucauucauccagcacguacuuguugaauggccaauguacaccagguuuguaguaguuacuacugugaauggaaaguaaaacagaugcaaaaggagaauacacuaaaccaagucuuuuauuuuuucucucucugauagggcuaccauaaagcuuuggucaaacuaaaacugaaaaaaaauaccguggaugacauuucagagagucugcggcaaggaggaggcaaguuaaacuuugacgaacuucgacaagaucucaaagggugagaaucaugcuuccugagguucugaaaaauuccugcuucuaaagauaaauuccuggugauaagaguauuucuagcccaagggcucauacagauacuuuuuuuuuuuuuuuccagaggcagguaucuuucuggaacauguuauaagaggaaaacuugcccccauuuggugauuucuccuuuccuccugcauuuugaugucucuguguugagggugaacuggguacaaggaaugauuuuuaucuguauccucucucuaauuucaggaagggccauacugaugcagagauugaggcaauauucacaaaguacgaccaagauggagaccaagaacugaccgaacaugaacaucagcagaugagagacgacuuggagaaagagagggugggucugguuuaggagaaccggauuugauuugguaccuacaacaccacagauguaucaaacacuauagaaguaguggguuauugagucucuugcccauuccccaccacacucucucucucucucagucgguuuauguguuaguacccuguuuauuccagaaagaauauauaacacaauuauguauaaaaaugggugguuagcaugauauaaaaacgucaaaaugaaaagcaagcaaaacaaaaguaaaaauaauggauuauuaaugaagcuuaaaaaugcauucauaaaaacacauaugcuuauuaagauugggcuacaaauugggcccuaagcuugcugguaaucagcuugaaaagagaagccugauuagcugcagaguccacaauguccgugagagugaagaaaacaaaaaaugacuuaccaagagaugugaaauuauucugguuaguuaguggcuauuuaaauuguuaacuuuuuuuucuuuuuuuuuuuuuuuugagauggagucuugcucugccucccaggcuggagugcaguggcacaaucgcgacucacugcaaccuccaccucccggguucaagcgauucucuugccucagccucccaaguagcuaggacuacaggcacaugccaucaugcccggcuaauuuuuguauuuguaguagauaugggguuucaccauguuggucucaaacuccugacugcaagcaaucugcccaccuuggccucccaaaguggugggauuacaggcaguagccaccgugccuuuccuaaauuauuaacauuuauaauaaaauuaacagccgccuuccauuugaauacuuuuuacaaaauaguuaaaaauaaacauaagugggcuuuuauagucagaaaaaaaaauucaaagcuuuaccauuaacuuucaaaaauaaaugguuagacagcaacaacaaaaaucugugguaacugagguacagagaacacagaugaauguuauuacaaaagccacuuuccuaugagaagucuaggacagugguuucuaaaugccacuccacagacagugcuaguaggugacagacuucuccagucacagugaaauuuaagcauaaagaaaaugaggaaaauuuuuacaaggcucuauuuagacaaaguucuuauucugacauuacaucuuuccuacuuuggagcuguugaauguauuaucuuuuaugaaaagaaggcgauccagguugagcaucccuaacccaaauaugugagucugaaaugcuccaaaaccuaaaacuucuugagcacaaacaugauagucaaaggucaugcuuaaaggaaaugcugucauuggagcaguuuggauuuuggguuuucagauuagggaugcugaaccaguaaguauaaugcaaacauuccaaaauauuuuugaaaaucccaaauccaaaacacuucugaucccaaguauuucaaauaagggauacucaaccuguaauauauuucuucauuucuuuauuuauuuuauuauuauuuuaagauggcucauggcccacugcagccucaaacuccuaggcucaagugaucuuccgaccucaaccucccagguagcucagguagcugggacugcaggcaugcaucaccaugccuggcuaauuuuuuaaaaaauuuuuuguggaggcagagucucaccuugcugcccaggccagucucaaacuccuggcuucaagcaguacuccugccucagccucccaaaguauuaggauuacaggugugaccacuaugccuggcccauauuucuucauuuaguuuuuucuuugccugcuguguuuuuaauguucuuucuuguucaaacaaaaaguuggcuauuccuugcuguuaguuaaauuugccaaucuaugaaacugaaaaaugcaggagucccagccugguguuaaauacaaagaaaucccagguaaauggcaugcacccaguuccugcuugcccaaguccuuggugaggcuucuguggggucucaguguucugcuccucacucagugaccccuuguucuucaggaggaccuggauuuggaucacaguucuuuaccacgucccaugagcagccgaaguuucccucgaagccuggaugacucugaggaggaugacgaugaagauagcggacauagcuccagaaggaggggaagcauuucuaguggcguuucuuacgaagaguuucaaguguaaguauaaaggaauuggcagaauuugcguugacaagaguccacaugagaccaggcaguucccucaucucucugaauucacuccuuuccauuacuaaucauccagcuuuuaaaaauaacuuauacuggccagacgcaguggcucaugccuguaaucccaccacuuugggaggccaaagcaggcaggucaugaggucagaaguucgagacgagccuggccaacauagugaaaccccaucucuauuaaaaauacaaaaaauuagcugggcaugguggugggcaccuguaauccuagcuacuugggaggcugaggcaagagaauugcuugaacccgggaggcggagguuacagagagccgagauggcuccacugcacaccagccugggcgacagugcaagacucugucucaaaaaaaaaaaaacuugucaauugguguuuuguuucuuacauaauauguuuacuauaaaaauuagcaaauaagagcaaaagaaaacauuaacauuucacauauuucuaccaaugaaaaauguuuauuaauauaucaguguuugugucucuauuugcauguguuuaucaauguuucuauauauuuuuauggccuaacauaugguucguccugaagaauguuccuugugcauuugagaagaaugaauauucugcuguucaaguguucuguagauguuuguuaggucuaguuuguuuacaguuuuauucaggucucccauuuccugguugaucuuagaugugccuagaugugguauucacguuugaaagugggguauuaaagucuccaaguauuauuaguuggaguucaucccuucaauucuguaagguuuugcuuuguguauuuuggaacucuguuguugggugcauacauauuuauaacuaguauauuuuccuaauauauugacccuauuuucucucucaacuuaaugaggcuaaagaaaaaaaagaauugacccuguuuucauuacaagauguuauccacuuuaucucuaguaaaauucuuuguuuuaaguauuuuuuguuugauauuacuguaaccacuccagcuuucuuuugguugcuguuugcaugauaaaucuuuuuccauccuuuuacuuuaaacuuauuuauaucuuucagucugaaguaugucucuccuguagacagcauauaauuggaucuuaucuuuuuauccaguuugacaauuucuguuuuugauuagauugcuuaauccauucauuuaauguuaucauugauguaguugauuucugucugcuauuuuauuuuuuguuuucuagcuuacuuuuuuuuguuccucuuucacugcuuucuuguacauuaagugaauauuuucaaguauaacauuuaaauuuuuuuaaugauuuuucauuuuuuuuagucaggaguugcucuaagacuuaguuuauacaauuaaguuaugaaaaauuacuucagauauauauuaacugaauccagugagauauagaaaucauuucuauuuagcuuuuuuccucuucccucuuuuugugcuauauauucaucuaucuauauguauauauagucaucuacauauguugcaaaucacauuguuagaacaauguuacauuuuuauaacacacuguguaauauauaguauauaauuuuauaucucuuaaugaagcugagagaagaggaaguauauauuuauaaauguguauauuaaccuacuuuuuuaccauuucuaauucucuucuuuugcuccucuggauucaaguuaucaucugucgucauucucuuucuccgauacagcuuugcuacugccuaccuccuauuauugucaaauauauuacauuucuauuauagaccuucagauccaauuauguacauauuuuuacacaacugcuuuuuaaaucaguuaaggaacaaaaggagaaauguacauauauacuauauuuuauaccuacacaguuaucuuuaccaguguucuuugccuuuucauguggauucugauuacuaucuggagucacuugcuuucagcauaaagaauuuccuuuaguauuuuuuguaaagcagguuugcuagcaaugaauucuuucauuuuuuguuuaucugagaauguuuuucuuucuccuucauuuccucuggcuuguauuguuucugaugagaagacaggugcuaauuuuacugugguccccuuguacaugaugacucaauuuucucucaccacuuucaagauuuuuuugcuuuugucuuucauuauuuuuacugugauaugucuggguauaaaucucugaguucauccuacuuagaaaguguuuuuucugcuucuuucacuuucucuucuccuuugggacccgcauuaugcauaugcuuagggguaucacauauuucucuuaggcucuguucgucgucauuuuuuuucccucucuguuccucagagugcauagucuguauugauguaucuucaaguucacugacuuguucuucugucagcuugcuuaaaucucuguugagcuccucuaguuauuuauuuauuuauuuauuuauuuuauauauauauauauauauauauauauagagagagagagagagagagagagagaaagagagagagagagagacagggagacagggucucacuccaucacccaggcuggaguacagugguguaaucauggcucucuacagccugaacaccugggcucaaaugauccuccugccucaaccucccaaguagcuaggacuaugggcacaugcugccaugccuggcuaauuuuuaaaaaaaaauuuguagagauggcaucuuguuauguugcccagguuggucucaaacucccggccucaagugauccuuccgccucggccucccaaagugcuggggucacagguaugagccaccgcacuuagccugaauuuuuuauuuauuauacuuuucaacuccagaauuucuauuugguucuuuuuagcaaucucugucucuuuauucuguauuugaugauauccuguauuugaugagacaaugucaucauaacuuccuuuuuuuuuuaagagauagggucucucucugucacccaggcuagagugcaguggcaugauccuagcucacugcagccucgaacuccugaacucaagcaauccucccaccucagccuccuaaguaccugacacuacaggcaugagccacuguacccagcuaauuuuuauuuuuuguagagauggggucuaaguugcccaggcuggucucaaacuccugggcucaagugauccucccugcucaggcucccaaagugcugggauuacaggcaugaaccacuggacccagccuccuuuauuucuuuaaccauggugggguuuuuuauuauuuguuuguuuguuuuaaccuguuugaauauauuuauaauagguaccuucaggucuuugucugcuaagucugacaucugggcccucucaaagacaguuucaguugucuuuuuuuuuuucuucuuguguaugggaacauuuuccuguuuuuuuguuuuguuuuuuguuguuuuguuuuguuguuguuguuguuguuaaagauuggacauguuagauaauauauuguaggaacucuggcuagugauucccuuuccuccccaggacuuguuuuuauuucucuuugcuuguuuacuuuuucauacagucuguuuccccacagugucugccucugacuuuauuccuuagagggcgcagcuguggccauguacguagucacucugggaagacagugguuuuagcagcgugcucauuaacuuucucugaccucuuuguuauaccuccugccucuguggauauuagacccaguuauuacauuucauuguuuacugauuggucuauuguuuuccagaaugccuugggauguaauuugcuccacagucugauccacuuaaauucaggccucuuugcagggcuaguuuuagaggccagucuuuuuuuuuuuuuuuuuuuuuuuuugagacagagucucacucuguugcccaggccggaauguaguggugcagucucagcucacugcagccucaaucucucaggcucaagcaaucuucccaccucagcuucucaaguagcuaggacuacaggugcacgccaccaugccugguuaauuuuugcauuuuuuauagagaugggguuuuaccauguugccccggcuggucucaaacuccugaguucaagcaauccacccaccucagccucacaaaaggccgggauuacagauaugcaccaccacgccuggccccugaggccagucuuuaacugucuucuuagcugucucuuucccugguucucucuggugaacuagcugguaauuuguuuaucucauaaggcuaccagauuccuuguaaaugcuuauccccacaaucuccauuguuuucaagagcaucguuagucuuuaauuuccucacgcuucauuccaaauaaaguccauucacuugagaagaguucuauauuccuaugaccugugucuccccaugagcaaaacugcuacugcuuuacagagccagggacaguggcccaccucucuguggcauccugcuuuaugaacaagucacugggcucagauggcagucucugauuuucucaccuugcuucuucuggcauggaaacuccacccuacaagugggaacugaguggaagaagagagccccauuccccuuagccacucuuaacaggauuagaaccucugcaacaugcauuuaagaaugggaacaggcugggcacaguggcucacgccuguaauccuagcacuuugggaggucaaggcaggaggauugcuugagccaggaguucaggaccagccugugcaacauggugagacccucaucucuacaagaaauagaaaaauuaacugguggguuguguauaccuguaaucccagcuacucgggagccugaagugggaggauugcuugaaccuggaggcagagguugcagugagucaagauuacaccauugcacgccagccugggcaacagagugagacucugucucaaaaaaaaaaaaaaaaaaagaguaggaacauugaggcugggcaugguggcucaugccuguaauccuagcacuaugggaggccaaggcaggaguaucacuugacgcuaggaguucaagaccaaccuggguaacauagcgagacuuugucucuauuaaaaaaaaaaaaaaaaaagguguaaaaaacuuuuguaacaagagugggaaagccgggcacaguggcucacaccuguaaucccagcacuuuggaaggccaaggcaggcaggcggaucaccugaggucaggaguuugagaccagccuggccaacguggugaaaccccaucucuacuaaaaaauagaaaaauuaucugggcaugguggugcacaccuguagucccagcuacucgggaggcugaggcaggagaaucacuugaaccuacgaggcagaaguugcaguaagccaagaucacgccacugcacuccagccugggcgacagagcaagacucugucucaaaaaaaaaaaaagaguggaaauguuaggaugagaaaugcuggcagccugccccucccugggagauacuguagcccuagacuggaaguugggggaggagggagcccugugcucuuagcugcacccaugugaaguugugcuucuaucacaugagcuggggacaggagagaaggcucagauuauggcuucagugccacagaaucucuucauacuaaaauuuaguagauuuucuugaauaaaugcuuuuucauuugcuguacacccuuaaaaguuucuagaaauuuuuaauauuugaguuuuaaaaaauaauuuucaacaguuacaguuauuucacuaaagagagagucuacagaacccucuugccaccauugcagagguugucuuuggcuuacgaguuuuuaaaguauuuguauacauuuuuuaaguucaaaauaauagaauuguaagugaacaugcuguuuucauacuguuuuucaagcuuuauuuaauauauuguaaaucuaauucuauuuuauuaaauagucugccacaguauaaugucugaugucuccuuagaauuuuauuguauggaugaacaaugauuauuuaauuuccuaccaauuguuggguguuuuuuguuuguuuguuuguuuuugagacugggucucacucugucacccaggcuggagugcaggagugcgguggaaugaucacggcucacugcagccucaacaucccaaggcucaggugauccuuccaccucagccucgcaaguagcugggaguacaggcacaugccaccaugcccaccuauuuuuuagagaugaaguuuugccauccugcccaggcuggcucgaacuccuggccucaagcgaucugcacacuuccgccucccaaaaugccaggauuacaggcgugagccaucaugcccuacccccccaucaauuguuugauguagccauuuuucaaugauccgcgauuaagaagcagcacucuuuuauagccaaaaauuacacauauauaaaauuuuccuuuagaaaauguucuaaaaauggaaugucuaacuaaaggguuaggcauacauucuuaagacuucugauacgcgcugacuugcaggaaaguuguuucaguuaacacuccuaccagcggcauccgagaguuaaucuguaaagcuugagacaacuuagaaaguguuucaaaugauuguguugcuuaagaaaaaaaucuuagcacuuccuuuugaaaagccaguggggcugaaaagacaaugacaagcacuuugucccucuguacuguguuuuccuugcagccuggugagacgaguggaccggauggagcauuccaucggcagcauaguguccaagauugacgccgugaucgugaagcuagagauuauggagcgagccaaacugaagaggagggaggugcugggaaggcuguuggaugggguggccgaggucaguagucaugagcugaaaacaccgcugcugagcaugguguuauuaaugaaaauauauguugcugacaguuguauuugaaguauugaagaagaguaaaaaaaauuuacguuuauagaaauucacaaugauguuuccauuuacucucauuuucagauuuuuuucucugaaacagaaacacucuuucuauaaaaucucuugcuauaaaacaucaauguagucauauugucuaacccuuaggcugagauguuuaucuuucuccauaacuacagauaaaauuauaaucuggagguguuacuuucuuaauacuccauaugcuaaugguccugccuucacugcaggguagaauuaagugaaaaauuacuccagcaacucugagauuugcuauuauaugcuguaaaucuccagccuuaccaaacuacagauuauuuggucccuggacuuccuaaggcauuuccuucuacugcccccaacaccaguuucuuuuucccuuuuuaggaugaaaggcugggucgugacagugaaauccauagggaacagauggaacggcuaguacgugaagaguuggaacgcugggaauccgaugaugcagcuucccagaucagucaugguuuaggcacgccagugggacuaaauggucaaccucgccccagaagcucccgcccaucuuccucccaaucuacagaaggcauggaaggugcagguggaaaugggaguucuaauguccacguaugauauguguguuucaguauguguguuucuaauaagugaggaaguggcuguccugaauugcuguaacaagcacacuauuuauaugcccugaccaccauaggaugcuagucuuugugaccgauugcuaaucuucugcacuuuaauuuauuuuauauaaacuuuacccaugguucaaagauuuuuuuuucuuuuucucauauaagaaaucuagguguaaauauugaguacagaaaaaaaaucuucaugauguguauugagcgguacgcccaguugccaccaugacugagucuucucaguugacaaugaaguagccuuuuaaagcuagaaaacugucaaagggcuucugaguuucauuuccagucacaaaaaucaguauuguuauuuuuuuccaagagugugaaggaaaauggggcauuccuuuccacucuggcauaguucaugagcuuaauacauagcuuucuuuuaagaaaggagccuuuuuuuucaacuagcuuccugggguaaacuuuucuaaaagauaaaauggaaaggaacuccaaacuaugauagaaucugugugaaugguuaagaugaauguuaaauacuaugcuuuuuuguaaguugaucguaucugaugucugugggacuaacuguaucacuuaauuuuuaccuuauuuuggcucuaauuugaauaagcugaguaaaaccaccaaagaucaguuauaggauaaaauggcaucucuaaccauaacacaggagaauuggaaggagcccuaaguugucacucaguuuaauuucuuuuaaugguuaguuuagccuaaagauuuaucugcauauucuuuuucccauguggcucuacucauuugcaacugaauuuaauguuauaacucaucuagugagaccaacuuacuaaauuuuuaguaugcacugaaaguuuuuauccaacaauuauguucauuuuaagcaaaauuuuaagaaaguuuugaaauucauaaagcauuugguuuuaaacuauuuuaagaauauaguacucggucagguaugacggcucacgccuguaaucccagcacuuugggaggccgaaacaggcgaaucacuugagcccaggaguucaagaccaacaugggcaauguggcgaaacuccaucucuacaaaaaaugcaaaaauaaaaaauauaguacucaaguauucuugauccuguguuucaaaacuagaauuuguaaugcaaauggagcucagucuaauaaaaaagagguuuugguauuaaaaguucauacauuagacaguaucagccaaaauuugaguuagcaacacuguuuucuuuacgagagggucucacccaaauuuauggggagaaaucuauuucucaaaaaaaaaaaucuucuuuuacagaaauguugaguaaggugacauuuugagcgcuaauaagcaaaagagcaugcagugcuguugaauaacccucacuuggagaaccaagagaauccugucguuuaaugcuauauuuuaauuucacaaguuguucauuuaacugguagaaugucaguccaaucuccaaugagaacaugagcaaauagaccuuuccagguugaaagugaaacauacuggguuucuguaaguuuuuccucauggcuucaucucuaucuuuacuuucucuugaauaugcuacacaaaguucuuuauuacuacauacuaaaguuugcauuccagggauauugacuguacauauuuauguauauguaccauguuguuacauguaaacaaacuucaauuugaagugcagcuauuaugugguauccauguguaucgaccaugugccauauaucaauuauggucacuagaaagucucuuuaugauacuuuuuauuguacuguuuuucauuucacuugcaaaauuuugcagaauuccuccuuucuacccauaaauuacauauauuuuucuucuuuagucauggagaacucccccccucaucucuucccuauuaucuuucccuguguacugguauuauuaaaaagacauuacauacgcaagucuuucucgacaaucaagaauguuauuaauguguaauacugagcacuuuacuucuuaauaaaaacuugauauaguag

SEQ ID NO: 14410 - RNA, 503 nt, Homo sapiens
uuguucuuuuuuguuguuguaagugaauuaaaaaguuuauuagccauagaaaaaaacugacuccucuaaaucaauuauugauaaauccccuguaaaacagcaagcuuacagaaaauuucucucaugaacggauagucacuauacuuuugguccaagaaaugauggguuuuuuccuccuucuucagaugacagauggauguaacugaaucuacaaacgaguguacuugccccaaaugugcaacauaaauacagaagagaugaacagaaggcucauaaccaauacuggaacaggaccaacuuugagcccaggugaaucuucuguguagaaucgccacauccgccaugugccugccgaggucgugcggccugcgcuccuugucccacagcuggcauuuuuccucugccggacaguggaucuugcugcccgggcggccacggcuuugcugggagaguguccugaggaucccacauuagugccacugggggucggaccaggcaugcug

SEQ ID NO: 14411 - RNA, 503 nt, Homo sapiens
cagcaugccugguccgacccccaguggcacuaaugugggauccucaggacacucucccagcaaagccguggccgcccgggcagcaagauccacuguccggcagaggaaaaaugccagcugugggacaaggagcgcaggccgcacgaccucggcaggcacauggcggauguggcgauucuacacagaagauucaccugggcucaaaguugguccuguuccaguauugguuaugagccuucuguucaucucuucuguauuuauguugcacauuuggggcaaguacacucguuuguagauucaguuacauccaucugucaucugaagaaggaggaaaaaacccaucauuucuuggaccaaaaguauagugacuauccguucaugagagaaauuuucuguaagcuugcuguuuuacaggggauuuaucaauaauugauuuagaggagucaguuuuuuucuauggcuaauaaacuuuuuaauucacuuacaacaacaaaaaagaacaa

SEQ ID NO: 14412 - RNA, 3501 nt, Homo sapiens
cuuuuuugaggggucuuaauuuacuuugcuuaauuggugcaauauugcuuuaacuccguucacuaaagacaaacacaucaaguccaaacuuguaaauuuagauuugcugaaauacugauuuauuuccuguuuuaauuuaaagugccucaaguaagcaccucucacaacaguugacugguacugcugcuccugagcaccucgugucauagauuuuauacucuuacagacuuggaaugcaguagagguauguggauuuuuagggguuuuguuuuuuuaagaauaaguaacaagaaauaacacauuucuuaauaauagcuuuuuugacauaguuuggaguucugauuauaugguacauuuuucuaccaguaauauaggguugccaauaaauagaaaauguuuucuaaaaauaaauuuuauuacaacaaaauaaaaauuuuaaugacuuauuaacacaaccuccaguaucaccaccauuuggaagauaacacagaaucacaaguaucauuuaauuucuugcccuuuucaguguuguucugguguuggugggaaaauaauaggaaauguaguucauuggguagggaaacucuuaccuuucccuaucuuaaugacaagcuguauuuucuguguuuuugugcagcuaggcgucauagccagacaaauccuaggagaauacacuuuuuagauaaugauuuccuucauuaucuaacugaccaguaucuaaucaaucucagaaaaauccaaaaaauucccugccaccuguuuagauauuaguuggcagauguuucauaggccuucuacaggacucuucaagagaauagaacaguuuggcacucugacaaaguaguguccucucgcuacaaaacuggacucacuuaaacacuggacuuuugucacuucuaagcacagcuugaaggauuuugcugauaaugggcaaagauggacucauaucuuugcuuuccuccccagaacugaacucugggaguccuggucuguggccaauggaggugaaucuuugccugccauagagccugugaaugcucugagaaguauuaucacaaauagaaaaggcugcauccccuguagcugagucaggaauugacgcuggcucuggcacccuggccauuccuucuccuccucaaaggcuugagguaggggacuagcuuauuaaacauuuuuaagcuuaaguuugaauaaucagacaaaaagcaguggcauauuuucaguacagcaaauucuuuucuaugcaucuuccaguugucucagcauucauuaauguauucacuaguguuaaugauguacccuggugccuaucuaauacaaggaaguagggauucaguguuggaauaaguucuggcuacauggagguuuauauagcaaaguagagagauaaauauuaauuauguaaauaauagaaguguuuaauuacaauuauagaugguguaggucaggugcaguggcucacaccuauaaucccagcacuuugagaggcugaggcaggaggauggcuugagccugggaguuugagaccagccugggcaacauagcaagaccccaucucuacaaaaaauuuuaaaaauuagcugggcauguuagcaugcacuuguagucccagcuacuugggaggcugaggugggaggaucacuugggcucaggaguaugaggcugcagugaguuaugauugugccauuguacuccaaccuggugacagagcaagaccuugccucaaacaaacaaaaaguguacaaaaucuguguaaaugaauaauggcagggguggagugaacuuaaagaagagcuucagggaaguuuuguaguuguaaacgguccugaacauuucccuuccaccagccuuguagggcacuguucucccugcuugguaaugccaccaccugaaauuagcacaguauuuuuagaaggaugccacuccaucuuaguugugagauaaggaguccagaucuuaggaucuuugcuuuuaggacuggaaaacuugucuucccuuuuuuaaacaaaacaaaacaaaacaccuuauugaaguauaauuggcauauagaaggcccuacaucuguaaggccuuuacauauguaccuuaaauaugguagcaaacuacaucucaaugagcugccuuucuuaaaacaaguguauguuguuuuugaagggcagggguggcaggaugccacaguucacuuugcuuuucagagaagagccauucuguaggaaccacaaucuaugagauaaucccuaaguuuggccacuggcagcccugcccauaggcuccuguuuccuaaacacuacuugggguucagucacuuagaacugguugguguuagaugccuucaaacaguaucaagggguaccucuuuuacccaaauuucuguugacuaucagcccuuacuaauuuccuugaacucugaaaaguucacggucaguugguuuaaaugucacauuccauaccacuguuugcaaauaggaauacucagagaguuccugagaaaugcugacucaugcaacagacuuuaaauauacuggguuuugacaccucaacaacagaaaaagaguugugggcccaaauagacugucaaccuauguguccucgugaauuuauguuggcaucgcauggaccagacaugggagaaaaacaaguuaguauguauaagcuuuggcuuaauauuuucauaucuuucuacgaaguccguugagcaccaaucugaagaagaguauuuaaagucuguuuuuaaauaugccaugucugggugagucucucaaagucugaaagaacuugguuuccuuguggcuguuuaauuuuuucucacuagcaguuaguuggcgugacaggauuggcucuuucaaggguucagaaagaugagccaaaauugucacagggaccucauucuuaguaguacagauuuaguaauuuaauaguaggcaggaagaguucauucuauaauucauggccagcaaaguccugacuguuugacauuuuuuuaauauaaagaaagaaagcauauucuuucuuaauccguaauacuuucucugucuccccuggucucuacuucaaccaguaaccaaaacucuauaaguugcugauggcagcaaacuccaaagugcccuugaggccaacgcccaauaguuauuuccauucaccuuguugaauaaaagccagagugcuguccucucgcuaagauuucugccagcacuugcgucaguaauucauuccaauaaaauggucccuuuaucaacugaauccccaaacaaaggcuguacuaacaaaaagcuccuuucaugaaaaaaagaaggggggaaaaaagagcaagccccuggaaaccaguuuucaaaaguccucuaacuugugacugcaacacgaagaaguggcccccucugauccuggccagcugcggcucucuuaaaggcuccggguauucaaggcgguauccacuggggcacagggaaggcugaagccaagggggcagaagggcagcaggccaggaaccaucugccucucagg

SEQ ID NO: 14413 - RNA, 1275 nt, Homo sapiens
ucggcucucugcuccuccuguucuacagucagccgcaucuucuuuugcaucgucagccaaaccacaucccugagacaccauggggaaggugaaggucggagucaacagauuuggucguacugggcgccuggucaccagggcugcuuuuaacucugguaaaguggauauuguugccaucaaugaccccuucauugaccugaacuacaugguuuacauguuccaauaugacuccacccauagcaaauuccauggcaccgucaaggcugagaaugggaagcuugucaucaauggaaaucccaucaccaucuuccaggagcgagaucccuccaaaaucaaguggggcgaugcuggcgcugaguacgucauggaguccacuggcgucuucaccaccauguagaaggcugggccucauuugcaggggggagccaaaagggucaucaucucugcccccucugcugaugccccaauguuugucaugggugugaaccaugagaaguaugacaacaaccucaagauugucggcagugccuucugcaccaccaacugcuuagcaccccuggccaaggucauccaugacaacuuugguaucguggaaggacucaugaccauaguccacgccaucacugccacccagaagacuguggauggccccuccgggaaacuguggcgugauggccacggggcucuccagaacaucaucccugccucuacuggcacugcgaaggcuaugggcaaggucaucccugagcugaacgggaagcucacuggcauggccuucuguguccccacugccgugucagugguggaccugaccugccgucuggaaaaaccugccaaauaugaugacaccaagaagguggugaagcaggcaucggagggcccccucaagggcauccugggcuacacugagcaccagguggucuccuccgacuucaacagcaacacccacucuuccaccuucaaugcuggggcugucauugcccucaacaaccacuuuuucaagcucauuuccugguaugacaaugaauuuggcuacagcaacaggaugguggaccucauggcccacauggccuccaaggaguaagaccccuggaccaccagccccaguaagagcacaagaggaagagagagacccucacugcuggggagucccugccacacucagucccccaccacacugaaucuccccuccucacaguuuccauguagaccccuugaagaggggaggggccuagggagccccaccuugucauauaccaucaauaaaguacccug

SEQ ID NO: 14414 - RNA, 658 nt, Homo sapiens
auuagcgguaacgguggagcuggagaguauugcgccuucuccaagcugcccggcgagagccaccaauagugugguggaacuuauggcccuuuccaaggccacggcucuuucggccugcagaugucagcccacgcaucucccugugcuuguggacugguuuggugauccacugggugucaggauuucuucugauagcuuuauggaauggaucaaugaggauaaccucaaaaaauuuguauguggaaucuucaccaacccaguaagaauucaggacccucagagccccacaguggcguccaacucgcuccucugcaacggacugaaggcuucgagcaaacuuuagcugguuaacaccaugauggacaggcuugccguaaguugcacccuuaggaacugggcguuuucggccaccacggcgaacacgaauccuauauauaacguaaccuugcuuggccuuguagcccagucggcgcgcuuuaucaggccggguggggcggggagcccuguggagagcagagagcuggcgguacugccagcagcggacccucagaagaaagcgcaugacaucagacugcuucuuucuccauagcuccuggauguacuuguaugcacccaucuuggcuuaccugauggcugccgccagacggaaaggaaagcc

SEQ ID NO: 14415 - RNA, 1123 nt, Homo sapiens
cauuugagcuggauagugcagaaaaaaaauaaggcuuaccuauguuuauuuaguauggaaaggcauuuggauggaggaagcaacaugaaugugaagguauuuaggcaacucauaauuccaugugauuaaagauuugguuggauuaaacaggaauguggaaaauuacaaagguagaccagguuuagaucauuuaacccuuuagauacuuuggacuuaauuauaauagcauagucaguggggaggcaaugaagguuuuuuugagugaaggugugccucugagugauuaauuugccaauauuauuuaggugaguugaaggaaaggagaauauagagaccagagaagggaaggagaccagcugggcuguugcaguaguagggaaaaaaugacauaaagugauagaaggaaagagaaggggaaaguuaaaagaaauugcaagaguagaaugggcaggucugcaaaauaugaaaacaugcuggguuaauaacccagggauauaagcuucgguggcucacaggauacuggcuggauacuguccagguugacagacccgggacacaagaugaagaauaggcuucugaggaaagaugaguuuuguagucuuuugagguaucacagggucauucauguaaaaauauuuuucagagaguuggacccuugacauacuuccuaggcuuuuaugacaccucucuuaacaaucccaucugucuguuccuuacagauaucucuuuauuugccucccuuuagauguugauaauucucugaauugcauccuuaagccucucuguuuuuuucaucuaccccagaauuucccaaccauguuucaaagcacagucuuacugaaugaauguccccucagcucuuauagcaaugagcugggagcagccuuuccauuuaugcagguggccauacauugaucauuuucuauauaucaugacauggaaaagguuggaagcagugcucuauacuugggugaucuuuggcauccaugacuucuagucucauuuuuacaauucaaauguauccaggccccaggcauguuuauacaacucuacuaaaugucuuuacuuaaacaucacauaggcauuccaaacacagccauguaaaaacugaauucccccuuuu

SEQ ID NO: 14416 - RNA, 10663 nt, Homo sapiens
augugaaagugggacuguaagugcaagacuaaaauaaauuauagcagacuuuuuaguaauaacuuuccauuuucaaacaguauauccugugggccaaagggcuauuucuuaaagaggcauguaaauguauuuauuuaucuaauguuuuuuuccccauguaaacuugauauacaagguuuaguauuugcuccucuuucauauuauuuucacacguauacucagauuuggcauguaccuuucaacaucuccauaaaauuaaacaccuuuuggagaaaagaaccacuauuuucugcucaaagguuucgccuaccuaaaguggaacauguuaaaaaucuaugugaccaucacuggacagcuuucucucaaaacuuuccuucaacgccauggauuagcaccaguuuuguuuacuuuaagguacuuuucccauucaucaucugguuauaauaaauggauggaagaaauauuucccacugaugguuggucuguugcuugccaaauuuuuagggagagcuguucaucauacaacauaagggauaaugacuccugucagguaaaacagaagcccaagaaauaacaacuuuuuuucuuaaaaaguuaguuacacuuguuuucuuggagaaaaaaaccugucaacuccuuugcuuuuccaaaauauuucaggguauuuccuauaagguucauaagaauaagagcuuaacacagaaauaguugcuguucauaaguuuauuaucuauaucugaaaaaaucauagaaaauugcuggguuuagcucucagcagcccgcuccugagcucugaggaagcuugccuucuuuugagcuacccgauccuucuucugagcaagggacauuuugggacgguuccaccuacaaaagauaggaauauauauuuuuuaaacuauaacugaagagaauagaauauuuaauuuaaaauuuuaauaaaauuuaauuuugauagagaauauuuaagacuuugcaaucagaagguuaaauaauccaaguucaaauacauuuacuuauguaugaucuuaagcuaacuuucccaaaccccaacuucugugauguccuacuaccauagggccaaaagucaaauagaagacauguuagauucaguaauaccacuucuagguauuugcccaaauguuuugaaaucaguuuguccaagagaguggcacucccauguucauugcagcacuauauauuaauagcaacagauaaauggauaaaggaaaugugguauacauauacauaauggauuauuacccagucuuuaaaaaugauggaaauucugucauuugcaacaugaaugaaguggagaauauugugcucagugaaauaagccaggcacaaaaagacaaauacuucauauucauauagaaucuaaaacaauggaacucacagaagcagagagcagaauggugguuacagaggcuggugggugcaaagaaugggcagaugauagucaaguauaaaaucuccaacaggaggaguaugauuuuguuuuuaguucuauugcacagcaugaugaauauagaauaucguacauuucacaauuaagagaauaaauuucaaauguuguugccacaaaguguuaaguauuugaggugaauauguuaaauacauugauuuaauuacuauacauuguauuugugggccaucacaucacuuuaugcuuacauguucauuaaguauuacuuucuauuccauuuaaagaucaaaacaugaaagaucaacaaaaagcaacuugucagccaauaaaaaaaugcaguaaccaguacuuagacuguacuaggauagaaagaaccaccucaguagugucugaggcuaacacauuuccaucaccacaguuacuuuugcaaaccugguucccuucgcuucugccacaucacgcagagcuagugaucgaguuugcacaauuacaccaacagucugccccacgugggaaccauucccaaccuguuuucuugaaaagacaaaaaaaaagacgacauaccucuucuuuuuaacuucuuucuugggcuucuuuucauagacuggauucucucguauagcagcaugagcuuucuuauacaucuccuccaucugaaacaaaggaaagcaaacaguacuugguuucauuucaugugcccuacuauauuaaugcaaccauaacuuaucuuguccuucuaagccagauucucaaaaggaacuaaacuaaaucaauguugguaaacacuuuaacuucuaaauguaacucaccuuuuccuaacaaauucccaauuuucaccuuaugcaaugugaauuaucacuacagaacuccaucuuacucaagaaaaaaaucaggccagguguggugguucaugccuguaaucucaagcacuuugggagucugaagugggaggaucacuucagcccaggaguuugagaccagcuaaggcaacacagugagaccugucuccauaaaaaaacuaauuagccagguggcaauuauuaaugguggcaugcaccuguagucccagcuacaggacuacacgugaguccaggaggucaaggcugcaguggcacaaucacagcucacuggaccccagccuagaugacagaaugagaccucaucucuaccaaaaauuaaaaaaaaaaaaaaaaaauuagcagggcaugguggugcacaccuauaaccccagcuaccucgagaggcugaggugggagaauugcuugagcccagaagucugaaguugcaaugagcuauaauugugccauugcaccccagcccaggaaacagaacaagauccugccucaaaaaaaaaaaguaagaaaacaaaaagaaaaaucugcauguacuucugagaaauucagccacacuucuugagucacucuaaaucaaauuuuugucugcagaaacaaauauugcgcuucucauuuuaaauacugucugaccuagauucuuucauucaagaacaagugccaaaaguauuaagauauuaagaugaugaacguaugggaccaagagucacaacacugacauagcuuaacugagaccaaggacuggacacaggccaacaagcaaauucaucugucaucccacaaucccuagacuuuuguuuuccaucuuuaucucacaggccuuuaaaaguaauucccagcauuauguaccaaggaccucucuucugucuuucacuaccaccaaucuaucccuaguaucuagugguaauauaaggccucuagaccagaaagaugucagaaguuuuccugaaaagccaaccgaucagauauuuuauugggcaauuuuuuguuuuuugacaugaagucucgcucuguugcccaggcuggagugcaguagcgcgaucccagcucagugcaaccuccaccuccaggguucaagcaauucuucugccucagccucccgagucgcugggauuacaggagugagccaccaugcccagcuaauuuuuguauuuuuagcagagacaggguuucaccauauuggccaggcuggucucgaacuccugacaucaggugaucugcccaccacggccucccaaguccggggauuacaggcgugagccaccaugccccgccagggcaauuuuguucuaaaacucacugaaaaaaaaaaaaaaaaaaagcugcaacucucugaauaucuaauaauuauagcccacuacagacuaugucacaguaauccaggucucuaaaauuauucaaucaauguggagaugugauuacuacaugcauuugcauaaagauuauuaaaggaaaauaaugcaaaaaugcucacugcauuugaaaccucaacuaccuauacccauuuugaaaguuaauuucccuaccucuuuuagcacucuauuauagcuagcuguucacuaacaaauaacaaauccauuugaugacuucauauauagucauucaacaaaucuaagcaacccaguuccuuccaagacgucagacaagcagacauguagauaaugccugaauugagguaaagaccaccuccuguuggagacacaucagaugucugcacaggauuucagcaggcacacaggaggauagaggccacuguagauaaaauuaaugagccagcuagaaaaauacauuagccaaaaaguagucuagcugaaggaaggcacauauacaggaaagcauuaggaaguaaacaucugaaagcacaaacugggagucugaaaaguucugagcaaguaugacaugacuacauaaagauauagguuaggaaguaaauuuugcaagacuaguagaaucauaauccaaaaguaaaugaccucuuuaccaggaugaagucauaaguaacaaagaaauauaacgcaguaaaaauuaacaugcaccuacauuauugauaaaaaacuacuccuuuuccuaacucagaaacucaagcuauuuguuuauucagccuuuacacuguguccaaagcauagaaauaacagaaaguggucauuucccaacuacuguuuuuaaaaauuuuccuaaccaauagcuaugccaaaauagaagcuacuacacacuaacgaaaaagaaccugggucaggaauggcucucaucuguaagcccagcacuuugggacucauucuugcaaacauggcuccccucauuucuacaacaucacgcagacccagugaucaaaucucuuuuccuguguacaugucugagauaaugggaaaguccagaauauagcacacauaugcuaugaagagcuuuccucccagaugguaucaaaauaagugaaguuuauuaucuagcaccucuuauccaacaaagcagauuacaacuaugauuacagaaaugacaucuacaaauacagaacagccaaagcauaaaagguagccaaaucuucagaugcuugaagucucccacacuugagcaucuaaaagauuacuaaaagaauguugacaagucuagcucauguugucaagaaacacaccuauauaagaauguuaccugcccccaaaacaaguaauaaaccuauuuccauaaauuaaccaauauaggcauuuuuagguaaauguuuuaccaugucuggaguuacgcuguucuuuauguauugagagaacuguuucuuguaagcaucuucaucuucuuccauuaaguagcgcauguaaucugcaacauucuggcccaugaugugcuuccgauguacuucugcauuaaauuccuugcuuucagaaucauaaccagggaaucguuugguacuaaaauaaaguuauucauauuuuaguauagacucacuuaacuuaguuuacuaguaagaauuuacuuuaguagcugccaucagucccgucuugaaacaauuaucgcaucauaugcaaccaaaggaccaacuacugacugcucaguuagugggauaucaucauucagcagcucaucucugaauuccaggacagaaaagaaauucaugcuacaaaaaccuuuaaaagccauuaccaaggcuuuccaccacuacaaaauuagucauccagcacaucagcacaggaaggaguuucaaaacuuauacucuaaauccuuuaauuuucaguggguacaugggaauaagugauuuguccaagaucacaguuaaugaaauugucaagugagaaugcucuugguguacuugcaacuaacuccccccacccaccuccacaucauaaaagcaaaauuucaguuggguuguauuuuaggcuuaccaaaaauuacuauuucuugguuaaaucaccaaaugcuaaaauauuccuaagaaguuaauaaaucaagaugcacagacucaacaacaaaaaauaucauuaaaccaauggaacuacaaauuaaccuacuuaacuucccaaaauggccuacaaucuuauuccuaguugcagguuuagaaaucuuucauaagccuuuuccucaaacuucuuauaaaauucuaggauccaccuuuuugcauaauucaguaaaucauuuuuauucugauugaaaaaagaaagugcauggggaaagaggauggaguugcucauuucuaauaagaauuaagucauaugcaaaagguagugguuucaaucccaucucuuucaauaacuggcccgaaaaacuugggacaaauaacucugggccucagacucuuaauuuauaaaaugggcuauaauuccuuccugcccuacuagguuccuccugcaugguaccuaggcauacagcaggcauucaauugauagcuacuuuaauucgguuaucuccacaguccaacuaguuaaaaacagggaaguaccacgguccaggcaccaaggucuuaaauaguauucuuaccugugagggauagacaagccuccauccacagcucccuucagggcaccaaaaacuuuauugccagugguaguucuggcaaggccugcauccaaauagcaggugaaggcaccuggcugaccaucaaugcuuuccacauuguauucaucaccagucaccuccacuuggccuucauagaucuuguccaugccaaaccuauugagaagcuauucaagaaaccaauguaaaugcugguuucaauuauucaaacugcucuaaaauuaaaauagcuuaugucauaaccguaaggaccacugacaucuggaaaagaaaauuuccuuccacacccacccuuucaccagauccacuugcucaugaauuuuuaaaugcuauuuaaaaaaaaaacuuaaaacauucaauuucacuugaaacaauuuuguuuuaugacuuuugcaucuuugcuacauguccacacuugacuuaugcagcaaucaaugagaaugcauaaacuugauucuuauacuuacaauguucccuccauuaaaacauguuuauaaccaaugaguggguugucaucaaccuugcugcacaugcuuaacaauuccauugcaaaacaagguaaaaaacucagauaauaaaaacaaggcaaaaucccaucuucaucuaccaggaaaaauguuuaaaacaaaaaugaaucuucccgucaauggccacucuccaaaacacuaagauucucauuuuuuuuuuuuuuuuuuugagacacaguuucgcucuuguugcccaggcuggagugcaauggcgugaucucagcucacugcaaccucugccuucuggguucaagugauucuccugccucagccucccaaguaguugggacuacagacacacaccaucaugccuggcuuuuuuuuuuuuucuacuuuuuuaguagagacagggcuucaccaugcuggccaggcuagucucaaacuccugaccucaagugauccacccuccucggccucccaaagugcugggauuauaagugugagccaccgcgccuagccaagauucuccaguuuuaaugugcauauaaaucacuugguacauacuaucaaaauacagauuccagaaggucuagaguggaguucccacgagucugcauuuuuaauguuugccaacauucagaauguauaccuaaguagcaagggucuucauuguccaauuaaguagacacuagcuacaaguggauuuucaaauucaaguuuacauacugcuggaacucaacagcugcaggucgcuaguggcaaaaccacuggacagcaaauuacagauuugugucauugcagaaaauuuuauuggaaagagcugaccuagauagauccauuaacaaagcagaaaacuggaagcaagcacucuccugaagcacaacuuaagcuaucuuauccauguacaaacaucuugcagaaaacucuccaagcaaucagccacaaacuacaucaauuaaaaucaucuuguacauacccugcgggccagcagcaggccaguacaauaugcugcagcauaauuugucaggccaaccuucacaccauauuuuggcaguucgugugcauacgcugcgcagacuaucauaucccccucuauacgggcauaagcaaucuauaguaagagagaaacuagguuaguaaucuguugcuuucacugucuuacuacaucuuaauuauuuuucaagggaauaaaaaaacauugauggacacagaugaacaucacuuaaaaugcuuaagacucuuagcuggguuaccaguaaauuagaggugcuuaaaaagucaaagaggaauacccaaauauuucaaucaucuuuugaacuaaacauaacuaaagucagcaaagucucaggaaccuaacguuuaguuaucugaacuuggguacggaggaagacaaugccuucacaaucaacaaacuauuugcccaggaaacaggugugccuaccugcugcaaaauaucaauaaaucuuaacucucagaauuucuccuaguuguaaaagcccaggauucuagcuuucagaguccagugagaaugcucuuaguacaagagcaaaacugacacuuccuaaaggucuuucaugcgggagccaccuuuguacauuuuauuaaaaccuauuucaaagaauaagcagaacaaucuuaaagcccuguuuaauucacaacuaccuuuucagugguuaaguggcauauaaggccauauaggaaaaaucaggacaaacccuauucuucuacuggaauugggaugggcaagaacuucuuacuuacuucuaaucuccccaccccacacacauaaacuagguuucagugucuugcucugucaccuagguuggagggcugggugugaucucacuucacugcagccucaaccucggggcucaaacaauccucccacugaguagcugggacuacaggugcgccccgccaugcccagcuaauuuucuuacauuuuuugugaagacaaacucucacuauauugcccaggcuggucucaaacuccugggcucaagcaaucuucccgaagugcugggauuacaggcaugagcgcaaccaagagcauuuuuuaaaguaccaaguucccagguuccaauucuagaccuacuaaaaggaaaaauuauucacuggaugcuuuuggaggugcuagacagcccuucuaacacacacaccaugugcuuugcuucccaagcacaauuucucuagcaauaaaaaaaggggacugucuagaauacaacuuaccugacaaaugauaucucuguuugucacacgaacuaucauccuguauuuggguguguuguauuuauuuuuaucuuguaucaccaagcguuuccgagcauaauaaucaguuuuacccucugaaagaaaaaaauaauuguagaaaggauacuccacugcaucugcaaagcagauuaauauuguaaacacaaaaaggugacaguaccucgucgucuucuaaauuucacuugguaucucuuaaaguaggccuuauucuuaacaacuuuaacaaaccccuuaaagaaaaaagaauguuauuaaaacuuugaugucuuagccuaugauacuuuugacauaaauuaaccauguaacaaaguaacacuugaacuucaagaguaaacagacaacugucacuuguagaaucccagguuucacaagcaacuagggucaagaaucuuuuuccucuaccuuccaugucacagacuaguaguuucauaaaacaauaaaaaugaauccuuagagaaauauggaauaaaagaaacauacaaaaugcaggccccaauuuauuacauuuaacagguauaaaauuauuguuauauugcuuucaaaagguuuuaaacgcuuucaauuuccauauuuguuucuucaaggaccagcaccgguaauugugccaaacuuuugcgaagcacugcuccagacagcaaucagugaugccaaacgucgguuuguucggaacacgcuaugucccacuucgaaaaccuagccucaaauaacaacuacguaccucucucgcuucccauguuauguuuuucaaaagccuaaauuaccugccacaaagcuuaacugggcaagagcacauucagcaguaauucccccacuaaaacagcacuguuccccaucagcuaaagcaacauuucaucccacccuuggggcccuaccccaauaauuaaaaacucauccggcgacggacucuagaggaagaggcaggaggcacguauuccauguuaaaggagcuuccggggcccagggaccccucggccuccaagcuccacugacaauuuuggcuuaaaagccacuugcucagcccacgggcacaagcuuccuaaaucuaagacuugccggcuccgacauucuccuggaaaacccacgaaguacucgguacucggaggucgagugggacccgaggaccugcagccccccuccauucuggcguuccccagcuaggcugaggucgacugcuugcgaccucucacgcccggccgcuugccagcgcccccucacacuagacggcaguauccgcacucaggcugucuacuaaacucacccuucuccccaauccgccguccaagcucacgcaacccuucuucgccaaccccuccccccaaguucgcgcaccgggcggcagccauuuaaggccacgcugggaacugcaccucgaccaagucagagcuagcaaucuaacgccauccggccccugcgacgcgcgagacgggcccuaggcuggcauacgggcaagaaaagggaaccuccaugcaucuaaagccccgagaccgaggcauccacucaccauccugcggaacagagaccggcguccgcugcucgacagagaccugcaggcccagcggcgcuagggggugggaaaagggccacagcccuugcgcaggcgcaguauguagcgcggacggucacgccagugacgugugaaagagagagggcgu

SEQ ID NO: 14417 - RNA, 3656 nt, Homo sapiens
cagaaggcgccgcuccugcugcacuacagacccaagauggacuugcugugaauggugccacacagcgcccacagacugggcccucgcacccuugggugcucccggccgccgcgcuuaagaacauugccucugggugucauguggaccagacuucugaauagagaauauuuauaacuuuuguaugagagagaauucacacucaacaagacacuaccagcaccacguuuacagaggaugaaaacacuucacagucucccagagccgaucguccucucccccgccccaccccgugcuucagccuugcagggagagugaugcuccaggcaacacgguucugagucaccuucugacacgagcucccucugcuugcuuuccaggucuugaaaaucugaauucacuucaguuuaguuuaugaauuuuagguuucaugauaagccucaaguguaguuggacuuuuauugaauccuuccuaaguuauugaaaaaaugucuuuucauggugaaugacaauauuuauguugccuuuagcuucuugaagauuuagaaguuauauaaaaaauuaauuuaaaagcaaaccaaaagagguuuccauuaacauuaugauuuaaccauuguauuuaauuucccaccuuaugaaacacaacagcagcucccugacugguucgccuuucauugugugaggucggcacuuggacucacucagaacugucgcucaccuguggcugacacacccagcccuggaaacggggccccagacgccacgucgggauuucugacaugcucagcagguagaccagaggccgugugaccagcucagugcugguuuacggaacaacucuuacuuuuaaaaauuacuuguucccccaaauuguugagugccgccguuugguuuccuauguuuucuuucccuguuuugauuuugcugaagggagaggugguggugguuaggaucagagcucuccuggcauccguggggaggauuugcuggugguggcuucgggcucaugcccagacacacucacugccccgucuguccaaggccuccccuuccccuuugcuggugggaggagcucgugugcuccuuggccgcuuacuggaagggcguuuuucagagcugcagggacagggugagcagcugaagggcuaggagggaagccggcccccgcucugcagaagcugcauuucagcugaaucuguguuucagccucaguugguugcaccguuagccccucuccucccggauggucauguuuuugucacauuagagaauaaacagccacacacacauuuuuuuuuuuccuuuaaaacaguaacuuggaaauaugaaaaggccagaaggaggagcaagggcuguuuucuggagugguugagguguuguccugcaguugucauugucuucuccaccgggcuguucccauuuauuuccuguggaacugaaucccuccucccuccacuccuugggagcccaggugguccuuggccaccauucaggcuuuccaagaagccaaccaccuuggagauuuuuuuucuugaauuucgcuguuuucuucugcuuccuuuagauaaaaagcagcucaagagaccuuaucuuagggaugagaaaaacaugcauauuaauuccaucugagugauugucaguguaaggccuuuuaaaacaaaagcaaguucuuuguuaggaauuggucaaaauucaucucuuucuuuaagcccaucaacucccaggacgguuugaguuacucaguuaccuaagcuugcuauucauccaaaucauuuucuagagucacuguauaagggucuaugaguagcuguguaugaauaaauauuaccugucuaccucaaaauacacauacugcugaagcauucuguacaaccguguguuaucacagugcaguuuuaaguguaacguuagaacuuaggcauuuuccuguguggcggaauaagaaaggauuaaacaguuacaagccuccaaauucaaauaaaauuaaaucacaguucagaugaaacugaauaucauuguaauaaucucauaauauauauuuguaacuuuguagcuaucuuugaaaucacuugacuuugcaauggugcuaagcugauagauuuaaauacacagacgggcgaguggcgcccgugucgaugucuucagccaguggugacccugcuuuuguaaccgcguuaaccugacaaaaccucagcagcagaagucccuauuuuucuaggaguucaucgugcagacagucuucacuacaggacucggcccuggggccucugccucucgucugaccuugcagccuuagucguuggaggcuggagcgcaauggcccugccgucuguggagccucugggcggccuucuuuccuuucugucaaccucucauuucacagaaaaaggcugaauuucauuuuuuccagcaugaaagccaggaucgguuagugguuggauucuauugguuuuuuuuuuuuaaacagauggaguuacugugaagaaguuuucacaacuauuuaugcugguaaaacaaaugcuguuaaaucaccuuaugcgucguuuucaacagcaguggggcuaauuacccggaauacggucucaccgaugcaguuuucauggacauagaaaauucaaauagaauauauaauauugaauuuaagauuugggggguuaaaaaagaaaacuuaacuuuauaaaauuauuuauucuauuuuaagccuucuaucauauuuucccauccaauuguuugguuucagugguccagcuuuauuuacaggcauauaaaaugaaauugugagauguuuugcaagcuucuuuuuacuuugaguagcuuuuaauuuguauguuuuuauguggaugaagagcauuuuuuaugcuuuugugcaauagguuccaauaugcauuuauuagacaucuguuuaaaugguaauguagcauuuauuuugcuaaauugaaagggaacauagauggaauuccaaaauauguacauucagcuguuugguuuuucguuuuucauuguuauuauugugagaaugcuguuauugggguugugugugagugcccgucagccagugaugccucgggccacgcuguggggccaccucaguccugccuggguccuggugccuuggaccccacgugcuuguggccaggcugccccugggcagggccauguggccucagaccacaagagcggagcugcccuggcccaagcacugcagcugccugcacccccgggcuucgcagccuugcuuguuuucucugaacagcaacagaacaguguucacagcgauucaaaggguggcauuggguuggacguucuggguacaagccaaccuagucccacguuguacgugaauguuuaaugugcucucaaaacauggaaaauaaguuuagugcacauagcuaaaucacaaaacauccaauuucucuguuuccucaggaagucauuacugcgccaccacaucacaugaccuuaacaugaucaauguauuucucugccuugacauuuaaauacauaaauugagauaaguagauuagaaaaucauucaaaugauaccauaauuuguacgggacagggugcgggcaauggccacguggccaaggcccugcaggaacgcgccgaggucucccucacccuccagguguccuucgcacccaacagugcgucugagg

SEQ ID NO: 14418 - RNA, 753 nt, Homo sapiens
cucacaaagacuuucuucuuccucuuuugcugauguuguuuacaggcacucagaaugguccagcauuugauauaccaucguaggcuuuccuacaauauagccucuaacaaaacuaggcugucccaaaccccagguaauagaauuguuuacuuuuauaccaagaagguugggaaagcaccaaaaucugcauguggcaugugcccaggcagacuuugagggguucgugcugugagaccuaaaguucuuaugaaauuguccaaaacaaaaaaacaugucagcagggaauauggugguuccauuugugcuaaauguguucaugacaggaucaagcaugcuuuccuuaucgaggagcagaaaauuguugugaaaguguugaaggcacaagcacagagucaaaaagcuaaauaaaaaaugaaacuguugcugggagugguggcucacaccuguaaucccagcacuuugggaggccgaggcgggcagaucaugaggucaggaguucgagaccagccugaccaacauggugaaacccugucucuacuaaaaauacaaaaauuagcugggcaugguggcaugcaccuguaaucuccgcuacuugggaggcugaggcaggagaaucgcuugaacacgggagguagagguugcaaugagcccugcauuccagccuggacgacagagcgagacuccuucucaaaaaaaaaaaggaaagaaagaaacuuuuuugagcaauaaaaaugaaaagacuuuaaaaaaaga

SEQ ID NO: 14419 - RNA, 10718 nt, Homo sapiens
cugccaccgccacuaccacugggcucauuugccccgaccccuucccgccgccccgcccccagccccacacaagguaacaaccccccugagggagagaguaaggccuggccgggcccgggucccucccgaggugaagcggaggcccaaggcugaggagcccgccucgccggagacgcccaggcgcuggcccuggaucccggagccacggccgucucucagccagagcugagccucggcggcccggccggcgcuggccuccgugcggcggcggcaaacacggcccgcaggggaccgggucggguggggcugggcgccgcgcggcucccuguggagccugccuguuggagcgcggcggggcuccggcgguggucuuggagcuggcguguggauuuccacguccgaaugaucgaguuguggcgggcuuugaggugcugcguggcggggaggagagcagccugggucgcuguaacucuuagggggccuuugcaggcucccagccuuugguuggacgggaauuuuacgaaggagaaggguccucggaaacgugguacauuugcuuauaaaccaucaaaaaagguuaauugguaucuuauuuucaggaaaaugacugagcuggauuuggcgaaaggcacauucguuagaaugccuaaaugggagaguaccugugcuguucuuuuugcugaagauaaugcaccgauaaauauuuaagcgacugggcgaaagauuuuuguuuuggagaggcacuuuuaaauacacucuuaauugaauaguucaaguaaagaucguaguuuguguaguuaauuuaaaaacgcacuuguuuggcuuuggaagcauacuguagugcuuaaaaauaaguauuuggauuguuuuugaaaguuucgacuuuuccaacagaguagugcuuuuuaaaaagauaacacugauuauugagccgaauucagcaccuacccuguggauaggaguuaaaagaaaauuagaaauuucuuuguaucuguaugcuuuuuuaaaguauggaauguaucucaaguuuauaauccucagaaucuguugccuuuaaguuugugguuuagcugaagucuaaacugagaguaaagguaauggugguaaauuaagcugcaguguuagaaggaguuagaggcaaaaacugguaauucaggcagacaggggaguuaguuuuuuaugccuugauuuuugguuuaguuuucauggucuaacccuuuuuauuuucccuagaugucagaggauuuagcaaagcagcuggcaagcuacaaagcucagcuccagcaaguugaagcugcauuaucuggaaauggagaaaaugaagauuugcuaaaauugaagaaagauuuacaaguaaguauggguagacaauuguacuuuuucucuguuuuucaaauuauugcuugaaucccuaaguacccaaagcgccuuuugagggguuacaccccacccuauguauauauguaaauucuguagguaccauugcuuguagaaguaggguugcuuccccaguucucagguuucuguacaucagagugaaauauuguucuuuguuauauaaaucuugugugcuuacauaauuuuuaaaaacuaaaguugauagaaauuuccaagucugucagauuuucaagacgagagguacauguaacuucacaaugaaaaacgcuuuuaguuuuuaagaccuggcaaaugaaauuuaguucaaaaaguaacaaagauugaaggagaaaaauagaaccuuaagauucuuuuuaauaccacaagauucuuugaaaaugcgugccuuuuuuuuuuccccaaagcuaguggauuacauuuuguauugaaaacacaccacaaaaaugccuaaagagagacaagugcuuuguauaauuguuacauagauguucagacuuaaggcuagguuuuacaguaaaguuguugacacuuguggaaauugaacuauguggugaaaaggagaucuuugucaugguagaguuuaguagauaaugaaaccuuuuuuugaaaaccugcacugggauuucaagacaaacauagagccaucauaguaaauaccuuuuguguuucaggacaccagacugauucagaaaaaugccauauauaauuugcaaauauauaugacuuuuaagagcuuccuuuaaauucugaaccugauuuuuaaaaaguuucaaggguguuuugauuagagauugcuuuaccgacugaguacuaaacucaaaucuguauccugucuaaaaauucauucccucccuuuauuaucccacugcccguuaaaacuauuacuauuuuagggauaucagaacugcaaacaaacuuaacggaaauaggguccggauuugggauucuggaacugcuuaucugggcguaauuaagaugaguugaauacuuucaaguucuacauuuagaauaaaauugcaguaguauguuauuuuuaaacacacacaaacuaucuggguuaauuucaauaugaacaagaccccucuucgauacguagaagccaggccugugggcuucagggugccagucaauacaaaaaagauguuuugggagcaguuucucccacucccaggcccuuaagugagaaauaacccagugguuugccaccuguccauuugauuugcucauauguugugaguauacauugaagaugaggcaacagaggcacaccgaccucuuauuuucuuacacucuguaaagugcuuucuguuugccccaaagagagaugccuugacuaccuuuaccaacuuaagcaguccuuuuuuaggaaaagaaaacacugggugccaauguuuuguauauugcuucuugggcagugggaggagggguauuuguugaacugguuggguuggggaaguugggaguggaguuagaaauagcauuaucaucaggucuuuuuaauauuucuagaauaauuccucauuagagucugagcagaacugccuuaccaugucaugaucaucauaguggaaaguacuguagggggaaaccauugugauaaacacuguaguaagccccuaaaaggcuugcuugcagggguucaguuaauaaugaccuggaaaucauuuuucuguaaaguauccucuuuucuauaaccauuuaaaacagcacuguccaguagaacuuucugugaugauggaaauguucuauaucugcuauucaguaccauagccacuagccacauuugguuggauauuugaaauacagcuagguuuacuuaggagcugaguuuuuaguauaacuuaauuagccacacgugacuaccauacuggauggcaaggauuuagaagugcaaguuuuaauacuucagauaguaauaacagaauguuuuuccugaccagucuugaucagaguuucuucccauuuuauucuaucauuagaaauuucauuuuggucccuagauaaggucuauuuugaauugaaaacuacucaaaaacggaaaccaucuuuuaagaugagguaauacucugaaaaguauuuggcuauaagcuuccacucaguaauuguugucuccauugagacuacacuuaacagcuucuauuuugcugugggguucccccccucauuccccuccuuuuuccuucucugccuucugggauguaucucaugcuauggguauuuaauucagcuuguuauauuuggugaaaagucuguucagacugauuuuguggcuuccucauauuaauauuuuuugaccaucauaugguuucuaauuucuuguguuccucuauagaauuagauccuuaucccaguuauuaauuuguuugcccuuuguuuuaugacaaaaugcuuuuuuugcaucuuuucaaugacuucauuuugccaguaagguuuccauguuuaucucuuucauguacugucuuucauagagacuaaaguuauucagcaggcagcaaaauaaucuacuaaaguccugccuuucuuuuuucacuuaaaaaagugggugugauaaaauccaggcuagcuagcugacuagcuccccgggcagucuaugauaaucagagauagucaauuuauuaggcuguuuugcugaauaagcugguucuaaaggaggcaggggucaagucacuugucucauauauuacaguggcucucugcauccccgaaacgccuuccuucaguaagcagagugcuugagugcaccccauuugaccugcugauauguagaucacaacaccugaugcuuccuggaauugccgauuacuguaacugcugcccaucugucgaugaaggagcaguuucagaacucagacuugagggaggaaaaguaauuaaugguauguaccuucaagaacccccucauacauaaaauaguuuuucuaauacuuugguccauacgcacaugugaagaauagaaauuuagaagguucuucauaguuuguugggaggguuauguaaaaccauggcaaaguuaaaggacauuaggaguaaaugcucuggauuuuuucuaaaaaagggucauuucagcacaggccucugaauucacuaauaugcacagcuuuucaggacccuuuucuuugaugaaauauauuucuuuaacaaaauauauuuggaaaacaguucuguccuaaaagaaauagaguucuaaaucugaaaccuacaagugcagaauucaugucugugcuuaaguuaaaugaucccuagguggaucuggaaguauuuaaugauagagauuugugugggcucuugagucaggcugacuggauuacauuccuaccccuaaaagugguuaaaaauaagaccagauaauuuacucuucuguuguguacuacuugaucuaguuauuuggaagguucuuugcuuuguuugcaaaggacugucuaauuaaaaagaucuaauuaauggcuaguuggcaacuaauaaaacuuagagauauuauuccuacuaaauuuuuaaaucaaaccuaaguguucuauuuauuuauuuauaaaacuaaccuuucuucaagagauuuaagacucaaauauuaguuuuuucagaaauagccaggaagauuuagaaucuuuaggagagagguaauauuuaacuuucuuggcuacuggaaucaaaauuacuauuaugaaaccucagugggaacuagaagaaacucaguacauaguuuaacuuuguuaauuuuucuccccaaacacacaguaugauguuuuaaaugcaacaaugggugaacagcuaugcaaguucuuagaucagauaagaugcauaguguggaucuucauuagaguaacaauauaguagacagguagcagaaucugucggcuuguacuguucucaauuuuuuagccaucccuacaccaaacaucuuugaaugaagccaauaaauguaagccugaauuagaaaaaaauauuugccacacagaaaggcauugccuuuguguguuaccuuuuuuucccccuuuuaaaugaagcugugcuaaugugcuuaacauuaagguauggaacauuuaaaaucuaaccugguaauuugcuuacccagauggggugaguuuuacaauaauugaauaggaagaccacugguuucuuuuacauugccuguaguauuuuagucgagauauguauaaguaggaacauuuuuguuacuaauaaagcugcuuaaaguguuuugggauugcuuggcaguuaauacugcugaguaaugcccuauaaaacaguacaguugcauaaaauauguuacaauaagaguaucuaauucagugccucauacuugacuuucucaucuuuagagagaucuauucagcuaaaauaggcacuuagaaauaaugcaugguauaagcucaagucuuauauuuucauuaguauuugugguuaaguugaaaggcaacuauaugggcuuaagucacagcucugccacuuaacugguagacaauacuguaucaguuucuacauggggauaaucacaguacuugcuuaauaguguuaugagcugcaaaugaaauauauguagaguacuuaacguacaguaugaaggcugucaucagaaacuaaguugacaaugagaauuauaaaaauaauguuguaguuuuuguuuuucuuuuuuaggaaguuauagaacuaaccaaagaccuucugucaacucaaccuucugagacgcuugcaaguucagacaguuuugcuucuacucaaccuacucauucauggaaaguaggagacaaguguauggcagucuggagugaagauggacaguaaguguagaaaaaaaaacucuaacuauaacaugaaauaauaaaauacaaugguaagaaguuuuuauucaguuuuaacuacccuauuuuaaucuugacuucuauuaggcaguaugauuuauagagccaauuugauucuugggugguugccauuaauacaguuuaguuuuagcuuuagauuaaguuuuggggagaagaauggcugggauucuggaggaaagaaaaacaggacaaugaauggguguuuucuaaaauaaucuaaauuauuuucucuaauugaaaauugagugaaugguugguuuuucugagaauucugugaagagcauacacugacaucauuccuauaagaaauaucuuuucgcugggugugguggcucaugccuguaaucucagcacuuugggaggcugaggcaggcagaucgcuugaggucaggaguuggagagcagccugaccaacauggugaaaccccaucucuacuaaaaauacaaaaaucaguuaggugugguggcgugugccuguaaucccagcuacuugggagacugaggcaugagaauuguuugaaccugggaggcggagguugaagugagcugagauugcacuacugcacuccagccugggcgacagugagacucugucgcaaaaaagagaaaaaaagaaaccucuauucucaaagacauuaaaucacguugaguagguacauguaagagacuugcccagcaauauuaugauugggauguccuuuuuugauagcagauaacuaacuucaaccacucuuuuguauucucuuugcugaaacaaccauuugauuauagaaguuucauuauagacacauguaauaauuuuaucacuacaguauaagucuuguaggcugaguacuaaaccuuuacucaccugcuuacagccaugauaucuuuacagguguuaugaagcggagauugaggagauagaugaagaaaauggcaccgcugcaaucaccuuugcugguuauggcaaugcugaagugacuccacuguugaaccucaagccuguagaagaaggaaggaaggcaaaggaggacaguggcaacaaacccaugucaaaguaagugacuuugacuuuuccauuuuaggugcaaucuuccccauuuggauacuugaaguagucugcagagagaaucuaugcauaagaaaguuguaauacuguuuuaccguuguuuugaagauuagcaacaaagggucaacauugucuguguaagugugccuaaguaaagugaagauaauuuugauucccauuuaggcauucaguaaauauuaagaagauaacuauguacaaugaacaucuucccagcauauuuuauaagccagguacuggggcuauaccacaggagaccaccucaggccuugucccaacugaguuuauauuuagagaagaaaacucaucauuaaugaagugcuuuaauaguacaguguaaacauuacaaaggagcuauaacagguacuguaagggaacaagagguacucagccuccacuuuuauuauuagggcagauuucuuugagaaaaugacaucuaaacugagauuugaaaagaguaagagccaaguacaaagcuacaaggcgguaugauguugaucugggcuugaauucuuuguuauuaaugagcauuaugaccuuggagaagcuguuuaacucuguuuccucaucuguaagauaggggcaguacauuauuggguugugaggauucaaacgauaaguguuaguaaagcuuguaacaguucuuuacauguaguaagagcuuaguaaauuuuuuuuaaaggggggaggugagcacguacaaguaacaaaucccugugguaaaaacuuggggccuggaagguggguggucugagaagagauuagagagguaaaguccagaacauaaagagcuuguaagccaccgauaacauuuuaaguagaggggauaugaugugaucacauuugagcuuuagaaugaucacugucaguagggagaggcaacuacugcugugauccagguauaagaugauggccugaacccagggaguugcaaugggaauggggaacuaugcaguuuugaaaaguaagaggcagaauuaacaauauuuuggugaacuucugcauauuugccacaacuuagucuuuugauuugucaagaguuuuugaaacuuaaguugcuacauauuuauauuugaauaugcaaaaauuauauauuaauguaagcauuccaauaaaauaaaauucuagaacaauguauauauauauuuuuuaaugucuuugucaucuguguaaaaagccauagcuucauggugguaauaugguaccggggagucuagauauugccccucuuaaggaucuuucuuuucauccuuuuggugagaagucaguguuaacugagcagaaauuauuggggguuuuaggcucugauccuauuuagaaucuuauuuagaauguuuuugaaacccccagguguuuuguuuuggugagaauuauuagcuaugauuuccauuugugcugcugcauucuuccaauguagguaaaauauuuuaucugcaucgaaucucuucauacauuuuuuucuaaaugcugcacuuguuaacuaugucuauuuggaaguaguugaaggcuuagauacccauuaauacugaaacucaacuuauuccuaaaacaacugguaacagcuauacaaaaguaaaauagaaagucauaauuaaggcugggcgcaguggcucaagccuguaaucccaacacuuugggaggccaaggcaggcagaucacuugaggccaggaguuaaagaccauucuggccaacauggugaaacccuaucucuacuaaaaauauaaaaguuagcugggcaugguggcaugugccuguagucccagcuacuugggagggugaggcacaagaaucucuugaacccaggagguggagguugcugugagccaagauugugccacuguacuccaacuccagucugggcaacagaacaagacuuugucgccaaaaaaaaaaaaaaggcauaguugaaauauuuaccuuauauggguaaauagauuacaguuauguuugaaagcuuccaaggaugccauuuuuuaaaaaaacauuucuuaguaauucugggugauugguacugauuuuaaugauuuaguacuuuuuauucauagaccauuguauauguuuauuagauuuuuuuuuugcacugccggugucuucaaggaagucauucuuguaugauaagucuuaacaguugacauuuaacuuuuuuucaugcagaaaagaaaugauugcccagcagcgugaauauaaaaagaagaaagcuuugaaaaaagcucagagaauaaaagaacuugagcaggaaagagaggaccagaaagugaaauggcaacaauucaacaacagagccuauucuaaaaacaaaaaaggccagguugguaaaucuuuuuacacuuuguaaauuugagaaaugcaacugucauuaaaauaacuuuaaaaugaaaagagauggagauuuuuuguaaaguaugauuaacucagauuuuguauuccgaauccuuguugaugcucaauuuaacuuauugaaaaauguuagccauugucucugcaauaaaaauauuacaaaugagagaauuuauaucagaaauuacaaaaggucuauguucuuuuccuucuauaaacuaauauuugaaaaaauaguugcuacuuagaggcagugugcuuaacucuaucugcuuuguuaacaugccuucaugcugggcaucacugguagauuuuauuuaaaagugcauucaguuucccuugauacacuuaccuuguguguguuggguagaaaauaacuguagcauucauauaggaaguugagaauaaggauaaccugacuuucacccauguguuacucuucacugccaucaagguagcccuuccauugauggacauggcuucuggaaagaagcgcuuccuuuucauaaagauguuuauuuugugacaaaggccaagggacuucacaauuuggcuaucauaacaggccccacaguaaaccacaauacagccagagcuuuaaucaugcuagaauggcuagcucacagcugaaguuaggauuugcguuuacaaaacuaaaauuuugacguaucagaaggcaaguguuaugaguauuaguaaauguaaugauauuuuccacaacuuagaaguuacaguaaauggcuuccagcaugggaccacuucuguacccauuuuuuaacacuaaacaaaggcaauauguuuuucuucuuuuaaacguugaaaccagaauauauuuuaacauuacuuaaaauuugaaauuuuuuauuuuuuccaacacuaaucaggaaugauuucuguuuucuuucccuuagguaaagaggaguauuuuugcuucaccugagagugugacugguaaaguuggaguaggaaccuguggaauugcugauaaaccuaugacacaauaucaagauaccucuaaauacaaugucaggcauuugaugccucaauaaucagaaaaacuguuggauuucaucucugcagggcuuuacauuuaccu

SEQ ID NO: 14420 - RNA, 1856 nt, Homo sapiens
gagugcggccuguccuguccuugccaugaggcugcggcaggcaccagaguccagaaagguguucauucagcgagacuacagcaguggcacaggcugccaguuccagaccauguucuccauggagcuggagaaccagauugauaggcagcaguuugaagaaauaguucaaacucuaaauaaccuuuaugcagaagcagagaagcuugguggccaaucauaucucgaagguuguuuggcuuguuuaacagcauauaccaucuuccuaugcuuggaaacucauuaccagaagcuucugaagaaagucuccaaaugcauucaagagcagaaugagaagaucuauguuccacaaggccuucuccugacagacuccauugaguaaggacugcgaguuauugaaauuaccauuuaugaaggcagaggcaugagccauggaagauaaaccauagaauuaaagauccuacuucuagcugggccccucauguauccauuggccgacugcagagugucucuaccuccucuccagaguaucauuccuaucugcugccagagccacacugccauuuacuccaaggacuuuguaaaauuccacaccuggaaagaccuuuaguugcucaguauccacuuugugucuccaaauuguguaggacucuguaaucuuuugacuaguuucugagaaaacacaaugaagcauuucacuuuuuuuauugaaggccauuuaauaaaacacagcuggucagcccagugcaaaccuuauuaucugccaccaguauguaccauugguucuccucauuccuugggccagcuucucagguagcuuuagaccucaacaaguuguaucuuugccaguguuccaucuuguuccccuaaauuaauaaaaugcuuuucuccaggauuuuggcaaagguugguguggcugugguuuugcuaaugcaccuccuagauuucaaagauuuaccaguuuuaccaugacucauauauuaagaucuguuucuacuauucaguuccucaaacugaagcucauugaaaaaauaauguauaauguuauuuguuuuauuauagcaauuauuccucauuaaagcaguauuuaaugcaauuuccaguuauuucuuuggagaauguuauguccuuguugcauuaccuuaaagguugugaagaugugauguguguugcuuguucaucacaaaaaucaguaagcacaauaaaguggaugccaaaccaucaaacacauagauguuccugcugggucccuggauauguaauaagcagguauaaaaauauuuuaauuauaguuuucuuacaaauauaacuuacgagaaaaaaauuugauuggaauaauacuguauauuacuaauuuuuaacuaucccuacccaaaccuuaugacucacagaauuuucucauauacaguauucagugcacagaaaacuuaugacuggcucaaguacaguaaguuacuucuaaguaaaacucucaagucugaguccauauuuguagcucugcuuuugguuguacguuucuaggaucagggccgcuuaugccuuuucguucauccuugggguuugagagcacuguaugagggagagaguuuaaaaauacauuaggagacagaaaccauuaaaaguuuaacugucagagauauuguaggugcuaauacuggauuucgucuuucagauuuaauuucuuuuaugggucuguuaaucauucaauaaaucccauaaguauguguaauauuucaauuguguaaaacucguuugucacuuuaaagccuguaacaguguguuuguguuuucaacccauugcaauaacuuugcugaaauauuaacacauuaauaaaacuuuucuuaaaaaaaaaauaaaa

SEQ ID NO: 14421 - RNA, 2196 nt, Homo sapiens
ugggcaacagggagguggaggcccaugagguggugacagggaauccgagagcugaugaagugcaccauaguugugcgagcauaaggcgccuccagcggauggacaccagggaggcaaagcacaagucaguggagcagugguugcagaugcaggcagagagcugacagagccaggcaacuugggcauggcagggcagggccucggcuuucguggggaugggagcuucugugugggugauguuggagcuuucuuggccccauguggauaacccaccauuggagggcacaggcagguaaagccgguuagugccugugucagggagaugcugggcagcgagguuggugagaagggccugggugggcuuugaaguggagccaaggggccagcggaucggauguguguaaaugcccaggugcgggccaggcugugggugaguggagguggcugucgggagcagucuggggaaggggucacgucuggcuggggcucaugguguuugcaagguugagacguggguggucagcuggugcaggaguggccagagaguggcuggguggguugagaggaggccuguguccuccacaggggcccucauaguggacugagaggaagcuguggguaccagagccaggggcucagaugucagagggaaagcccuuuguaaggacgcagacgcuucugggagcuggcaggaugaagccaagacugcccaggacaccuggaugggagcgauucugguuggaguugggggauaaacccugauugaagggauucagaacaaagugggaggguagaaacucaggcaguguagaccgcucugaggaggggaucagcguguggucagggcagguggcagugggugucggugucuacacagacguggauggugccguggcacgaacacaggcugcgcgggaggcugggucugugauggggucgugccgucccaggagauucauggacucagaggagagaacagucaccgggaagcucuggcugguucuuucguccuuggggggugggaguucaacaauuaaagugaacucuggaagagcagagugaagcucacagucccaggucacgagcacuucugugugccaggcgcuucccacaaagcacuuuguacugggagccacccugggggauucacgcaggcuccaggggaugccuugacugcgaggaaggccucuggucaaacggggcagauggacccagguuggaggagccuucgcuguggcauccuaccccucuaccaggccgcgauggugcaaacacagccgcguugucucauguguuacagcaagacucccagaaagcagggggagcagaggaugagcaggaaaaugaggacgaugaggaggaaagagauggggaggaggaggaagaggcggaggaauccaacguggaggauuuacuggaaaacaacuggaacauuuugcaguuuuugccacaggcagccuccugccagaacuacuuccucaugauuguuucagguaagcccagagcccagggcugcgcagcccccacugaagggacucaugguuaguagauguggcuccugugccaugguaucgcaagaagggagacagggaaaaucagaucgggcggagccugcccagcaguugggacuuugugagccgaggggccuccucuccaggcuccaggcauguuccacuggagggcccggagaggggugacugucuucccuccagccuuugcucucaggaaacuccauggggagcggcugccccuggccgugucauugaggaguuuccuagcucugcucccgccaucugauucgguaacucagucacauacauucccagggaacauuugugugugugcacguucaguagcugaagauaaagcccugggucaggucagcugcccccuggcuggucugugaggccuaacuuucuggugggggaguuccuaugccuugguuugggucugcaggcuuagaguuugcaaaucaagcuaugcagguuagugugcagaugaaguguaucgaggaagcacuguuuguaguugacagcccuaaguuaaagaaugcccuaaguaaaaacagcagguugugaugugcacacacagguggaugcggucacagaggccuucguugaugaucauuuuauauuuuugucuacuuguccuugagucuuuaacuuucucaguucucucuugcaacuuucuaugucu

SEQ ID NO: 14422 - RNA, 596 nt, Homo sapiens
acugucucacagcagcugcagccaaucccagugggucugaggccucacuuugccuacugagugggucucagcucacucucuuuggaugcaagaggaaauggaagcccagagaggggaagugacccacucaaagccgcacagcaagcgagggacaaaaucaucuggucacucacugacuuggcaaauauuucuggacucugaagaguggacuaaguccaucagggaagaacauaccuagagaaagcacugacuuggacaaagguacagaggagaaguucugugaugguuaaggguguggguaccagucugcugggauccaagcccucucuggcacuugcugugugacuuagagcaagugaaucaacuacucugugccucuguuuccucaccuguaaguugaagauauucacaguguuuaugucauaggggucuuaugaggaugaaaugaguucauucaugcaagaugcuuagcauggguccuggcacacaguaggugcucaauaaacaggagcuguuaggaaggcauggggaaugaaggacauguggaacaugggaaccaccagccagugguugguagggaaugucuagagcccaga

SEQ ID NO: 14423 - RNA, 12561 nt, Homo sapiens
caaauggaugggcauauuuguuuggcaauguacaaaggacugugggccucagagagcacagggccuccuccaggggcagcucuugccuuuagccacacagggguguuaugugacugccccacaggcgacaugaacuguuucuccuccccacuucgcagguggaaaacuggaacccgcucacagacacuguucccauccacucuuggauccacccauggcugccccuuaugcaggcacggcuggagccacucuauucccccauccguaguaagcuguccagcgcccugcagaaguggcaccccagcgacuccucugccaagcucauccuccagcccuggaaggaugucuucacuccuggcuccugggaagcauucauggucaaaaacauagugcccaagcuggguaaggauaaggggaaaugcauuccaagcccagcagcuuuggugcccugguuucugugguuagcagugaugauuuaaagcaucgccuuuauguucaugaaagugcuuaguacacaauauuccuugcugugaaaaagguaacauuuuguucagaggcugaacauaaauguaacuuggguccuuuccgcuguuuauuuacaacagucacuaauagucgacagugacaauaucggacucugugccuugugguuuucccgauugguuuuggcuucugguaauaggacagccauuggaguucuaaaauuuuugugguauuuuacucuaaauuauuagggaguuauuuccagguuagcaaaaaaaauauauauacauacacacacacacacacacauauauguauauauauacacacaugcauauacauguauauauacacauguauauacacauauauguauauacacacauauauauguauauauguauacacacacacacauauauauauguguauauauauacacauauauauuuuaagaaucgcuaugucgggagcuuaaauuugaccuuuaaaagcagauuacagccugagcaacauggugaaaccccaucucuaccaaaaauacaaaccagccaggugugguggcgggcgccugucgucccagcuacuagggaggcugaggcgggaggauggcuugaaccucggaggcagagguugcagugagccaagaucugccauugcacuucagccugggcaacagugagacccugucucaacaaaaaaaaaaaaaaaaaaaaaaaaaaaaaaaaaaagccaggaguugugacuuaugccuguaaucccagcccuuugggaggcugaggugggcagaucaccugagaccaggaguuugagaccagccugggcaacaugccaaaacgcugucucuaauaaaaacacaaaaauuaguuggccacgguggugcacaccuguacucccagcuacucgggaggcugaggcacaagagucacuugaacccgggaggcggagguugcuguaagcugagaugaaaacggacauugucuuugcucuuugugcuucuuuggcuuugccaguacuaaagcugugccuuacagaccggguuucucuuccagggaugugucuuggugagcuagucauuaacccccaccagcagcacauggaugcauucuauugggugauugacugggaagggaugaucucugucucuagccuggugggacuucuugaaaagcacuucuuccccaaguggcuucagguacacuuuguuuugcuuggauuucugggggagggaacuggguggggauuaaguuaauuuucugccaaggccugacuguagguacaauuccauaaugaaaauaaauuacaugguaggguaggaaugaguuaggucaucuucauagugggcaccauuuauuggacauuugccauguaucagaagcuguuccaagcacuuuauuugcuuuaucucagcuccucucagcaacccuaugggguaggggauaugguaucccuguuguguagacauggaagcugaggcucagagaguuuacaugcaagggcacuuuagcuaccaggcugacuccaaaauccauauucauaagugcuagacuguuuagcuacuauaaaucccuguaaaguagugucacuagccuguaggaccaggaucaaaacaaaacaaauggccacuucagaaaucuugccuucauuuguugccacgauggaugcaaguaauuuuucuuuuuggcaggugcugugcucuuggcucaguaacagcccaaauuaugaggagaucaccaagugguaccuggguuggaagucgauguucucagaccaagugcuggcacauccaucugucaaggacaaauuuaaugaggcacuugauaucaugaaccgggcgguguccuccaacguugguaagugaggauucccauuuuggauguccuggccccaaguuucagauuuuacacauguaaaugacacagaaucagaguuuucugguuccuguaggcagccuaaaccuuaggucacacuuuugcacauagcaacagacucucacccugcugacugggguacauggucagcuggcacccacugcccaggucuaccaugacugagaggggcaucuucccugaguggagacugacuuaagcuggauucagaugaugucagucuaaccccaggccccgcccucuuaaccacugugcuguguggccuuuuaaggcucauucaugccugagcaugcugcuuaggugacgcaucuuacaguguggaguuuggcacgcggucugacacuuggugauugcucagccuuaaucagccccauuuuaccuguuaaacaguaagaucuacuuuauaggcuaaaagggagagugaguucaugcuuguguauagccuucaauagguggugucuguguugucaaaaacaggcaguucacuguucguguacuauaucuguucccaaguucuagguaagucauucugccuagaucauaaguaagugagaguauauuuauguuucuacauuugggagccuauuucaaccaguccugugcuccaguguugcucauaagccgauucgcagcauugaaaugggaucgucuagucuguguuuuacagauaagcccagcgaggcugagagccuguucaaggucacauaguuaaaggguggcaguuagaacuggaauuucuauuuccugagucuuuaauucuuguuauuuaauagccuaggccaggcacgguggcucacgccuguaauccuagcacuuugggaggccgaggcggguagaucacgaggucaggaguucgagaccagccugaccaacauggugaaaccccgucucuacuaaaaaugcaaaaauuagccgggcgcgguggcacaugccuguaaugccagcuacuuaggaggcugaggcagaagaaucgcuuaaaccugggaggcagagguuguagugagccgagauugcaagcacugcacuccagccuaggugacaagagcgagacucggucucaaaaaaaaaaaaagaaaaauagccuauucugugaaaacagagauuaaguaauaaggcaaauauacuucucugcuucuguaauuaucaaguuuuuucuaaaaacucuuccuuagcuacccuuggccucauguuuccaaaacuguucccugaauauaccccucaauuagcacuuagcauuuauggucuugguauuauccuuuaaacacucauuucagcucccuaaauauaugugaacuucuuucaggaugggggcccuguguggguagguuaaaaauaaagccaguaugggcccuauguuuucaagguacuaaaagcugccucuuugguggugggaaauggaaacucuacagagcaaggugggaacagaagaguggcugaggacucucuguuaauguuuccagcucugaaggaagaaaucccuugcagauacuucauuuuaaaauguugaauauuaauaaucugguuacuagauacuagccaggaaccuucugaacaguuuuuaugugauacuggccagucgucuaaacuuccuccaaaguuguaucuuugaggcagagcugcccuucagugagucacaagcacucuggcacacccaagaccugggccaagccacagugucaacuuccauacaccuggaaacaccucuccucaccgcccuguccuccuguaucuuaggugccuacaugcagccaggagcacgggagaacauugccuaucucacccacacggagcggaggaaggacuuccaguacgaggccaugcaggagaggcgggaggcugagaacauggcucagaggggcauuggcguggccgcuagcucugugcccaugaacuuuaaggaccucauugagaccaaggcugaggagcacaacauugucuucaugcccgucauugggaagcgacacgaagggaagcagcucuacaccuuuggccgcauugugaucuacaucgaccggggaguggucuuuguccagggcgagaagacgugggugcccaccucacugcagagccugaucgacauggccaagugaacuguggcagguccagaaccagucagagacuugccccuaagagggauguacuguaaauaaacaguauuuuuagaucaccuucaaaaggguaacuucuuuacucaggagcuacuccacaucaggccaggucaugagggaaggauguaaaaugggacaaugccacguagggcaggaaucuuuauaccaaguccucaugugggguaucguccucaaaacaggacagccaaguugauguucuuuccuggcaaaggaguucucuguaguuccuccauagcagccuucccuuuagucucugguggcagcuucuaccucagccaacacugaguaccucacaacgaguucagucaguagcagaaggaucuucucucuuguuccugaugauuucaagguccucacaguccugauaaucugguucuucccgaaacucccaaauaucuauggagagcuguucuagcuuuugcacagggaaccaguggacagagguaucauuaaauauguccauguauugugaagucugaggaaacucaagcuccuccaguccuuuuaaaaucugagcagaaaaauucaaguauaaaaacuucagauagucacaguaauccccacucuucugggauaaauuuccacuuuacuugucauccccacuuuacuuuuuaaaaaaauaacaaauaggguauuuugauuuaaaugcuuuugcacaaugaauugggcgccccaaggacaguggauaucauggacugugauacuaagaauaaaggaaauaaggaaaaaacuaagagaugcauuaaagagucauagcuuucuggaacacagacccauggagagagcugacaguacacuagcgccacuuagcccaugaguuuccuccuacgccuguaaagaaagauagaauucuucacaguuucacacccuuuuccaucccagccccuuuauucagauagauaccuuugcaauguagggauaauuuuucugcagaauccuugccaacaaccuagaaauuaaaaaaaaccaaaaaaacaaaaaaaaaacaccaugauuaggagguaugaggauaguuucauucaacuuuuaagacacauagaagggcaagaugauugaagcauaguaagaauucaggaaaaaacucaagauguggaguaaaccaguuaaauaguugaaaaugugggccaggcgcagguaaucccagcacuucaggagacugaggcgggcggaucauuugaggucaggaguucaagaccagcauggccaacaugguaaaaccccaucucuacuaaaaauaaaaaaaucagccgggcguccuggugugcaucuguaaucccagcuacucauuaggcugagguaggaguaucgcuugaacccaggagacagagguugcagugagcugagaucauaccacugcacuccagccggggggacagagugagacuccaucucaaaaaaaaaaaaaaaaaaaaaagcaaauauuccaguaauugugcccauuucaucaagagaaaugacugagcagacuccuaagcacgugaaacagaaugaggacguggagcuguaggcagaggaaucaaauagcuuuucccuguuuucaaaaccauuucuguguaucauaauggaagggaggaauucguggcaaaaagacuccuuaacuugcuucauaguucgaaucaggauuugacaucugucuuuaagccuucauccaguucccuguggaaaagcauuuccccaguauggaaucgucaaggaaauguuuucugcaugugggucaaucugagguaugggcuucaccucagggccugacagaaucucagcauucucagacuuaccucuccucaaguccuuugaaacuguucccaaugaugaccaucuuagaaagggcaucuacugaccaguuacuccauaaaagauuguuguacaaggccgucccacaauggagcauguaaaagaugguaggcuccccgcgaauacuccguuucccuuccuggggauacgauauucacagguguaaacaugcccacaaccuauucuuuacagcaaggugagggagagguaaggauggggauaaucaugagacaaacuaaaggaucaaaaggaaaaaagcucauuuuguggaacaguuacacucguauaugaaaucuauaguuacaggacuaaagagucaggaaaucaugaugucccgaaagaacucauguuuacuuaacaaauguacacauuguguucucaugaacacaaagcccugcacugauggaggggcuuccugggucuaugacggcaagaacaggagggauagugauguuacuuaccccauguauuuccccuguguucaguaauccacacuuccuaugucacuuccugcagaucugcauaacuaaguccucuuccaaugucccugaggcacaaucaccccuccugagaaccacugcucucuggccaaacuccagcagggaacauaaggcccuuugucugacccuugcccaccucuggccugccucuccucuccuugcagcuucccuuguguuaauaacaaacuggcagugguuuccugaacagccagcacugcacagcuaccuucaauccugguucugucccacuagcaaacuccugguagaccuucaaagcccagcucagacccaggaauccuuccuccaucccuccgaacaccugucguaguacaagguucugccucaguauuucauuccucauucacuuguugaccaugggcucccugaacacagggacuggcucccauuuuucuuggucuccccaaagcucccugccuagcacagaacaggcacccagaaagaugaucugaacugagugacaguguuuuaggaccuugccaauaucagggaaugacucuucucucaacugagccaaauuuucauacauaauaagcaauaagauggcaguuucagcacacacacaggaaucaaaagauucuaauccccaagacaauacaaaaccgaaaucggagggauuugcucauacuggcuuuggcccugugcuuuagggaugcauuucuuuauuccacaggucucagaaaugucaaaucccagcuauuuuggggggugcaaacaugggcagagaauuaauccacaacucacagccaggugcuauggguuugacuggguuauagcaucaaagaggaaugcugcauccccuuuuauuaccucccugggacaggauaaaauccaaccacaaagaccucacuugaggcaccuagacuuuuauguuucaguagcaacagcaaauaccaaguuagcauaauuuccagacaaauaauucucaaaaaaguggugcagaccuaacauguucugguucaugcuaucuguguaauuuuuuucugaugggcacaacacaagccaaaauguagguaacugauuggcugguuacaucguucaggcacuacaaaagugagcaggcgguaagagaggaauggcugccacugcaaagaaugcugguguccacaggcagggccuggggugagucuggucaggauuuuuacaguucugucugcuccccuuuaaaccacuuaccucguucucacugagaacagucacaccaaggguguuaaggacuucaauuucaaguuggcuaaacagagggucauauacccaacagugacuucugggaaucuagaagggaagaaugaguuguuuacuucaacccaaacaucugugugcacccauguauaggaccagaggaggaggagaugaaaaugaauccaaaaauguaccuggcacuuuuccaacaaaagcagcaaaaacguuagcugguuucuagcuacgaugcagguggcaaaguucccaaugccguaacacacacacuucaaauggcagguuccugugaccaagaucucucuugggauagaaucaguggccacaucugacuccucuggcaaugagucaagaugcagguuuccaaagaugucugaaagaguccccacaggggccuucaguuguuccagauguuuugugagacaucuauugaugguuucugaaagagcaggcccccaaaugcaguuagagggcauguucugacccugugaaccaaaucauccacaaaagaaguucacauauuuggggagaaagagaucagggcaguaaaagguuucaauucuucagagagagagagaagcugccagccucauucccaaacaugccuggacauacagucacauucaccaccaauugacaaacugucccggccccuggacucccaaaacccaagagcauguugcaagcagaaauuggguuucacucaagggcaguuuccaucuaaaacucuaaugugaacucauucuaauuuaacaagacccuccuaguaaauguagacuaugcucugaaaugcguacuuuuaaaguuguaacaaaccaggugcucacgccuguaauccuagcacuuugggaggccuaggugaguggaucgccugaggucaggaauucaagaccagccuggccaacauggcaaaaccccaucucuacuaaaaauacaaaaaauuagucaggcguacuggcgcacagcuguagucccagcuacuugggaggcugaagcagaagaaucacuugaaccagggagguggagguugcaguuagccgagaucacaccgcugcauuccagccugggcaacagagcaagacuccaucucaaaaaaauaaaauaaaguuauacucuguuuaagucuucucauguagagguagguucucuugucucuccuuuuauuguacugguacugaauuuagcaaaacaaaaaaagccgugcauuccaauaagauaccaacuuuucacuuaagauaccagcaaagggccaggcaugguggcucacaccuguaaucccaguaccuugggagaccgaggugggcagaucacuugaggucaggaguucgagaccagucuggccaacauggugaaaccccaucucuacaaaaauacaaaaauuagccagggguaguggcacacaccuguagucccagcuacucaggagacugaggcaggaggauuguuugaacccaggagguggaaauugcagugagcagagaucacaccccuacacuccagccugggugacacagugagacuccgucucaaaagaaaaaaaaaaaaaaaaaaaagcagcaaagacaucuuuaaacaagaccccaagccaggaaaaacuggcucuucaggucaauuuugauaaaagaauuggugaaaauuuucuggauaacuugacaauagauaucaaguuggucaccgccuuucauuuaauucuacuucugggaauauauccuaagaagaucauccuaaguuugguaaaagcuuuaugcauaaaguuacucauugcaaaauuauguauaauaacuuaaaaaggcugguugugguggcucaugccuauaaucccagcgcuuugggaagcuguaggugggaggaucacuugagcucaggagguacagguugcagugaacuaugauugcaucauuguacuccagccuaggcgaagaguaagacacuguccuaaaauaauaacugaaaaacaacagaagaaaacuaaaugucccacaauaaaaaugauaccuaugguauguccacuccaugcauaaauauuaugucgccacccacacacuauguuuaggaagagauuaucacugcacgaggaaaaggcuacauuguaauaucauggaaaaggaacaggauaaauauaaauuucagcaauaauaaugacaacauuuauugccuuguauacagcaggcaagcauuuaacuaaacagcuucaauucucaaaacuauaggauauacacauuaucuccauuucacagauaaagaaacugaggaucagaauuaagugccaaaagacauacagcuguaaggggcgggcggcguuagaacccagcaaguuaucccucugugaagcaaaauguccucaaaugaggacugauucucuuuucugccccacaaucccuaccauuggccaagugguacccaccuagugcugaacuccagaaaucagagauaaacagguccuuccuguugagaaaaaaaauggcacagucaugucccacccaucucagggcugccccaacaguaacuuuccugaucaugaccugaaugcuuacagaaugaggugcccugcaaugcagggcccacccuuaccaagugauaggagggggauauauguugaauauguccagagccagagcacauacugcuggggcucagagacugcaggagagaguaugcuggaggagguccuugauucccagagagagaucugggucuauucucagucuacaacagagccuagcauagaauugcagcucaauaaaugguuguuaagugcucagaauuagccuuucugagcuuuaguuuccucaucucuaaaauggggauaaaaaucauucccaacacggaggaguuuagaggcauaaaauggguuaacauucuuagcccagugucuggcacauagcagguacucaacaaaugguauuuguuauuauaaauaguuuuaaggggaaaguaaagagacaaaaccaagugucugggcuuucuuuauucaagucaacugguuuuacagacccagagcaaaagaaagucaacagugaauuaaaaugaacuggauuuaaacugacaagccacagccagagacagugauuaugggguucagaaaggaguacagagaauugaaagucggcccagaggcugcugcacguuucucacagaggguagagaguucugauguacacaggaaugcuuuaugaacugguaaaugcguacacagauaugcguguaaaaugcuggcucaaucucuacucagagcgauggugauugcaccacacuuggguguugggagaagcaaggagcuccuggggaauacugaagcaguugaggagaucgugacagugucaagggauaugaaaaaugccuugaguuuuccaaaccccuaggcacauucacucucacuggcauccucugagagcuuaaaaauaaucgcaggugcuuuuuauucaggcugagccaaauggucagcaacuuucucuucagagguaaacucugggacauuacugccucuugacccuaauucuaggggagaggagcacacaaaauuaaucuaauuucuccccuugugacggcccuucggaugcugaucuuaagugcuaacuaaagcuguuauuuauugagccuaaacaaaacugcgaauaaagauaauaauacuaaauaacaauaauaaguaacauuuauugaguguuuccucuguauuaggcacucucuauguacuuucuaagguacagagcaagguaugugagaaucugggcugggauaagcaacaagcauaauggaaagcuggaagcacugguuuuugucacaaagaccuggguuugaaaucugguuccacacauuuucuuugucucuuugagaaucagugagcuaccaggguccuaguaugccugcaauguuuaacauaaaguguguagaaugauuaagcuaaugucaggcacauagcagcugccugaugauagcagucacguguucauguugcuucccucgugucaccaccaccaauaauaucaacaucggcauaauauuaauagcaaacacuggcacagugcuuaccacgugccagaaaaugguuuccguuuacuaauucauugaauccucaaaacaaaccuacguauguacuauuuucauccccaucucacagaugagaaaacugaggcacagagauuauaaauuguccaaggucacgcagcuguaaccguaauaaaaggaaagacgaccuuuaacugagcgcuuacuauaauccacaucuuuaaugagcucguuaccuacguuaacucuucacaauaacuccuuaaagggugugcauuauaucuccacucuacagauggggagacuguggcucagaauugcccaugggcgcaaagauuccaucagggccgagccugcacucacucagccucccagaugcgacgaagcacgacuccgcugucagacucgaacuccgccucggggccccggggcgccgccucucucccccggggcgccgccucucucccccggggcgccgccucccuccgccgcggccgucgagccgcggagcgccucuuccgcggagccgccgccugccaggauuccagc

SEQ ID NO: 14424 - RNA, 3796 nt, Homo sapiens
ccgucuuagcgaggggcuucgcugcccaggaaugcaggaggggccucggggaggcggaggcgguggcggcggccgcccagggagcugacguccgcccccauuuuuuucucccccaagucccaacucgcucacggucccucggggcugauggcaacuucacgugccugccagccuacccaccccugugcccucacagcaagcgcaccaggaaaugcggcugcacgugugugcaugugugugcacucugugugugugugcguguaugucggcgaucuggcagccccgggaagguuagcacugcugggaaacggcuucugccucuaagguuacaggcagcgucuugggaccucuggucggcugucagucugucucccucucguggucuguuucucuguugauuucucagccucgcucuccucccucucccugugucucaacuuccacuugcuugucucuaagcgucucuccucucucucuccuuuucagcugucucucccucccucucuggaaggcaacacugauccaggugagacagccucugaggucccccaggaaggacuggggagggcuguauuucaguacaggcggaguugccauggcaacccggggcacagcaucugcccuguccugggcagcaggcucagcacugggagcaaugggaaugauucaugguuuacacuaggucacgugagcucccuggguuuuaacccuuacagggcuggaguacuagggguuggggguacgacuagacccuaacacccacuguccucggccaggccccgcucaucugacccaugcagguuuucuguccucugccuggagaucccaaacaugucagggguuguuagaagggggugggcagcagcuggauccuggaggucaggcacaccuguuaaaggagguuucuccuucuagcagggauccauguccccccaaccccacuacuuuuacagacaaggaaaugcagauucagagacauagauucacuugcccaaggucacacagcaaggaugucaccaggcaugcaccagagcugcucccaccccagguuuucccaggucugacaugguaccuggcccagagucagggcucuguaaauauuuauuguucggacaccaaguacacaauugaaacccaggucgcucagaaugcauccuauguccuuuccaccaccaccucacuucaguuuugaacaaauauuuguuuucuagacacuggucaaagggccucacuugagaaaguuuaucacaaaggacucucuggcaauauggccaacagaucucuuucuuuucuauguauucccaguccuuacagcuauucauucucuuucucucccugucucucuucuucuuuuuuuggauacaggaucucacucuguugcccaggcuggacugcaguggcaugaucacagcucacugcagccuuggccucccaggcucaagcgauccucccaccucagccuccucgguagcuaggacuacagguaugugccaccaugcccagcuaauuuuuuuuuguguguaauuuuuguagagacaggguuucaccauguugucuaggcuggucucgaacuccuagacucaagcgauccaccugccucagccucccaaaguacugggauuacaagcaugagccaccacauccagccucauucauucuuucauucauucauuuaauaaagauucagagggugccuacucugagccaggcacugcauagagauuaagagcagagggcucacagcccagcaggggaugacagugguggcuaauauuuaucaagagguaacuaaauguccaacaccauuucuaagcauucacaggaaucaacuaaugaauuuuuuugcaugaacccauuugacagaggagacugagauccacagaggugaaaucauguaccaagguuauggcugauagauguccuccaagaugaccaucaguaauccuugcccccuuuuauucauaaccuggugugguccccucccacaacgaaucaagguugguccgugugguuagcagaauaaagaagugaugggccgggcgcgguggcucacgucugaguaaagaagaagugaugggccaggugcggcggcucaugucuguaaucccagcacuuugggaggccgaggcggguggaucacaaggucaagaguucaagaccagccuggccaacauggugaaaccccgucucuacuaaaacuacaaaaauuagccgggcacaguggcaggcaccuguaauaccagcuacuugggaggcugaggcaggagaaucgcuugaacccgagaggcagagguugcagugagcugagaucacaccacugcgcuccagccugggugacagagugagacuccgucuaaaaaaaaaaaaaagaagugauaguguaggacuucuaaagcuuggucauaaaaggcaucaugguuucuaccuucuucucugaggucauacuggggaaagccagccgccauguugugaggaugcucaagcagucacacacagaaacccacauggagagaaucugaggcccccagcaaacagcuagcaccaguugcuggccaugugagugagccacuauggaagcagaugcuccaucucuagucaaacccuuagcugaccguagaccuggccaguaucuugaguacaacgucauaagaaauuccaagucacagucacucagccacacugcucccaaauuccuggcccauagacaucacagagauacaagugcccagaggcaaguagguaacugguccaugagaaaacugaagauugaaggcaaagaugggguggggggcucuugcagcagccuauauaccuuacauugauauauccagaaguauuacuccaccaugcaggugaggaaacauacacaggaaacauacacagggcuaggucgcacuuccaugagugccuggcuccacccuccaccacaugcagccuccuaggucccaggacuucuggcauccaaagugggccuccaaaguuuguccauuuuccccacacagauugcccauagugagcuccuacaccaugaaguccucuucauggucugcucccucauuacgcaggcccaggacguccagaguggaaacaggaacagaccugagaaagagcugaguccuccccgcuggccccagaaaagucacaccagaaauaccuagaaagcuggaauggcacacagcuuuuuaacagaccaucuggacaucggggugggaaauccacugggguccucaggaggaaaaauguuaaaucaaaauagaaaguaaaacaccuuuaaaaugaucauacccaguguugucaagguuguggugaaacaagacacauauguccacagcagauggacaugaaaacugauauauauuuccuggaagaaauuuaacacccuaaaucaaaagucuuaaaaaauaauggcuugccaguuaaugacauacauauugaaauguacagcugaaauguacugauaucuauaauuuuuuuuugagacaaagucuugcucugucaccuaggcuggagugcaauggcgugauaucagcucacugcaaccucuucccacuggguucaagcgauucuccugcuucagccucccgaguaucugggauuacaggugugcaccaccacgccuggcuaauuuuuguauuuuuaguagagacgggguuucaccauguugcccaggcuggucuugaacuccugaccagugauccgcccaccucggccucccaaagugcugggauuacaggcaugagccaccaugcccggccaauaauuuauuuugaaaugcacacacacacaaaaaauggag

SEQ ID NO: 14425 - RNA, 6192 nt, Homo sapiens
ccagaaaauccagaacugaugauaaauagaaaugugaaaaacuacuucaguuacuugacuguuuguuaguaaaaaaaaaucaguaauucauccuugcccaccuagguaggcgguuuauccaacuucugggucucuugcccauggaaaucaccaucuuggaucuguugcucucccagaacaguauuaugaauagggcuaaaggucagaauacccccacugcccuuaugacagaugggaacaucucccaaauaagacagucucaagcauucauguaauaaaauaacuuuauuagaaucaggaauuuguuaaaauaauauccuucacauauagcuaaagugcaaauucucuugcucuguaguagaagcaagcacaucugucagaccuccguggugugcuuauaaaaccaagacgagaagaguuuuaagaaguaccucuggcagcauaagaguacgaaaacacauuuuauaaagguuugaacaauuaucauuuggagccauuucauauaucguguaugucuuuucacuuauuuuucuuaaccuuucaaaaacuacucugugcuauuuauacaacugaagaacuguauaaacuacuuuagagcaguggccucauuacugucaggaacggaauuaccaaaucaaagagacaacacugcguauucgccaucacucacacacugacaaagugcaguaguguuagacaucaugggcucugucacugggaaagggacccagugacuuccaccucucugacucuaaauagcagcagucauauuggcaccuguaccauaugauucaaagagaagauucuacuuccauuggaugacagcuuggaaacccggccauauuacauagagcacuacaucauuucacaaguugcgagaaaaauaaggccacuccgaggcaaucucuucugccucccagggggaugggacacgggacagugcaaagaccguggaagauggcaguaaguagaugaaacuccaggaccaaagggaugcagccuggccauggcugaagguuuuugcuccauucaguagaaacuggugcucuaauucauuaucaaaaaugcuuacuugguguccacauggcacuuguuuucucagguuaacaucugccuacagaaaacucaggcagaggggugagggcagaugccuacuagcauaacaccugguuugcagcacgauacagguggaaugacaagcccagagaauuucagacgaaaacaucuggccugaguugcuacaaaugaagugugagagaaacgcggauacacaaagaaaaccaaacugcccgcccaccauguuucccccuccaacauacagcucuuuauggcuacccccuauucuuaauuagaaaaauagucucaauaugaaaaaaaaaaaaaaaaaaacagcugcuggcacuaaaguuugcaaacuauggcucaaaaagucuuccugcagguaaguaaggaaugucggcauucauuuucucuucuaugaaguuugcuuggaaguuagucaccacuaaucuaaaccuugagaaagugagcuuucaaccauuucucucagcugcgacuugggucugacuucccaguugcagucacagaaccucucagccuguuucagagaagcacuuggaggaguuaugucaguggcucugggccccgucccacaccucuuggccgcuccuccaccuuagugcaaauucugcuccagaaccuuuguucuggucacaugguggcacuguugccccuaaagcacggccaccagcaagacacagcagacaccauacaauacugacuagcuugcuccaaagaagaaaauaaauagcuugguugaauuauaaguuauuuuagagacaaggcuucauaacuuaguuuuuuuuuuuuuuuaaaacuaaaacauuuggagguaaagaauguuucuccuuuugcuuuaggaagugacuagguuucuagaaaugcuguuucuuuuuuuuuuuccuaccucaggacagccuuugucacugaggauuucuaggguuagggcuucacaggaagcgucuccuugaacccagagugguuggguugggcuucuggcagugccaccgaguacucaguuguggcaaaaagcaggguguccaggguggucucaguacacuuggcgaugaagcgaaugaaaggccucacgucgcccucguuggcagcuuccaacacgugguaguagucggaccgcugcuccuugcggauggugaugggcggguagcccgccugcaugaggaugagguucaugagcagacgggagguccucccguugccaucaaugaaaggguggauguaaacgaguuuauaaugggcuaaggcugcaaacuccacugggugcagguucauggcuuccucggaguugagccacuguacaaacuccugcaucugcuuuuccacauccugcggauggggagggaugugguguccgaccaggaccuguguuguccgaaaccugccggcuuccacgggguccacguagcccagcacccgccuguggaucuccagcacgucgcugauggugacggagccgaugcgcgaaaccagagucguguugauguacuucauggcugcaugcaugccuaugaccucguucugcuccuccaggcucuucccgggcacggcguagcgggucuccaggaugugccugauuuccgagagggugaggguguugcccucgauggccacugugugguagaugugaugguaguaggucuccuccaugacccugcgcagagcugaguuccccuuggggauggacaugaccuucuucacuuugcugucgaugaugcugaaauaccucuggucgaucucuuccacaagaggcaguguccgaucgcgguugaccagugcuuucucaugguagggugagauggucaaugcucugguguacaaguaguccgccuggaugauguccuugucuucuuccgagaagaugccaaacucggugagcgcguccacgaaguccggguccaucuugagggcgugcaugaagagcuuuugggcuuuuucccgcuugcccuggcgcuucaucuccagggccugguucagggcagcucuggcuuccaacuuacccgcuggaagagagccaaagaagcgcugugagggagggaggcuagggggcagaggacauucggggggcuguccccugugcuggucuccgcaggaaaccaugaugaccagccugugucccuggccuugaggagcuuguugcagccgcaucguguguacucaacaugcccgguaccacucuguugccccagccguguggugguaugcagucacuauccguguguccccagagccacucucuuguauucugggaggcaccuccuuggcuuccuagccuccugcuuucuggacauagaaaguucuaggcauuuacuucgccugggcccucucugcugggccuuuccugugggccacagcucccaguguaggccgucuccuacaucuccagcucaucuugugcuggugacacagguuccugccccgggaggcccaaaggcguuaacaacuccccacucuuccuagacccugggggcgucaaccaucccgggacuguucuuuaacucuuuuaacccagugguuugauugugcgccccaggggacauuuggugacgucuggagaccugguuaguugucauaacugaggagguggagggagugcuacaggcaucucauggggagaggccagggaugccaccaccaucuaacaaugcacuuucaguccccaccacagagaacugguggagguggggagccugcucuagcccuagcccuccuguccuggccccucuuggccaccugaggaucagccccacacauucaacuuccuuuaguuccucgaaugcccccaggcucucuuacgacaguuaugucaguuaugacaacuaaccucuggucucugccuggaguccuuuuccuuggaugcccuucacccuggaugacuccuacuuaacaacugggucccagcucaggugucacuuccuccagggagccuuccugguaugcuccuacagcccuuuaugcuuccccaucaccacacuugugacacugucucagucacaucaccuugucuauacuaggagcucagggcugacuuguucacaauaccccgaugccccacauacaggacaugacacauucuaugucugucuauccaguuaacaagcauugaggaagacggccagucugucuuaccuggagaggccuuggucuuggccaccagcagcgucgcgccccuggaggugaugcugagcuccguggacgggcuggugcacuugguggcggcaugcugcgcccuguccgguuugcuccugagcagguagaggccuuugagcacagccaagcacugcuccuccacagcccccagcggcagcagcagggccagcagggaccccagcaccaugcucagcagcgucacccagaggaagcggcuccagaccgagacccauuucgguucagucaccgccaucacugaagccauugguaugagcaucaucuggacucaggagagggcccuuugcgcauguccacaggcggcugagagagagcaggaucugcaaggagccaagagucgcaggagaaacagacacguucaggacauagugugacuucagcugggaagauggguuuggagacuucugcucuuuuagcucacuagagagauggggugggggcaagucaaggacuggaucucacuagaggaggggccagccuagaaggacuggugccaccuccugggcaguaugaaugugaaaacacugcugugguccaacaauuaaugagcacuugccauaauccaggccgugugcuaagcaccaaaugccucacaugggucaccuccugcaaucuucaacgacuugagcugauguuuucacccuucuccaggugagggaacugagguucagagaggugaagucccuugccgaaagucucgccgggagcaagugacagccuuaggacuugaacucaggaaccccacggcucuaaaguguccccccuucccauauaucccuguggcuucugaccacaaacacuggauuuguggacauaugucaaacauuugggacauaaaugacugacagacacccaggcagaucagccacagcaguucugacgcccaaucuuugauaagcacaauuguuggguggccucauuuauugcccucacccugauauucagccacagcucccacagugcccuuccccucucuggccuuccauuucuggccuguccagaagggaccccaucaagaagaugagcaguucgagcaucucgaaaggaacucaggcugugggccacagugcuuggccucagugacaacauggcuuguaugugcuuggggcuggcagugggaguggagguggggccaggcaugcaaacacuaugcuaacaauaagcacuuauuaagcaacuaugguguccuaggugcugagcaguguacuggccacgcauugccucguuucacccucaugccacccuaugaaggaagagcuaccgcuagcuccauuuuacagacaagggaaaccaagacacagagagcauaaguuaaauuccagaaggcccacaggagguaaacagaggcauccggaaggaaaccccagggccucugaacccgguccccaggucucgauuucuaccuuauuacuaagcagggccugugcaccugcucugggcugguccugacccgggaaugacugauggaucacgggguucugagucucauggggauccuggcccauugccacagaacaugugaaauggcuuggggugcgcuuuaauaggggugcgccuggagugcugcgcggguccaggggucugggcgggcuucccgaggggacaggcuccugggcggggcgguacaggaaagggggcaguucgccggugccaggggugugugcagggaaggagugcguucugggaggcgcgaaucucucccccacacuucccuagaaagggagaacugaggcccggagaggggaggggaccggucugaguccccuccaagacugcagagccucccuucccgaaccccgcccagggcucgcggccccgucgcacccuucccggcuucauccucucgagccccuagggcuuuuccccuucucaccgcgcgcagcugucagaaccccaaccgccuuccccgcgcucccagcuccgggccgccggcucccggguccuccuucu

SEQ ID NO: 14426 - RNA, 399 nt, Homo sapiens
cuuuuuuuuuuuuuuuuaacuugaaacacaaacgcuuuauuuaaaggagcaucucaauuccguguggcggaccaaaaaaaaggagcagacugugacagaccauucccaucggccaaguggucgaaccccacauccaagacccagcgagcagccaagcucagcgcaaccuccgggcuucucgcucugacuccaaaagggugagcacgucgcccucgcgcacggggccuuuuacauugcggaugauggaucggcucgugucguccaugaauuccacgcgcaccugcgugcacugucccugagagccgguccugcccaggaccuuggugacccuggccagcuugauaggcugcacacggcugguguccaagauggcggcgcggcggcgaucuggcggagagc

SEQ ID NO: 14427 - RNA, 23501 nt, Homo sapiens
guacaacgccuccuccccuugaggcacgggcgcucuggguugugggaguuggggagcugcuccggcuucggcgcggaggggcggcggccggggaggcggcggcggcggcaggugagaggccggggucgggcggccgggcggcgcgagguccuagacccaggacgacgcugagccaggcguccagcuucuguggcucaguuuacccagcucugagagucuugccccgagggaucggcgaccucaaucugacagucgugauuuugagcuugacaagcaaggggauuccccgcucugagccucaguuuuucuaagaaauggggaucacgauaguacuuagcucauaguacaccugaaucuuagcguaagguaaucuacguaaagccuuaagcggaggauaauuuugcguuauguauaaaaguguaaauugcacacaccuauagacccugcaagcuccuuucuaggacucuguccugcagaaauacucauuuaagugugcaaaacgaggcguacuggguguuuucugcagccuuguuuauaauugugacacauuggaaacagccuaaauguccagcaaagaguucuuucugcuccaugauuucauguaauuucuaccuuuaauaguaguaguuguaaaagcugaaacgaagaacagagccaguaauaaguagcucucaguaauugaaugauuaguaggugccagacaccgccaaguguuucccuugcguuaauuuaaccuuccuaacauccaccgagguagguacgguuauuuucucuccauauaacguguggggaaaccgagguucuuagccauuuaagugaguuaacuaagaugacaucacuggggaguggaagagcuggcauuugaacccagaucuguuggauguguccaguugacuccugcauugccuuucugguacguagcaagugcuggacgguaacuaccuuuuuuguuauuaugaugggcuugaacuagguguucuaagaucucuuccugcugguucugacaucuagagaucuuugcucuucucauuggcuuucccuuuuaggauucccaggagccauguugucagaaguccuacuggugucugcuccggggaaagucauccuucauggagaacaugccgugguacauggcaagguacaaagccguuagagccuuuaaggauuggguaccccuucucccugaugcuaauuuuguaagaagguaaaaggacacccugaggcacagcuugggagcagaucagagagaucagguucuccccagccaggcaaggaaaagauuucuuaugcccacugaagggauucuugggccucgcucgguaugauagcaaaaagaugauuauaauauaaagcccugugaguggaaugagaucaccuaggagugagcuuugaugcagaaggaaagagguuugagaacugagcuccggggcacuaagacauuuagaaguuggaaggaugaucuagcaaaggaguugaaaacauccauuaucucauuuuacccuuacagcuacccccaaggcauacccuuuuauuauccuauuuuacaaaugugcaaacugaggcuuaggagagaagugguaacuugauccaaguccuauauaccuugguagagcuuggugugaaccuaagucugucugaaaccaccucugcugcacucugcuuuuuuuuuuuuuuccugagacagucuugcucugucaccggagugcaaucuugcgaucauggcucacugcagccuccaaccucagccucccaaguagcugggaccacagguguguaccaccaugccccacuaauuuuuuucuuuuauuuuucuguagagacguggucugacacuacgcuggucucaaacuccugggcucaagugauccucuugccuuggccucccaaagugcugggauuacagauaugagccaccacaccuggcuucucacugcuauucuuuauguucuuauauuucucauugaaaacauggugauuauggggaagugauuccuugguauugagaaccucugaaauuuugcaggcagaaggcaaaguggauuuuaacuuuuagcugaucgaugguggcuguucccaggcuuagugggagagcaugccaagguugauuagcagugucuggcaagggcauggcuaggaguggccucugugcuuauguuugcucucuucuuagcacguggguccuggccccuuugccacucacccucaggcuuauugcuuuugucauuuauucuauagguagcacuggcuguauccuugaacuugagaacauuccuccggcuucaaccccacagcaaugggaaaguggaccucagcuuacccaacauugguaucaagcgggccugggauguggccaggcuucagucacuggacacaagcuuucugggugagugcaaggaggagaaaccaggugugcuaagagccuacagagagggcagcuggccagguauucugggcuguccccaagggagccaggggccagcuauuucccggguguuuucuacccugaccucauaaaauuagcuucacucauuuuauuuuuuuaaaauuuauagguguaaaacaaugcauuggaucucugugggcuguuguggacagaucaucaaggccuauuguugagugaaaaaaaugcaaaacagcaaacauacguauuuaaguauaaauauguguauaaaugauagaaaaggucucgggggcauagacaucagauuggcaguggugauuaguucuccugggagagaccuagggccagagaguagacaaagugacacauguuuuaaauaaggagaauauauuggcauuuuguauaauuaaaaauugauaaaaguaggccaggcacaguggcucaugccuguaauuccagcacuuugggaggccaaggcgggcggaucaucugaggucaggaguucgagaccagccuggccaacaugucgaaaccaugucucuacuaaaaauacaaaaauuagcugggugugguggcacacaccuguaaucucagcuacucaggaggcugagguaggagaaucgcuugaaccugggaggcagagguugcagugagccaagauugcgccauugcacuccagccugggggacagggcaagacuccaucucaaaaaaaaaaaaaaaaauuuaauaaaaguacaaguuaccuaugcuuauuauuggaaaauauagucaauacugggacauuguaauuuuaaaaaucaccuauuauuucccuucuccuuucccugaccccaguaaugacucuaagcauuuaggcauuaauccuucugggugauuuucuguagauugauagaaagauugauagagacagggagauaucuugguuuuuuaaccaaaauugggucaggccauauaaaccauucagaaguacugauuuuuucuuugugugucacgugugugugcugauuuuugacagcacugugaagauuucauccacucauaagcaggccagcuuuuuccaucaguggaguccccuguaccugccccagagcugacguguguuuucucuguugucaguuuacugucugcucccugggcugaaugaagccuugcucuuuggaacaguguuucucagccaggaugggguaaaugagaaucuuuuuggguuuuuuccuuacacugcaccugaacccuugacaccugcuucccauuccccaugagaaaccacagucacucccauaugccguauggggauggaggaagaguugaaaauucucauuucacuuguugagauggggucucacuguguugcccaggcuggucuggaacuccugggcucaagcaguuuuccacuuucccaccuugggcucccaaagugcugggguuacaggugagagccacugugcccagccaaaauccucauuuuagagcagcccuuuuuaacuucaucauaucuuggaaucacccaggaguuuuuugugauggugguggugguuuuuuuuaaccaauacagauggaugggcuccuggcuccgccccucucuuauugggaguugguaguggugguaggaguuuuugaaagggguuccuugggugauucuggggacaccucaguuaaaagccacuccuuuggagcgugcaucugaaaacaaccagccagagcacauggaacuugcuuuccaaggugcacagggccacccagccagaccagaaaugucuccugagaaccagcugcaacuuguguaugucaguagcuugggguggaagcagccagguaugggggaacaugucucagaccacuccaacucccucagugaaccuggggcaggucacuucauccucugggccucggagcagagacauguuuccugacugagggcugccaugaggauccgacgacacuggaggcaggcauuaggggugcgacacagagugcauuauguagggaagggcuuguuaguuuuggagcucugggagacauacuaucuucuagguugcaaagaucuaccaucuuucuuucaguguccuuuugcucccuccugauaguaauaaacauugaacuuuuuuuuuuuuuuuaagaggcagggucuuacuauguugcccaggcuggucccaaauuccugggcucaaguguucuucugccuuagccucccgaguagcugggaauauaagcacauaccacugcaccgugcuacuacagugaacacuuauugggcacuuacgugugccaggcacuaaguguguucacauauguuagcacucuuagaauucgccagcauucccuggaaguagguggugguauucauccccauuguacagaucugaaaauuaaaguucagaggucaaguggcucagguuacacuuguuggugacacugaaaggauucagacccagguuucuccuagccccaaaguccaggcucuuaacagcuguuccaucucgauuacaaagcucugaaauaccuggguucucaaugaugccaugacuuggccauuugaguauaucauuaauccauucaacacacauuuacccaguacuuaaccagugcccgaaguuuccuaacacacgcaugcccaauuccauuucccagucccuugagaaugugaccugaggcucagcgagugauuuguaaaggugagcuggccagaaaggcucugccuucucagugucucagaggaaaguggcccagguuccuguacaucccugggaacaaccugccucaccuuccccuucugcccaggcaccgccucgcauuuacacuguccuauuccugaugauuaucuuuuggaggagggaaauauuuuggggguuaacuuaacacucuuuugauuuugguuuuauacaauggaaggugaaaccuaggcccuugugcgauugagccagcauucucugugugugucugugugucuguguguguuuguuuuaagacuacaauuuuuuuuuuuuuuuuuuuugagacagggucucacucuguuaugcagccuggaguacaguggugcgaccacagcucacuguuucuucaaccuccugggcucaagcgauccuccugccucagccuucugaguagcugggaccacaggugugcgccaccaugccuggcuaguuuuuguacuuucuguagaguugggguuucgccauguuaccuaggcuggucucaaacuccuaggcacaagugaucugcccaccuuggccucccaaaguacugggguuacaggcauaagcgccugcacccaaccuuaaaacuacuguuaauuagcacuuacuacaugccaggugcugugcuaaaaaguuuacaccccuuauuuaacuuuacguuccugacaaccguaagaagaggcacuguuguuaucccuguuuuaccaaggugggaaacagguucagggagguuaagucacacggccaguaaauggcacaguugggacucaaacccaagucugccuaaagccaaugaacagacuugggugugggguucagaccauaaauucguguccauccauguuccaauuccagugacuagucgauuuucuguguucuguuguuuauaaagcaccaaagucccucucacccacuuguguuugcuuguuugccuguggaacagagcaaggugaugucacaacacccaccucagagcaaguggagaagcuaaaggagguugcaggcuugccugacgacugugcugucaccgagcgccuggcugugcuggccuuucuuuacuuauaccuguccaucugccggaagcagaggugugugcguggucuggggaaggaguccagauucagccucccauggagaaaaaggaagaguuucugucauugcugcuggagaaugcacaugcucucuucuagagcagcagccauuggcuguccucaucaugugccaggcacccugccaggcacgguauauauggcgugccuuuuuuuugagacagggucucuguugcucaggcuggaacgcagugguaugaucucagcugacuccagccucgaccucccaggcucaagugauccuuccaccucagccuuccaaguagcugggacuacaggugcgcaccaccaugccuggcuaaauuuuuaaauuuuuguagagauggagucucacuguguugcccaggcuggucucaaacuccugggcucaugugauccaacugccuuggccucugaaagugcugggauuagaggcaugagcgacugcacccggccccagccucucuguuguuguuuuuguuguuuuuguuuuuguccagaacccaaagggaaaaaaaccucaagggggcagcccuucccuugagcagcagaugcuggcucaguggccaggcucuaugcugaggacacauucggaaacggccugauacuugccguccgaagcagaauuucaacuugagagaggcauguccccuuaagugggugaggggcauuccagaaucuuccaggcugggugggguggguacguggaauuugaagacgcacauuauuacaauuuuucuauuugggaaaugggaaaagcacuucguggaaauuaccaaacaugaaguuugacaguucuugcuugggggaaauacauguaagauguagcgauucggaccuuucuggugaucaaaagcagacccguguuacacaugguuggggagcaccgucuggcgggagaggccccggugaacacacaauccuagugugcgguggugaggcagcgguggagggagggagggcaggcggggguccuagaaggggagccaggagggucuuugugggcagcuacggaaagugucacaguggaagcgacauuugauaaggccuugagagauggguagggauuucucugugggauaaggaggugcacggcuauugcaggcagaggggccagccugugcucagagcaggcccacagaaaagccuagcaugugggcacaggaaggaggugggagaaagggguugacagcuugccaggugcuucugggaagggcucugguugaaugacccagggauuuaaaugaacuugauaccuguuuucuaguugucugauucagcaugaguuccugauguucaauagggauacauuuggggucaggaauucucccccaguugagaaaacuggaccagaugcuuggagucaggccugggccuggccccugguucagugcuggcaccccacugcccugcgggagagucacguuucacacccugguguguuucagggcccugccgagccuggauaucguaguguggucggagcugccccccggggcgggcuugggcuccagcgccgccuacucggugugucuggcagcagcccuccugacugugugcgaggagaucccaaacccgcugaaggacggggauugcgucaacagguaaccaugguccuuaccuggccagugucccucccgcacggcaggacagggacguggcuucucucacugagaccucaccaccucccugugaggugagaggugucauaguggccauuuuaacaugaggaagcugagccccgagaggucaaauggcuggcccagggccacacagcuagugcuggcagagugggauuugaacucagagucugagcuuuucucuccugcucuccaccaccucugcucacccccaucuuggcucuguugguuucaagcgcccaugguaugguagaaagagcuggaguccagaucuagagggcagcagguuagaugaacccucccaccucugcauugacucaggcuaggacaguguucuccucuguaugguaaugacagugcccuaggggugauuguccaguuuuaccacaugguuaugaaagaaacuaagaguuugcugagaaauccacauuagggggugugcccauuagacuagggcaucucuccuccuacggggccgucuccacggagggcgugucaccucucugcguuccuauugaccacgugagucagugaggccuguccagacaggcuugaccacagaccauuucuaucauuaggagaauguuccuugagaaaccacccagugcgcagagguuacgcaguuugucccaggaccaggaguuguggaugaggcccccaaaugcagagcucuguccucuuccugggcuuguuuuuguuuuguuuuguuuuguuuucugagcuugguuuuuuuguuuguuuguuuguuuguuuguuuguuuguuuuuugagauggagucucgcucugucacccaggcuggagugcaguggugugaucuuggcucacugcaaccucugccuccagguucaagugauuuuccacgggccaaaggacuggcccugucuuucaaaagguggagggugacugugugugugcacuugcauguguguguguucuuaugcugcuucuaaccauuucucccaccuuccccugaaggccagucauuccuucucagaacccuuagggagaguagaccucccaccccaccccaccccaccacaccccacccaucauguguuucugagucggaaaggacuggagcccagucuccuuugaagacucaaaucugagcccccuaaaaaacaaacuguguagagcaggaggaagacucacauuuguugagagggccaggcccugggcuaggucagcugccugaguuaccuucccccgccuccaucacucacuucaucccaggcacgcugccaccuguuggucccugggaagggccagccagcucuggugugguuccagugcugcacaaguggugugucuggaaugcaccccacacacacaccuugcccagcuggcuccccuuguccuucaggcaccaccaccccgccccagcccccagcaauucagcccaucguacucuuacagaaacaccugguuuguuuuuguuuuuguuuuuuuaacuauauuaucauuuauuaaauguaauuagguagcucuggauccuuggucuguuuuuuuuuucuuuuauuauuauuauacuuuaaguuuuaggguacaugugcacaaugugcagguuaguuacauauguauacaugugccaugcuggugugcugcacccauuagcucaucauuuagcauuagguauaucuccuaaugcuaucccuccccucuccccccaucccaccacaguccccagagugugauguuccccuuccuguguccauguguucucauuguucaauucccaccuaugagugagaauaugcgguguuugguuuuuuguucuugcgauaguuuacugagaaugaugauuuccaauuucauccaugucccuacaaaggacaugaacucaucauuuuuuauggcugcauaguguuccaugguguauaugugccacauuuucuuaauccagucuaucauuguuggacauuuggguggguuccaagucuuugcuauugugaauagugcugcaauaaacacacgugugcaugugucuuuauagcagcaugauuuauaguccuuuggguauauacccaguaaugggauggcugggucaaaugguauuucuaguucuacaucccugaggaaucgccacacugacuuccacaaugguugaacuaguuuacagucccaccaacaguguaaaaguguuccuauuucuccacauccucuccagcaccuguugagaaacaccugcuuugaagucacauauugcagugucauggauuuguuuguauuugaauacugaucgcuuucugaccuucacuuucuccauuagacucuaagcuccaagaagucagggaccuugucuguuuugcucccuacuaggagcuuagucacaggcacauagcaguugcucaauaaaugcugaaugaauaagugaguguaucuuguuggcaccauuaaguuaguagcuaagagcuugggcuccaagucagcagaugugguccugacccagcagugaguagcacugugaucuccaggaugcuguuugacccauccaagccucaguuuccguuucuguaagaaacaggauaauuauuauaccuucccuguagggcacaauugggaggauuaugaaccauuucucaaugguccauuugagaaagcauuuagcacaauguuuggcacaugcuaaucaauaguauguuaacugauguuaacucauuauuaaucauagucucacagcuaccaugugaguugccaaguccguaaaaauccuuauuuggcagaugaagaaagagacucagagcagguaauugacuugcucagggcucacagcaaguaagugauugaaccaggcccccaggcgcugugaccccagacggccuauuuugaggggagcacauccuaucuccugggcauuacacaaagcacuuguguauuuuuuccaucucaauauccucagugagauagacacuauuaucccuguuuuauggaugagaaaacaggguuuaaggugaagcaguugcucacagaugcccagugagucagugauaggaugggcuccaaaaagggcucacuggcugggcacgguggcucacgccuguaaucccagcacuuugggaggcugagguaggcagaucgcuucaggucaggaguucgagaucagccuggccaacacagcaaaaacccaucucuacuaaaaauacaaacauuagccaggcgugguggcaggcgccuguaaucccagcuacucgggaggcugagguaggagaaucgcuugaacccaggaggcagagguugcagugagcugagaucgugccacagcacuccagccugggggacaagagcgaaacuccaucucaaaaaaacaaaacuaggcugacugcuuacuccauaacucugccacugagccacaucauucucagaggucagaaaaccaccuuuagcuucugcuguuucaugaggaagggaaucugcagaaaggaaacaaaagcugagagaaaagaguggggaagugggguugaucauuuugucuuguuccauacucauguguuuugggucuguucauuuaaacuguuugugagcccacaccugguccauggaaggcagugaggccacgugcuugggagagauccagacaugguugggacgagccuggccccuccaggggucucuggggcuccugggauuugaauucauaaugaucgugcuuuggaucuacuugcagggcccugggaaagagucacaccucugcccguucuucuuaaaggcaggcuugguucagguguggacgcuuaugcagaggucuguuauaguggcaguugccaccugcugcuuguggacaccuugccaucauuagacacacaugcagcuagccucugaggaggguggggguuccaauucuccagggaaggauaaugaggcucagagagguuagauaacaggcccagagucacucagcuaguaagaggcaaugcaggggccaggugcgguggcucaugccuguaaucccagcacuuugggaggccaaagcgggcguucgagaccagccuguccaauauggugaaaccccgucucuacuaaaaaauacaaaaauuagcugggcgugcuggugugcaccuguugucccagcugcucgggaggcugaggcaggagaauugcuugaacccgggagaaagugagcugagauugcaccacugcacuccagccugggugacagagugagacuccgucucaaaaaaaaagaaaaaaaaagaggcaaaguaggaccacgggaguccaaagcccaggcuguuuugacugcgccaggugggcuucagagggaagggcgcacacuuggcacgcuccguagcuggagagguucagaguggacuuguucuuucugagcucaagggcccaagcuccuaugccccuuggccugcccagcacagccccaggugaccccuccccagccccacuccucacugccacaguaaagaugaacaucugugucuucagguggaccaaggaggauuuggagcuaauuaacaagugggccuuccaaggggagagaaugauucacgggaaccccuccggaguggacaaugcugucagcaccugggguagguguggccucagguuuauuuuauuguuguuauuuuaaaaauucuuauuacaaugguaggugcccaagagucugugcugguuugggaggaaucgaaucaauggauucuggaaaaaauagcauuuuccuauuuuggggggaauggggagaaaucuuggggcccugucucacacccccugaaucagaaucuccggggguggaacuggggccugggaagcugcagcuuccacgagcuccccaagagaguuguagguucaggaugcagagccguugccguggaguuugcacaccauccagguggccuccccucuggcaagaacucuugcuuacagggcccagaugcuguguccugggccccaccuucaccauguggcuugucgggggaagcuggacagucuggagggagggggacccaggaauccaaggccuggcaagagcuuccugguggggcuucggggaccuuuugcccuccugcaccuuuuguaacugaagcugggcugacucauuacuuagccucuuuccugaauggggcaaaaugaacccaacccaaaguucaaccucucucccaaguagcacagauauguuagcuuuucccacagcucugacccacugguuuuucucuuuaggaggagcccuccgauaccaucaagggaagauuucauccuuaaagagguaaccuggggguggagcagcacauucagccauggcugcauugaugugugcagggggcagagcucugcaccuuugggaaguaccauaggaggcaggugucccuggcucuucaucccccaauguggcccucacagugcacuagcugcaaggaagcaggggugguggggaagaccugcucucuccuucuccccuucagcucuuaaauugcagagauaucagaaagggaaagucaugcauggcugugcccguagacucucagcugcucauucauucauuccuguauuugcuuaguaaacaagaauccauuacuuccuguguucccgaugaugcugcacuggggcguaggaauggagagaugaagcuuggguacaguuuccaaggacucucagucugcuuguggggguggggccagacacacacaaaagccgccacaggacaaugugagagucaccaugauggaggcacacagggcagaggcaggauggaagcgggagggaggcuugggaggggcuuggagcagaagugacauuuggagacucucagccuguuuuauguuucugugucccucccgcuggaaucauuggaaucacaaacgugcaugugcgauuucagcauucucuguucuguuugcgauuucagcauccucuguucuguuugcacccacggcagaauuguugggugccuggaaugaaacgcauggcagaggggagccaggugccuuuuugacuguucccuaagcccuugaucaaguuguggggugguguuugucccagggcacuuugccaccuccaugggccuuuucgcaucaguaaggguccuggggcucucuccucuuuacucagggcggucuucauggaugaguggcagguccuggccugcagcccccaccagcugggccacuccauuaguggcucaguaaccuggccugccacagcgccacaccugggcccccggcuaguucucugggaucuuucugucccagcucagucaugccucccuuuccaaggcuguacgucagaguugucagcauuggcacuauugagauuuggggcuggguuauucuuugugguggggcugcccugugcauuguagccauccccagccccuacccacuagaugccaguagcacccucagcguggcaaucaaaaacaucuccagacauugcuuagugucccuugggaggcagaaucacccuugccgccgaccuuugcacuccgcagaagccaguaggagcguggaacagcuuccucggguugcuccagcagucgucaggagagccucgggugccgaggugaagcuggucugccaccgccccggauccauguggaaccagagcuggaucaugugggggagucucaaaugcccgggccccggccugucuucaggagcccacggucugauggggaaggcggucacuggaaucgucagagagaagacaccugaaggguugugaagcugcugugggugacagugacaggcgucuuagaucuggcugcgagccuggggaaucauucauggaagugguggcauuucauuccuucagugucuccugagagccacuuguggccuaagcacuggacuaggcccuggagcuagaaaacugaugaagacgugggcugggcaccgaguguacggucuacugggggcaucaggagaugaaugaggagguuuccaaggggggcgggcaggggaacggccaggggaauggccaggcguugcuggugugcugggcggaggcgcuggguccacaggccuagguuugaguccagcucucccacuugccagcuggugcccucaggugagucacuucucccagaccuccagcuccuuguuuacuuagggggaucuugaacauacaaucagaagcgguggcucugaagugcuuaccuguuugcuggccgaguucauucauccuuuccacaaguaucauuaagcaccuacugcgugcugaguacuggggccuccgcagggaacaaaacaaagccccgccuccguggaacucauacuuuguugggagaggagaaaaaaucaguugucugugagagcauaucaggcagucuuaagcaccuuuaggaaacaaggcagggucagaggcuacaaagagaaggagggguccgauuggauggggguucgggggcugcuggugaaggaacauugagcagaaaccugaauaagucacgccgcuauggggcggggcuggucccuggcagaggaagcgcggugcaaagguccugagacgagcacgcugccugccgugugacacaguagcugggaggucagaguggcugaguggagugagcagccuggggagcgaggagagaagaagaggcuggggcaguggccaagcccggaucacaggagcgcuuaccaggcuuacccccugcgugguggccgcuggauggguaugagcccuggaucugguggggcuggugacaggccugucugcagaggacuugucuaagaaagaugaagaugcaacacccaaacuccucccgccuggcuagaugggagcauggagcaaaccaaccuuugcugccugcuguggggugccacgggagcagauggcggcuucacagagaagcugggggccagacuccacguuaaucccauggauggcuuaaggagcuuccccccaccaaccaugcguggugccucucuguaaagaaaaaaugcauuguuugugaaguggaucaagaugcggccucccagaacgcugcccuuuugaggaauggcuugucuuagaagggaagagaaaagccaaauagaauguucaucuuuuguaaaguuaaaaaaaaaaaaaagccagccuccaaggcugagaaucgauauuaauuucaugggcuuaugggcagugagauaaagcagguuucuggcagcccuuuccagcccuauuggauuuuacaaucuugaacugugaagacagcgaauaaagguaucaagggcucugcccgucuccagcugucucgggccagagcucauccaaaucccccaccuuccaucccagccugcagcccucugaaaggcagguuggauggcaagaaaugucagcuugagcccucgaagacggcucacuacaaggacaguugggauuguggcuuuaggagggauuuaugcagcuccucuggggcaggugaggaccacggggucaugcuagagagucagcucaacguggcugccugggacacgucuaugugccagagggcagccaaggggaugacugacucuacaucugguuuuagaccagggcugcucguccgggcaccauugagguagggcaagaaugggcucagcgugcuggggaccauccuccucugcaacccugcccucccugcauuuacgagcccgugcguggcacugcccgcaccagcuagccugggcaucuucccucugugugauccauuucagggccuguugcuuggucuuucuaaaacuccagcuucgugggggugacccacacaagugaaccuucgcccccuccuuguacucugcuauagccacuuugaauuucucacuggaugacugugccggguuccgccaccuccaggcucacacaggcugcuccaacugccagaaauccucacccuucuagcuuugcuugguggcuucuuacccuuccucaguucucaguguccacgucaugccagaaaaaccuucucggcccuucuccccuauccccucucuggccccggccccaaggccacgcugugccuagcauguuguaggucccaguugaaguugaaugaauaaaugagugaaaagccaagggagaauggccacccaaccagugccugggauggaggcgcagcuguggccagcagcagaagccccaugcucccccaauccagugucaccucuugugccucccuucuuccuccguaucagggugggcggcuucccggacugcucccaguccugucccagcuccuccaucuugaguucaguguggaccugccuccucuucacccugcaggucgccagcucuccagauccugcugaccaacaccaaagucccucgcaauaccagggcccuuguggcuggcgucagaaacaggcugcucaaggugacucuuguucccuucuugggcagguuucaggaaggccaggacacaauuacaucuggauuuucgaggucucccucuggcugauggguuauagggggugugguggguggugggggcccuuagggaggugguuuuggcagaaaagaagguaccguccgugcccguagccuggccaggaaaaugacaguggucgggcucguuagacacacugacuuugcagcugggaaggcaaaaaaacaggcucagaagagaggugguuuccccagaggaugggcacgggcugugugaacaccuccucccuccaccccacugcuggggcagcuguccugcaucugccugcccccaggccucaccagccguuccuucuuuuuuucuccaguucccagagaucguggccccccuccugaccucaauagaugccaucucccuggagugugagcgcgugcugggagagaugggggaagccccagccccggagcaguaccucgugcuggaaguaagagccugucugcaggaaccgggguuacugaguccacaccacuguccaaggcaguggcucugcaaucuggcugugcucagaaucccccggaagcuagcacauagaggucaggaccugccucuggccuaugcucucagcugggcccaggucugugcgugccauauaagcguaucuuauuuucaggccucuuccugggugauuccgaguaauugggagagugcaagggaggccagggccuggcucgugcuaagugcaauggaaacagguuugggucacuucuaaggagcucuggcccacguagguagauggggauguggcugaugcagagugcucugucggugcaggggugacuucuuggucacucuccugcuauugcuaacuucaugggugcauucaacaacuacuugucaacugccugcuuugggucagacagauccuaacauuguuuuuucaucauugcaaccccauccacugccauuugcauaauucuaguguagagguugugaccugguacuuugggugugaucaggccugugugugaaucccagcuccacuucugcuggacguguggccucgcuagagugucuuaagaaugcucagauuagacgggcgcaguggcucaccuguaguauuagcacuuugggaggccaaggcagguggauugcuugaguccaggaguucgagaccaggcugggcaauguggugaaacucugucucuacaaaaaauacaaaaguuagccagacaugacgguacauaucgguagucccagcuacucgagaggcugaggcaggaggaucacuugagcccaggaggucaaguuuguagccugggcgacagaaugagaccuugucucacacacacacaaaaaaugcuuggagucucaugggugacacgcaagcacaaugucuggugugcuaugagcuuagggaaccaaagagcccaggcucccccuggacacaguccaccuggccuggugaauaugggcuguuagccaucuggcugcccuugcagaaugagaggaucggguggccccuagcugccguggcugugcagcagccgucagugaagggacaggagaggggcgugcggucuccaugucaccacagucccuccccgcgccccgcacucuguagucauugccuggugucucccggucccccgugggcauucgagucuguagccccugugcugaguggaagcugccacuaaagcaagccuuuuacaaaugauucuuuucacuugauccucacacccaccucccugugaaguaggugucuuaucccuauuuuacagauguaaaaacugaggccugaagagagacuucccccaagguuauccagcuagugaguggccgagccagggguccagccgacggacuggucugucccuuuauucaacagaucugucaugagcaccuacuaugugccagggcagcgccuccaucgaauuccuguguuucggcccucauucccucagucuuugucuuccuagcucucaauuccuuccacauagaaaggagggaacacaguccccccgaguaggaaaucaauaaugauagaauacugccuaaaauacacccugucgagucccuggagaaugccacagaacagcacguugauuauacauuguguguauuuuuggcuguggcagccgcugaaaugugcagcucagcuccuggacagcuuugcacucaaaccagcgaacuguucuccugugucacaaccugucaucugauccuugacagauuuuggaucagaaugugacaggugucuggaaccugccucggcaacgugacaccuggugcucaggcgcagagagcggcccccagaagucuucucucacauccagcccaucaggcuggugagaggcacccggggcugccaccaggccaucaugccugucugcucauuugucaaaaauggugagcuuggcgcagagcgagguaugaggcaggcuguuggggagggccacuccaacccugccugaccggccauccccaugcgggagagcuaggugggccuccgcagagaugccucagugauuggcaacuccugguauacaggcaauccaggugccccggaacagagcuucacacggaagugaggaaugccagggggugcucucagaggcaggguagacaggagcuucaugucaggcagacccgccuuccagugccagcuugguaccuacuagcucagugaucgugggcaagucacuucuucucugagccucuguuuccccuuuuguaaaguggggaugaugcuaacguacccauaaaaauacuaacagcacauaucucgugccaggcauugaacagaaaacucaccuuguuucgucucagggcaaagaagcagauuuuuuuuuuuuuuuuuuuuuugagacagagucaucuugcucugucgcccaggcuggagugcaguggcacaaucuuggcucauugcauccucccagguucaaaugauccucgugccgcagccuccugaguagcugggauuacaggcacacgccaacauacguggcugauuuuuguauauuuaguagagaugggguuucgccauguuggccaggcuggucucaaacuccugaccucaagugauccacccgccucgaccucccaaagugcugggauuaaagacgugagccaccacacccugcugaggcagauacucuuaugaccccgguuuacaagcaggagacagacccagugcagaagaccuugcucaaggacacacgaccaaaaaggggcagagcagagacucgaacacaggccuacuugacuccaaaucccaugguuuuuacuuccugauggcugggaccguggcugggcacccauccuuagagccccagcacguuguggguguuugguaaaugaaaucuaacuacugggugccugggcaguggaagcugugaaguuuuauuuuuucauccacaugcaucuuguuggauccuuaaagagcaggaaguuuauccugcauaacugaagaaaccuagacaaacagcuguuucccugcuuauggccuugcuggaguuacaccuaguucuuauucugaaaccaguccccaaggcagcuguagggaggcauguuauuugaaacuuuuucucuugcaaauggcagaaauccauuucaaccagacuuuuguagaaagggaauguauuggcucucaacugagaagaccagagguaaauggcuucagguauagcucaauccaggggcugaaacaaugugucgggaaucuguccaucugccacguaauaucugaucauguggcaagauaggucaucuuggcgacuugugucugaaguuaauuauuuuagcagcucuagugggaaggggcagaggaaacccugggagggcugugauuggcccagcuuggaccacaugcccaucccugaucagucaccagugccagaggcuucugugaccagcccuaggauaugugcucacugcuguggugaagguaugcucagcucuacccaagcuccgugagaaaugcugcagggcagaaggauucuuuuacaaguggagagggccagggugccagguaggcaaagccguuggcugucuccagccaacaacugucagauggacgaggcaggcucaggggugggcauaggaccuuggccucaggcaggccaagugggaacagauggaaccuucuccccuaggagcucauugacaugaaccagcaccaucugaaugcccucggcgugggccacgccucucuggaccagcucugccaggugaccagggcccgcggacuucacagcaagcugacuggcgcaggcggugguggcuguggcaucacacuccucaagccagguaucccggggguaggugggccaggcugccagccugggcuccuaagagggguccaccuggagaauucccuugaaaggaaaaagagaccuggaaacaggucucagcuccgcuguguggccuugggcaaguuaguuaaccucuggucuuugcuuccucauugguaaaauaaggaugagaguaucuagcuugcaagaucguugcccagauucaagcaggaaagugcaccuagagagccuggugcagggcugggcuguggcuggggcuccugucaucggggcuguccgcacaagcuugggaaguaaccagggcauugucacucuccacgucugccuaaccuugccccacuuguacccuugauguggucaggaugcgguugauuuugcuacaaaacgaaaggguuuccuucccguugguuuggggaaagaggaagaccgaguaaugggcuuggcuuaggaagcucccuggugccugggggccuggcaaggggcuucugcuaguguuuaaccaccugacaccuaccucugcccucaggcucgcuccuggccuacaguaggcacuaaccggucccaccugccuccauuucccucugugcuccuuguccccuccuuccuuccuucuuucucuuucugucuuuaucuccuccucucuguucuucauccuuccuuuccccucugcuuugcacugagcccccuuaggcuccagacauccccucacacuccaugauggcucccaggccucaggagguggccacauccucacuccagccaaccccaacuguugguuccuaguucagagcccaugacgauggugggacuugacauuucuggagugugcccgcugugccagguguugugccaggcacuuuaccugcguuauuuccuuuaagccucccugagaucugcacggggagucaucauuagccccauucccagaugaggagacugagacugagagaggggaagucacuugucugaggccacacggccaguacaaggcaaggccaaguccugugacuugagagcccauguuuuuaacucuugcucccuaaaccccugggggugcaaggcugggcauuccagugcacggaggggcugcagguaaccuugggcuuuauggccuguuggcucaggugggucacagccaggaaggcacagcaggaaggccugggcuuuugccuugaauaugaugagcuucucccacggagcggagaguugucaagggugaccugccuucccuccccgcagggcuggagcagccagaaguggaggccacgaagcaggcccugaccagcuguggcuuugacugcuuggaaaccagcaucggugcccccggcgucuccauccacucagccaccucccuggacagccgaguccagcaagcccuggauggccucugagaggagcccacgacacugcagccccacccagaugccccuuucuggauuauucugggggcugcaguucgacucugugcuggccagcgagcgcccagcuccugacacugcuggagaggccccagccgcuuggcgaugccagccaagcucugcagucccagcggugggaccuagggaggcauggucugcccucugcauccucuggagccagccgagcaggaggccuaggaggguccucugagacuccagaccugaggcgagaagggcugcuucccugaagcucccacagucccaucugcuucaggcccccgccuuggccuguguucuuccuggccgccuggguccaaugcucaggugcuggggccugguucccggagaagugugccuucucucucccuuuucagggaccgcccccugucucucagggccaggccucucccuccuccaggaagccuuccccuaccccuugucgccccucccucccagagcaccugcugucuggguggcucacucagcacuugguguggccuucccuucuaccuagcgggauggggcucccccaggggcugucccggaggcggugggccugguuaaauaaggcaggguuuauaugcacuuucuuccgaucuguaccugagagguuuguggaaaagauggcaaauggggaauaaaaagauuuugugucaaca

SEQ ID NO: 14428 - RNA, 544 nt, Homo sapiens
gcgaccaaacuaaagaaggagcaggagaaucuguugaagcagcggugggagcuagagaggcuggaggaagagcgaaagcagauggaagccuuccggcagaaggcagagcuggggugugugucagaagggccccccacucuucccaggcgggugggccucuugcuuuuucagacuugcauucguguugcugaaaccauaaaggagacagccuggucagcaguuaucuaacuucuauuuaauucuuucugagauacugaaggcagcccacauuugauucuccuucaggcguuucuugagacaucaguauaacgcucaacucagcagacgcacacagcagauccaagaggagcugguaagucugaagagacagccugacaucuuucuuagccucuuuuguaaaaaaggccuuccauugcuuaguauaugagugcauucucguaagaaugaagacagugagggguugggggaaaggggagauguuggucaaaggauacaucccucgguugggagaucugggaguaguguccaucauguugaucacagc

SEQ ID NO: 14429 - RNA, 15182 nt, Homo sapiens
aggugggaggcgguacccguggcugagaagaaggaggccugagagcgacauguccccggcggcucaggcggagcggcccguggcgcuguuuuucugaguccgggguggccuggcagccggccgaggacgagggucggcgggggcugcccccguggugguggccgccaugcugggagccugggcgguugagggaaccgcuguggcgcuccugcgacugcugcugcugcugcugccgccggcgauccggggacccgggcucggcguggccggcguggccggcgcggcgggggccgggcugcccgagagcgucauuugggcggucaacgcggguggagaggcgcauguggacgugcacgggauccacuuccgcaaggacccuuuggaaggccgggugggccgaggugagagucccccugccgagccgcgggauccagggccugcugugcugggcgcagccggccgggggcugcgggccccgagccccuuucgacccuggggccgcgucucuggagcgaaguuucucucugcagcuucuucgggggcccgcucugagcucagggccuggcacuggcuccaagguaccuagagucauacaggcagagaguuggccagaaguuaguuauauuuggauuucucauccugcauuuucucaaccccucacucccauccaagcugggagagaaaugacgaaggcggccuuuugcuaccuccaggccucgcggguuguaggucaugggugccccugcuucuccugucgagacaguucuugggagauucucgucgacccaggaaucggccgcuuuccuugccccuucugcaggagcggggcuugauucuuagccagaauaggaaggaaucuucgaagagaaugggccaggaaaguuugauuguagccuccucccccgcccucuuuucgagcgaagaauaugugugcuuaaaaguagaaucggcaggccgcccccagagggugguucuaucgaagccauccugcacgugaggcugguggcugugugugaacugggucaaccaguguaagaauccgaauggucuaucagagaaugcuuacaaccuccccuaggugauccugagaguucuaauuccagcuuagggggaaaaugauugugacuuaacuugcugggcaacagugguuuuuaacggagcugcucccuucccaaaguuagugugugucagaauugccagggcagcugguuaaaaaugcagauuccuaguccccacucgaaauugauuauaguagauugagcuuuuuugcugggauccagguuucugcaccaggggcuugugauguagguugccccgagaccaccguuuuggaagaucagcuuuauaaucuuuguuucuucuguuggagggauuggaaaacagguuucagaaggaaguucuuugcuaggagauugauacuguaugcuggguucagaggcuaccaaauuggcaguaugccaccuccagacaaccaggagacagacucacucuucacuuucucucauucuuuuucugcgaugcccagauuuggcucuugcuuuuacuaaaauaguuaguucuucccaagucgauugcaguguccuggaguuuguuauauuaaggaguuuauugccuuucacacaugugagggucuugggacacagggcuguuuugugaaguucuauguuugucuuggaguuuguugagcccuggcauguagaucacaguagccuggguucagcugacucagggcuccagucuuuagcagcgguaacagcagccaaagccagacuuuauagcaggaggucauuacuaucucuauccuggacccuuccucuuucuucacgagugugggcagggaggaaagagcccuugaggaaacuagacaguuuguggacuuugccucuugagauagcgguggugagggugcugagcggaugguuucuuucacuuagcagauaccaggccuuacauugguuacaucguccuauucagucuguugugcagagaauaaagccgaguaagaccacacagguuuaguucccagauacugcccuuauucagaaauucugguuuuaauuugcugaugcaggugguguguguguguguguguguguguguguguuucuuuggcuuggucagcagucagccaagaucuguguccuuggguuauuggcucaugguugcaguuccuuggaaggaguuuauuguagcagguaaaauuacaugagaccuaccaaagcuuguguguacuggaguccuauuucggacacuggcccuuggggcauuguauaaaugaagguucccugcuaagguuccccucuccauucuaccaaucuggguaagaauuggagcaguauuaaggcauggauggggagugggagguggcgcuugucagcugcaguuuggaccagcuuguugcaacauugcgcuuaccagguuccugagaaaggcauuuugcuggcuuuaggucgggcugagaugcgcauaagcuugcacucucaggaggcagcucucuacuaaggagucaguccuaccaagggaaguccagcuguucacacugccuuucuucugggccuguuuggauaagggugugccagguauuugaagacccuugccucgugcagcuauuuacacugauugcaguaggaacuguaugccuuauuucuuuucccgccugccugugauauuguuuccagcaugcugagaaaaguugauuuuauguugaaugaauucagguauuuguuaccaaguuaguccagauaaggguuuggccuucuuuugaacuugcuguuucuguguaguuucuuuguaguucaacauucuuguaauugugaguggcccagggcaccuagugguuuaugcuuucaaaagcaguucagaauauuuauugaauuucauuucugccuugaggauagcuagugcuuacagccugggaaaggcuuuuucagccugugugcuuccacagaugggagcaccacuacagaaagugguuuagaagcguucaccuugggguuuugguaugaggcacauuccaggguuuuuauuuauuuauugaaaauuuuuaauuuuuuuuuuauuguagacacaggggucucacuauguugcccaggcuggucuugaacuucuguccucaagugaucuucccaccuuggccucccaaacugcugggauuacaggcaugaaccaucacgccugaccauguuccagauuuguaacuuggucauuuugaguuccucuucacucugacuaggaaaagaccugguuauuugaccugagggcacagaauuuugcuugaguuuagggaaggcuauuuccucuucagagaaagauaccugcuaaagucgcagguccucgagaaacuugcuuuacgucucugagccuuguuuuccuuuucaaaaaaucucucaugcuuuagaaauuucugauaagacuguaaacucuccuguccagaguagcuugaagugucucugucacuuuuuuuuuccuugaugaccuuuuacauggaauuaaaaauagggcagaacauagcuccagaggggaaaaaaguugguuggggaccagagccuaucagguugcuaaugcuguaaccuuaaggaauacccuuuccugggcugccuuccuuucaccuggggaaggauuuggcuuuggggagguaagagcuugaaacaugggaugagagaggagucacugcuaccucugauuugcucaaagccauggcaguuguuuagaauucucuaccucuacugucaccuaacaggcaggcuucaucugcaggccuuccaaauaguggaaguucacagguagaaaauuuaggucccugaauccguggguucgcugucucagcccauucagaacaauucuuuagguacuggccucacuggagaaagaagugauccagaagaacagucuagugaccaggagaucugaggguagggugggagugacgcuagagcaccaaggggggcuuuacagcuguguucucauggaggacaggcuucugcucauucuggcuuucccacucuugugguucccaguugcaguuuuccaguuaguuuuauuacuuccuuuucuuuugauccauucccuaaacugccuugaguggaggcauuuguuuagugcuuaucgugugcauauccuugccuggcuagcauacccauguuucugugucucucuccgugugaggcauuguauugagcuauuuauacagauuguuuuauccuuaccacaaugcugugggauaggugguguccccauuuuauaggugagaaaacagaccuagagaaaacaacuuguucagugacacuucguguaugucuuuuccugaacccugugcugaauuuuccaaggagccuaguuacuacauugucuaaaacuaagaaagagcagacauaauguaggcccuucggcccccuuccuuuuugguuaacugaguuaugccaauuucagcaguaugcugacuguacacuucauuguauuuuagagaaaucuguuucgcugugaaugcauaaaggcuaaggagggaggaacaacccuuguuugcugcugcaucucuugggacuugggcaaauucaacuuugcacguggcagaucucuugggaaagccacuuggguuuuaaagggaaauauuuuaaagguaauuccaagguuguuaaguaauuuuuguucacaugguugaguuuucuucacugugggacugagacugccgcagauuacguuacugucaguuccucacuuuuuccacuuggcaagaaaaaaaaaaagauucggccuggugugguggcucacgccuauaauccuagcacuuugggaggccgaugcgggcagaucaccugagguuggaguuggagaccagcuuggcuaacauagugaaagcccguuucuacuaaaaauacaaaaaauuagccgggcguggugaugcgugccuguaaucccagcuacuugggaggcugaggcaggagaaucgcuugacccugggagguggagguugcagugagcugagauugcgccauugcacuccagcuugggcaacaagagcgaaacuccgucuccaaaaaacaaaaacaaaaacaaaaaaacaauuccccacccaugcacaaaauuuucuguguauccguaaaucaaauguagucgauguuccagauuuguaaugaucacaguccucauggaagaaggaaauucuuagagcucaguuggaagagaaacagcagucuuucagucuucauagguuuguaucccggggcaaugguuuuuugaggcuggaaaggagggggagcauguuagcaguacauccuuuguaugcauugcucagcuacucuuugauuucuugaggagaaauagaaagaaaaaagucugaagacaaaagugcaaugaguuuccucuuccauugucucaucagucccucugaucucguggcuaaugucacuuacaggaacuguuaacaguuauguuuauuuuuuugaggucuugaccucaaccacugggucuuuuuguuaaucuuuuaccuuuugccaugucuucucccuuguugaugauucagaagauaaagcucuggggaugacagccccuggccuucucccaaaggaucuaguugccagaugucuucagggucaccacgugagauuggaaggcagucuugaaaucuuaauuucaugcgggaggagagacuacaugacggcuacaucuguaguuggaacaguauauuuauggagcacuggaaagccuuacuguguuuauaggauaaaggagucaggcuacucucuggaggaagcagaacuauuuaccucugagacugaaaugugauaucuuauauuugcacaaaaaagauucggccuggcgcgguggcucacgccuguaauccuagcacuuugggaggccgaugcggguggaucaccugcggucaggaguuuaguguguugugcgagaggaagaaaaaaacauauauacaacugucuuacaccaagguugggagagggccagggccaagagagguuuucugcucuucugauacugacccgagguaaguaacuuuuuacuuuuauccucucucauuccuugucaguuugugaaaugugaaaggugauuccccuaggacuuggacaucuuaggcagauugccuugcccugcaggaugcuccagccuuguggacagaguggcauggcuucacugcuuugcaggcaccuccuucauugucauuuauucauucagcaaacuguaugaguggcgacuaugugccaggucccgugcuaggcacuggaggugcaguggugacuuuuuuuuucugcuguugguuuaucugagugaauguucaaguaaguaggugagguggaguuuugugagucugugggaaggaaggaaauuagcaucacaccuuucuuuuaugagccuguuuuuguuuacagcuuuggaacuuuuugaaugaaaauuauaaaaaaaacacacaacaacuaaagcuggaauuuuauucguaaggacaaugaagaaugacuuuccaaagcagauauccuguuuguuuuagacucugggcuuuucugaaugagagaaaacauucuuugaacuucaucuuguauggaguuccuggccaucccccuuguuuuaggagguuucucugaagcccucccucuuggggaaccaggcagcugcaacacagcacuuucuucugguaaugaguuagacuuguucuccguacagucagggggaaaaagucauuuuaaugugcuuuuagaaaguuccgcucugagguuuacaggggcuguuggccugauuaguguuuaguuucuuucauuuuacucuuccauaguaauggcuguaugauuccugccuuuguuggagcucuguuuggagccaggugcagaguggguggccccuuuuauggagaggguuauuagcauugcccuggaaaugccucuggcuguucuggggucuuugcuuuucuuuugugucuugccucugaugugcuuucucuuugucuuuuguccucagccucagacuauggcaugaaacugccaauccugcguuccaacccugaggaccagauccuguaucaaacugagcgguacaaugaggagaccuuuggcuacgaagugcccaucaaagaggagggggacuacgugcuggucuugaaauuugcagaggucuacuuugcacagucccagcaaaaggugaggccuagucaggcugcugcuugaccaguaggacauugcugcucuuggacaauccacgauuauggggcuagagagugugagagucucuccagaaaggcagaacagaugagcucuagagaagcauguuccauagugcacaaggcugcacuugccuugggggugagugacagaaagcaaugccagaauccuuguuuugccaacuaacugauccuguuaaggcccuccuggcuacuucccuccaugguuugccgcaccuucuuguuuuuagccuuauuuuuccucugucccuuccugugaauuuccuucuuccuaugcuaagcuuuuuguuuguauucuuuguuccuuaaagccaauauaagaacuccugggcagugaaggaacacggcuuugauuugacccggguuaaggaugcuaaccacccuggauauccagacccaucauuucuuaaauuauuuuugaacuucaagcccaaacacgugcaugauguccaacugcuugaaaggauguaaagcugaugguuuugacauuguuuucuuuucuuauccuggaagguauuugauguacgauugaauggccacgucguggugaaggacuuggauaucuuugaucguguugggcauagcacagcucacgaugaaauuauaccuaugagcaucagaaaggggaagcugaguguccagggggagguguccaccuucacagggaaacucuacauugaguuugucaagguaauuccccuauucugcccauugcugaagagaguggguacaggggaaguuguuugcugcugugugggguugaccacuguuucccuuuuccuagggguacuaugacaaucccaaggucugugcacucuacaucauggcugggacaguggaugguagguuguguucugaccugcuuuuuugacuugaguggagggauaugguugaggaagcccuugggagguaauugagcugaugacuauuuuggaaacacuuaaagcuaaauuguaggggauucagaaucaguuggauaaggaugaagcauaacaugguacuagccacaagcuuuggagucaggucuauguauaucuuguugcugccauuuaaucagauguuugucuuggauggaugcuuuuaauuucccuauaaauugggauuaauaaugguaccuauugguguacccugaccuuuguagucauuugggaucaccuaaaacuuguccuuauucuguuuguuugacaucucuuuccuaggggaaaaaaagguaaaaggaggaguccuguaggcuuuugguaugcucugaaagauuccagcauugcuggacugcacugggacaaaacuucacuuauuuaugucuccuuauccuugggaucaagucuuagaguauauuucuuucucaggguuuagauucuccuggcugccagcaucucaggcugauuuuugcagagaaagcugcgucuuugugacauuucucccccauuccaccucuguaccuuuccccaacucaaucuugaaugcacugaggauuucauccuguugucuugaugucccccaaaugcugauauuaugacaucuaggaggaugaaugucuuaccaccaaacagaccuguguucaagucccugaggaggaggcaggacagagggauagugugugcugggaacccagaacucucugggucaacguuucuucaguuguugugugaaucaaaagggaaugugggcuugugggaggaggagggauuugaaaaggcuaaaguuuaggcauuggaucauugucccuguccagucugguuaucuuggggcucuguaaaaguagaacaggaagguaagauagugaaccucccuaugagcacggcuuuuucuacuuucuaguuaaaucuaaagcuuuugcagcacucugcuguucuguagaccagaggcuauuucugcuacuucuggucuuuucucuggacccggguucaaucacagcaaucucuuuauuguggcuuauuugcugcuuuuaagggucucucuuacuuaaaugcugugggucuuaacaguguuuucuuccuuguguuagauguaccaaagcuucagccucauccgggauuggagaagaaagaagaggaagaagaagaagaagaauaugaugaagggucuaaucucaaaaaacagaccaauaagaaccgggugcagucaggcccccgcacacccaaccccuaugccucggacaacagcagccucauguuucccauccugguggccuucggagucuucauuccaacccucuucugccucugccgguugugagaacaaaugacuauccugaacaggguggaggggugugggaaagaaaccagccauauugguuuugguuucuguauuuuucacaaugauuaaugaacaaaaacaaagagaaaaaaacacacaucaauuaaaggagacaaaaagaggcagagcgaguagagagcagcccucauucaccaccuggucccagacgugcuucaguccucguccucucuuuguggcuggcucccagccuucucuuuccucuugaggauacuuaggguaaacuggauccuuccugcucaaggauccucauuuguauaccuaguggaaaggacucugaacucagaggagucacuguuccuuuuuuuagguuagaaauuaacagcagggaaaugccaucuuauuaccugagacgaccagcacugggaguuagguacggucugaaguuaugucuagauaagacuucagacguccugggauugaaagaaugugugugaagggguagaauuugugcgguaaagacuuaaaaaaaaaaguagggagauuaaaaaaaaagaaagaaaaugcuuccuuaucuggaagccuuucuggauuaauccagugauggucccaccuuuaguguuugagcuuugucauugcuugucucccuggcaugugccaguuauagacuguccagcauccaagacguuucgguuaugucggguccucagaucgccucugacuuguuaccacaacaaaucauuuugauuucagugccuguuggggacuugauuucuucucaguuuuguuuguuuguuuguuuccuuaaucuggcucauuugaaauuucuucucccucucaaccaucccacuaaguuauagccaagaagggaaggagacacggggauuugggguucucugcuugaaugucuucuccuuuaccaccucaccuuguugguaccucccucccuggaucucugagccagcagccaggaggaccugacccagcaguucuuuacuggccccuuuguagggccuugcugccagggggcagggaugcuuuccagccugcagcaacagaacacuugaccuuaaaagucucuucuggucuuuggauuagaaaaggcuuauguuagcauagcuuaagagcaaccucagagauuugagcccuacuaagugacugaccacuguuuagagugucugguaucugauguucauuuauucccauguucuugugugucacaguucagccaguuuugguuuaugccuagagcuacuucaaggaacuagacuaauuagcuauauaggcccagcgaugcuucuuauugaucuuaauaguaugccccuccuuccccuguccuuucauuucucuauccaaguagcagucagguucuuggugugaugggacugaaagaauuccagucagccagagccuuggcagcucugaagcuaaccuuagcaucuaagugucgaucuugaauucccugaaaaaauuucuauaggaaaugaagcuucccugguccccuccuuucuggccauugucauccauuucccaguuagggcaacaaugaaggaggacccagccaagcuagaaggaauuuuguggaugggagacagcaggauuagcuucagcuugggcuggagcagucaauauaggaucucaggccaggcccgcuuuucuagaauguguuuaauuuugaguuugcuuuauuagauauguuuuuuaagagcucuguauauuugaacugcuccuuaugugacaaaauagguagcucuugggcucauguccuggguuuuggcucuuuaaugauuacuccaggccagcauuuagucguuugagaauuguagccuguuguuuucgcugugacuugggucucagugcuaggguauugagucaggcagcuggaggguuguggcccgaggcugcagucagagguauacuucccauagugcuucacacagcuccccugcuucuaaaggauaagguacuguagccuugguccuggggaccaccugccuggggcaguggacauccuaacuaaacaggcuucuggcaguagcuuugguuccuaucccaucgaaauuccccaaagcccugggccacugccauuggguuagucaagaugaaggaggaggacuggcugccuccauuuugccuuguuuguuaguuugccugggucugucugaggaaggagggggucccgccuuccaccucaacacaucccuucagugacucagagucucagaaggaaacccugacuccuggggccauuuccuaaugguacuguaagccaagcagcuuugcuucugccucuguuuccaagcccacccuuuuccccugagcucaggguuagggaugggcgcuuuccucucugguugugaacgaaaggaaggaacaucuuucuauggcuaacaaaaacuaaaggggaagugaggaaacaggaagaaguauggugggggcugggguagacuccccuggagccaagccuauccagcuaacaagagcucccuggggcuggucacagcuggcucaugaugcugaacuugaaaguuuuuuuguuuuuguuuuuguuuuguggcuccuccaagauauagguacaugaaguuuagguuaaaggggugggauucuuuauuuuuauuuuuguauuguaugugucaagaauuacucuguuguucaccuuuugcuuuuugcacuguuuguucucuuaucuguauuuugagcuuagugcuaggacugagaggcugcaccauagggaauguaugggagauggugaggggugccagugaggggugcguggaggagaggccugggcuccucuacuggaucuacacucugucccagguuuuuagaucccacugagcccagcugacugaaaacaaggacagucagggugaaacuucuuuugccagaaguguggccugaguugaauuucugggaggaugacgcagaugucugcugcagagcugggcugagaguucugcagucuagcucugacuuaggucaggggccuguuggucucucauuggacguuuuugggucucacucaugcuuacugaaacauugugccaagaaacucugugggauuugugucccuuaaaccagacucacuuuucugaaaaaucuccauuguugaggagaggcugcucaaucgacaccccgaguucucaugacugggaagauaguuuucuucaggugucaauggcguuagacucccaggaagacuagcccugcccacagggccaccuguugguuugagagcguguucguguucucuugcccucccugccuaagagcuacugggaucacguuagcgggcauuuaggcuuugaugagagggcacaguuugaguuagguuuaccucccccuuucugugccugggaacuguuugguccagcuuuagaacugugguuuugacuuccuuaucucuugggagaagcuucuguuuuaaggaauuucucuuccuucuucuccugccucuagccucuccuggaaaggccuggauaugguuucuaaaaucucagcugagaacuucagaaaacagcagcaguauuuuccuuuuccuagugcuaaaaucccuuucccuagaaauuggcucaccuugggaaacccagggaaagaaucagcagguucucugcccucccuagggguuggggaaggacccaccccggucagcacagugccuuuuccucuccugcucugagccaggguggggcauucccucuagauucagguuugggcagggguccuauagucccugccauggggcugcuucccugucccuucccuccccuuugcuggccuacucuggcauaauucaagugucuucuugccuuggggauccuuaguggcaucaaauggcaacauggaauauuguccuccaugccccuccagaaggaccuaggagaguaggugagcuuuccaaagugagagacgaaucuuucuuucuuuuuuuuuuuaaagggcaggauggguaugcuuugggcuuucuccuucuguggccccggaggaaggagagacugaggcaaggcaaagugauaguacacggaagcagaaccggaaacacccaggaacuguucagaaaucucagaagaaaucugcuucucuucgauggaaagauauaauuaacgaucaaagagcucuaagaaaauugcaaagaagccuuaauguucaagcuuuagaaagaucagagcaauuuuucucuuucaguccaaacuaagacucucuguauuuaaaucucucuggggcaagagggcuagauuuccucauuuuguuaugagacuagauugguaccaguagaucagcugccuagcgagggcagguuucuucuuugcaucuguguggcuugcuuccagucuggccuguccuuuccagcugccuuuugucuagccugcuauggggggccagauuaucuugauaagagcaggugauuuggggacuagcuggguuggcaggaaaagagcaggauggaucucuugggacagguucccccaggaguauaaacacaaggagccaggauugugcuggcagccaaggaaacaguagugccuguuugaguuggcagagagggccuuggcaccucuugcauccaggcagucuugugagaugggggcacauagcacuggggaaagcagaacuccauucucaccucuauuuugagcuucagugcuuuauuucaguaugaggaaaaacaacaacaaacugaagugcgcuuuccguccuuucaaaggacaacugucgggaagggagagccgaguugcgagguaggaggggagcacuggcagggagagacauucuugacuccucucuucccugguguguugugauccagggaaugaaaagaaauuugacccuggauugguucucuccuuggacuuaaggaaucuuaccuuuuccuuccacaaaguucucccaggcaaggaccagcugcccauucugagcccagggcagccucuucaaccauuauuggucuaaccuggcuugucaggaaaccaagcccacccuuccacauugggccuggcugcucuauucuguaccaaguacuggagaaaaagcaucaaguucuuagcccuuguagcuucuacccuaguuucccauccucucucuguggaggccaaaccaacucuuugccagcagccacaacaugcauugacagcggcacagugagauauaacugaugggcuuugaaccugguuggccggggaagcuguagggguggauagagcuggcuuuccuucugggcugucuccaucugacccuaccccuuccaugucccaccccacucccaccaaaaaguacaaaaucaggauguuuuucacuguccauugcuuuguguuuuaauaaacaauuugcagugacacucuguguugggacugaguucgaacuugaucucaaagcgcugaagugauggggugggaaaaaggagacccagggguucacuuggcuccaaagaguucuccugugacgaggcugggaacuguuguccauuuagcugugugucuuuugcuuuucuucucucugggauguuugcuuaggggaaucauucuguaaaacccuuccuggucauuucaacuagcagcgcauuuaaggacaaaaaauuuguuuucacuuucacuggaacaacuaggcacagacugucccacucuuaaggcacacugggccuauugcugccucuccucaccauucccuuagccucugugauagcccacggacaagcuaagcuaaccuaagccauaggagauuuuucucugcuugcuccuuuucugguguuuugucauuguugauuacacauuaggaagagcagaaugcagga

SEQ ID NO: 14430 - RNA, 26593 nt, Homo sapiens
cugucuugcucuuggaaauauuuuuauugguucugagauaacagggcugaggcgagcugggacgggcgcagagcgaaggugggaggcuuugcccuggggcggacaugcuguguggggucugcuggcgggcucccuggcccacccagccagcagcagcugggcacauggcccuuggcgccuggcaugaccucugccggcuuggcacgguggccuccucgucggcgggcgcccccgcuuuccaguugcaggaguuagucuuucacagugcggagggguggggguccggggugggcgccuccccggggugcaggcaggccccauccgccaguacauccugggcucucggcggcuacagcgggugaggcaagcucuagcuccucuuagccccgccuuugggagcuuggcaguccuggaggggcccucgcggccucagcgggacaucauccggacaaacucuagaaggguagaggagcagcuggggagcaagcagcagccagaggccuccccagguugcugccuucagaccccacccuguugccacugccccaacucugugcuggucccccauccauuccgcccucuccaauccauggacacagcagccagcgagaguguucuaaucugcggaucugaccgcugcguaaaccucccacagcucuccacuggaaaaaucuccaauauccugacacagccucauggcccucccugaucuggcgccagcugacaucuccagccauaucucucaggcuaacucccaaccucugugcuccaacuacacagaucuuuucagccccucaagugcagcuggcgcacucucucucucaccucucagcauuuuuuuuuuuuuuuuuuuuuugagauggagucuugcucugucacccaggcuggagugcggugaugcgaucucagcucacugaagccuccaccuccuggguucaagcgauucuccugccucagccucccuaguagcugggauuacaggugugcacuaccacgcuuggcuaauuuuuguacuuuuaguagagaugggguuucaccauguuggccaggcuggucuccucucagcuuuucugaaagcaaccuguacccccucccuucuucuucuuccuuuuuuuuuuuuuuuuuuaauguagagacagagucucccucugucgcccacgcugaagugcaguggcaugauuauagcucacuguaaggucaaacuccugggcucuagcaauccuccugccuuggccucccaaagugcugggauuacagguguggccaccgugcccagccccuucucucucucucuuuucuuuuuuuuuuuuuugagacagagucucgcucugucaccuaggcuggagugcaguggcgugaucuuggcucacugcaagcucugccucccggguucacgccauucuccugccucagccucccaaguagcugggaccaggagcccgccacgacguccagcuaauuuuuuguauuuuuauagagaugggguuucaccauguuagccaggauggucucgaucuccugaccucgugauccgcccaccucggcuucccaaagugcugggauuacaggcgugagccaccgcgccgggccucucucucucuuuuuuuaagggcaauuuuagguuuauggcaaaacggauuagaaaguacggagauuuuuuucugcaaccccuguccccgcauacgcauagccucccacaccaaccacaucccacacagaguggugcauuuguuguaagugagaaaccgacaccgacacaucguuaucaccuggagaccacaguuuacaucaggguucauuguuggcgauguacauucuauggguucagacaaauguauaaugacaugcauccucugcuguuguaucauacagaaucguuuauuuuuauuuauuuauuuauuuuugagacagggucucacuuugucacccaggcuggaguacaguggcacaaucucggcucacugcagccuugaccucccgggcucaagcgauccucccaccucagcucuccagguagcugggacuacaggcaugcgccaccaagccuggcuaauuuuuuuuguauuuuuaguagagacgggguuucaccauguugcccaggcuggucucgaacuccugaccucaagugauccuccugccucagccucccaaaauacuaggauuacaggcaugugccacuguaccuggccucauacagaauaguuucacugcccuaaaaaucuucucuucucugccuauucaucccucccuccccccaaccccuugcacccacugaucuuuuuacugucuccauaguuuugccuuuuccagaaugucauauagaugaaaucauaggguaugcaguguuuucagauuggcuuuucacuuaguaauaugcauguguguccccucuucaccaugucuuuucaugacuagauagcucaucucucucucucucuuuuuuuuuuuucuuuuugagacagagucuugcucuguugcccaggcuggagugcagcaguaccaucucagcucacuacaaccuccgccucccggguucaagcgauucugugucucagccucccaagugcugggauuacaggugugcgccaccacacccagcuaauuuuuuuuguauuuuuaauagagacaggguuucaccauguugaucaggcuggucucaaacuccugacaucaagugaucugcccaccucggccuaccauagugcugggauuacaggcaugagccacagcgccuggccuagcucaucucuuuuuagcacugagcaauaucccauugucuggaugugcccccguuuauuuauccaucacuuacugaaaggacaccuugguuguuuccaaguuuggacaauuaugaauaaagcugcuauaagcaucuauguacagauuuguguggacauagguuuucaacucauuuggguaaauaccugcccuucccucucaccugguggcucuucccauuuuggggggcucuaauuauuuauaaccuccuccaggaagucuucccuaaucccucccugcaacuuggcacaggcgcccccucuauagcagcccccugugcuucccccagcacacauggauuaugcuauuguuuucucugguuuucuugcugguuuugagcucuucgaggcagagaccagaucuuagcacacagcagauguacaaugcauccucguaggaugaaugggggaugccaggcuuucaagagcaaggcugucaucuguggugggcgcuaccuggauacagggagaccugagauuuccagaucuggugauaacaaagccuucucuccaacuauccacgcucccuggccuugaaggccaacugcuccugagagaaaaccucccagccuuuguguucuggacacucacggucucuggcacaugcuuaucuugucuuucugcucagaaugcaaguuccuggugugcagagucaacauuuuacccuuucccuguaucccguagugccucacauggcgucaugcacaagacugcauucugcugugauuucaggccuggggcugugccccagcucugccucuuaguaggcaggcaaucuugagcuaguuauauuacuucucugagccucaguuuccucaucuguaacaugagguuauaauaaugcaauccauagagucauucugagaauuaaauguaagaauauguguaaagcuacuuaguacaaugacugcacauaaguguacaguaaauuauaacuauuaugauuacuauugauucuuuaaaaagaaagucuuugaggcugggcgcgguggcucacgacuguaaucccagcacuuugggaggcuaaggcggguggaucacuugaggccaggaguucgagaccagccuggccaacauggugaaacccugucucuacuaaaaauacaaaaaauuagccaggcaugguggugcaccccuauagucccagcuacucgggaggcugagccacaagaaucacuugaacccgggaggcggagguugcagugagccgagauuacgccacugcacuccagccugggcgacagagcaagacccugucuuaaaauaaauaaauaaauaaauaaauaaauaaccuuucacugagcacuagcuguguuaugcaagaaaugcagugauuaagaaaauaggguucuucuuucaaaguucagagucaacugggaagacaacucuaaccagcaguuaggggacagugugaagaacaggugagccugacgugcugugaaaacccagaaaagaggaaguucaguuugaggaaccagggaagggugcuagaagaaggagucccacugucgagucaugaagaaugucccuugggcuaacagaacuuagcccaaguaaaaaacaggauaggccagaugcaguggcucacaccuauaaucccagcacuuugggaggccaaggcggguggaucaccugaguucaggaguuccagaccagccuggccaacauagugaaaccccaucucuacugaaaauacaaaaacuagcuggacguggugguaggcgccuguaaucccagcuauucgggaggcugaggcaggagaaucgcuugaauccaggaggcagagguugcagugagcugagaucgugccauugcacuccagccuggaguacaagagcgagacuuugucucaaaaaaaaaaaaaaaaagaacaggauaaaagcccuccugguggccaggcacaguggcucacgccuguaaucccagcacuuugggaggccgaggcggguggaucacuugaggucaggaguucaagacuagccuggucaacauggugaaaccccgucucaacugaaaauacaaaaauuagccgggcaugguggugggcgccuguaaucccagcuacuugggaagcugaggcaggagaaucacuugaaucugggaggcgcaguuugcagugagccaagauccugccaccacacuccagccugggcaacagagugagacucugucucaaacaaacaaacaaacaaacaacaacaaaaaagcccuccuggcaaaaagaucaguguauucaagagggacccuagcagcuucacugaucacaaguauuuugguggagugugaaugaaggacuguugaguuguggcuggggaggugagcuguggucagaucuuagggagccugaguguccaguugaggaauguaauguucagaaaacaccuaccguggauggaugcaugcguggguagacagauaaauggauagagaaggaugggugcagauggacacagggaugggugaauggaugaguagauggauauagaugaggaaaugacugaacagauagauggauagaucaaugcaaguauggguagaaguauaugcagacgaagagacaugaaugugugaauggaaguauagaagugugaacacauagagagaucuauaugaguagaugaauacauagauagauucaugggugaauguagagaagaaugaauagaugcacgaauggacagauaaaugcauggauaaauugcuauaggaaugauugcuuagagauggaggaauggauaaauaggcaucuggacagauaaggagauaaacagaugaaaaauggagagauagauauggaaagauggacagauagaugaauagguagaugaauggauggacagauggauggauagguggauggauggauggauggauggauagauauguagacgaauggauggacggauggauggauggauaaauggauggauggaugauggacagauagauagauagguagaugaauggaugaauggauaaauggacagauggauggauagguagaggauggauggauggauagauggguagauaaauggauggauggauggaugguggacagauggauagauagguagaugaauggauggauaaauggacagaugaauggaaagguagaggauggauagauggauggacagaugcaugaauagaugcauggggaagggaugggagauggauuagacgggggcauggacggagggauaagaggaugaaagggcuggggguuggaaaauuagggcggauugaugguugcaugauggauacacaauuggagggcuccauggauggccacugcuggcuugcuucucucccacuuucaagccccaccuaccuucaaaguccacucguccauccccauugagguccacaucucggauaauuuccucuaugucucggugucccaccugaugacccaggagcuuccucauagccucucgcagcucacuggugcuuauuuccccaucaccauuggugucaaacuagagaaggcaggaaggaaggagaggucgccccagcauggcgauuggcagcagcagaucccaaaguugagcuccuucuccagugucauugccccccuuuaccagagaccuuucucuguccaagcucccuccccugaucugggacuugaggcucaggcuucuuuugaaguauuuauacugcagauaggauuccaauagccgccccaugccugccugccucuguccguuaccucucggaaagcaucucgcaguuccuuuacaccaaucauaucugcugucucugccaggaguuuaggccccauuagcuccacgaagucaucaaaaucuacauggccacccacuggaaaaggaggaaagggcuaggucauccccgacauacccauucccugucuccaacuagacaacugacagaauggacaaccccuccuugaccugcucaucagauagagacaaacuuaauaauaacaagagcccucuguucaguucuuccugugagccaguuauugggcuguuuuacagauauucccuaaucuacuuucugggcuccacuccuccaauucggcccucauuuuacaggugaggaaacugaggcucagagaggguaagugguuggccccagaucacagagcugguaagagguggaugcagaauuugaagccaguccugucugacugcagaggacggcaagggugaggaccgaagggacgcagaugccugguagagggacucacgguucauguugaucugcugggacaguucgaugagcuccaucucggugggcauguagcccauggugcgcaugcaguugcccagaucccggcaguugauguagccauccuuguccuugucgaauucucugaaggccucucggagcucuggggaagugagcaaagguggauguggucagggguaggacccgcagagccucugugggcaaaggcagcccaaaggcccaccggcauggaaagagaggcccaggagcuucccaggaugcuggggcauuucucuugccuccugugcacaccuucagcagcugguuucacagaagauaccccgcguugcaccaggccccauuuccaggggccucucuucccaucaaccucccuucccacaccuuccuagagggcuaggcaguccuuucccccaaggggccaaguuuuaccuucaauuuccucuggucgcagugaucuauccugaaacaaaagaacauguccuauuagccgcgacaagggaccuggaagucacaaaauaccuaaccugggggccauccacguggcagcaggcacuggguaggaggugacgaggaugcagcacaggugugccuggaucagguccuugaggggagaagaaagccccacaucucccuuagacauagaagcuccugggccccuaacaggagaugcccaagaagccaccagccccaccagccugggcacagaaccucugugccuccagccccuuguuccagauacaagaaugggucagcaggaguuugaggcuguagugagcuaugauggugccauugcacucugucacccuggacaacagagugagacccugucucaaaaaaaaaaaacaaaaaaagaaugagucagagaacagagcuugccugguggcaaaaaccugcaaauaaaacagaguccagggaggucacaacagggaaaagagagcaccacccaaugaaacaggaagagcagggcgacagaggcugcaagacaacagaagaggcgcaggaggggagggaaggcagggccauccugaagcgaggguaggaggacagggaggagucaggaggagacguggcaacagaauggggcugugacugcuucgcgggcacugccccaccuucuccaauuugacccccaucccuguacguuccccugucaugggaucacaggacaccacauaggaccccgggggccaccagugcuucuggcuggagccaggguccaaaaagcacaugucuccagccucaagcagugcccaggucuccugggcaaucaaggcaacccugaaucuaggcgucagaacagauggcagagacaucuccaaggagcaggccuggaggaagcucagguuggugagcugccaguugcccugggccugcccaggagggagauagacuggcaugaaauggauacaggugcccagcuggaccugguuaguagacuccaaaaguggccuucagcguccagccucccgcauguugcagcucuuugccuuugggcagggaggacaccaggcaggugugcccguccugaagaggcucacacagguauggccauaccucccacgaacacagacacgcaggcaugccacagugagcguguggcaccuccacugugcaugcaggccguuccagccaacggggccaggaugaguagagacagccacuccaaacuggccccaggacaaaagacgacaacaccagaaaaucugcagaucaucuagaaagggaagggcugcugagucacaucucaugggacaaccaggugcauaggaccaagagcucagagguagcucuguguggcaggacagcguugagagugugugugagcuuggagggagcaggcugcaagcucccagcuccgccaggcuggggguaggagucacccauagggaggcgugucucugagaugacugcauggacguucaccuaaaaagcucgcuaugggccaggcacggugguccacgccuguaauccuagcacuuuacgaggccaaggcgaggggaucacuugaagccaggaguucgagaccagccugggcgauauagugagaccucgucucuaccaaaaaaccuuguuuuaguuagccaagcauggugguucacgccuguagucccagcuacucgggaggcugaggcaggagaaucacuugagccugggaggcagagauugcagugauccaagauugcaccacugcacuuccaccuggacaagagagugagacucugucucaaaaaaaaaaaaaaaaaaaaaaagcuggugauggugccuggcuuaaggguaggucacagccauuccaacacaaacccauauguucguagauguuuuugggugaccaaaaaggauguuuugugcaaugggucauaccagcagucugugaaagcgagugaguaagcacacguguguacacauacaugcagagcacacgcccuaggaccagcuacugagacccaauaaauccuuucccacgcaucaggccuuaagcagccucccacuucuccaaggcccaguucugcaggacucgggaggaacaggcauugcugaccccauggcagccccuuccguuccuccuguacacccaaagccccgggggcagcaaagccaggugccccuucacggagugugcccgccaccagagcuggucugcugagcacugauggcugguccuuggaucacacaccccaugcacagcaguagcuauguguguucucugcccuggaguagagccagggaugcccacuaaugugccaggaagaucacgugcagcaacucagggucagguggaauggggugcaggaacacgccuuucuccccaguacauguggcuggggagacgcacuuggacucuagaggcagacagaccugaguaugaagcucagaucuacuuccucaggcaggucacucugcuguuugagccacagucuccucaucuguaaaauggguuaauaccaguacccaccucacagggccuuagugugcauucagugagacaagauauuaaaguguuuagcauguggcauucaauaaaugcaaccuacaaauguuuaccucuauaacauccucauuaguccucuccucucuuugaacuauuuagcuacuuguagaaagcuggccaauucacuagccgcuagccacauguggcuauguaaauuugaguaagaauaacauaaaauccauaauucaguuccuuaguugcacuagccacauuucaaguggucaauagccacauguggcuaguggcuacuguaucggacagcacggaauuuagaauauuuccaucacuguagaaaguucuaccggacagugccacguauacagaguugucauuaggagcacaagaggcucuugagucaggcuauccaagugugaauccuaccucuaccaccaacaagcuguuaccucgagcaugugaccucugcacuccaguuuucuuucuuucuuucuuuuuugaguuggagucuuacucugucacccaggcuggagugccauggcgcgaccuuggcucacugcaaccucugccuccuggguucaagcgauucuccugccucagccucuugaguagcugggauuacaggcacccgccaccaugccuagcuaauuuuuguauuuuaguagagaugggguuucaccauguuggccaggguggucucaaacuccugaccucaagugauccaccuaccucggccucccaaagugcugggauuacaggcgugagccgcugcgcccagcccaagucaguuuucucaucuguaaaauggggaugauaaaagcaccuaccucuuagagcugcucugaggcuuaaaugaggcaauccgccaacacacuaggcacagugcucaccuaguaagugcucaaaacaauguaucugauauuauuauuauuauuaucaucaucauuauuuugcucguggauauggacucaccagcacuuuguagccaugaguggaaaacuuuggggaucagauucauaaguugggggugugagcucuguauagaccccuucuucaucccagcaccuccucacgcccugugaagccaaguucagcgggcuccacugggccaacuuacguacaggcugccuguucucagcgaagcccuugcgcaggaaaaugcaggcagggcccagcagguugugcaugacugcgcaguucugggccagcaucaggagcggucccgggagcucggcgucagccgccagccccuccucgcucgucugcaccaccauguagcuggucuguuccuccuggcacaucuucagccagcaccaagcaaaugcaaaagagaggcagggugucaccucccugcccagccuggcuccuggucccgggaggggcuuuccgcaagaggggacccugagagucaaggagcgggguucagagagcccugagcgugcacaggcaucaaauugguccaacagacagagucuccaauccuugacggaaauggugguuccggggagagcugaaugugaugcccucuguguggcacaugcgcacacacacacacacacacacgcacgcacgcacuggcacauacauaugcacagaaucacacacccaagugcaugaagagacaggggcagcggggggcuucuauucucaccaaugggaaguguucacucagagccuaaugagacaacauccuuucccaaaaugcucccaaccucccaauucagucaaucuccagggcuaagucauuccucccagcucccaaacagacuuguccuacuccagccagauccccgcuggaaggcagugagggcaaucggagcuggcagcauggagaccaggcuuggcuggucugccagaccagagguugcacaugcaggugccauugcugacauaaaugaagcaggcagggugugagagguggggacuggggcaaaguggaaacaugcccccuccuuuuucguguguggcuagugcacucugucgcccaggcuggagugcaguggcgugaucuuggcucacugcaaccucugacucccggauucaagugauucuccugccucagccuccugaguagcuugguuuacaggcacccaccaccacacuggcuaauuuuuuuuuccguauuuucagcagagaugggguuucaccauguuggccaggguggucucgaacuccugaucucaggugauccuccugccucagccucccaaagugcugggauuacaggcgugagccaccgcaccuagccugagauggugaccccucugaagagguagcacuacuuaacuccagcccaguguaaccagaucugauuuaaagcaccgggugggccacacaaggcacaucuguagguaggauuccacccaguuugugauuucaagacuagacacucucugccauccaccaguucuccuuuuccucccucccgccuucccuggcucccugccuggcccagagugccggaccucuagaggcuaaggcagggcccuucucugcuuaccuaauauagcugugcucccaggcccugaccagccgauccuccgcccugaagguucccaugcggcuauaaaaaguccgcacugcccacagaccuuccccuuaggacaacagcagcuuccagacacaacauucaguucuccccagccucccgggaugcccagugccucuacagaauccagcuccugcacucugccuucggccugcacucugccuucggccugcacucugccuucggccugcacucugccuucggccuggagcuuacauaccuuccuucaauguggggggauuuagcuagaguaggaccuucccaaggagcgacaggagcugaaacccugagggcucuuugucugagaagugcaggucugcgcacccuauccuuccauccuacugcauucuacuugcagucagauuccuccagggcaaagaaggcccugcuuaggagaacaucccaagacccaggggcagccuguccuuccagguugagacucagaacaacccccugcccaccguguccucuccugcuuccucuccccaaagcccugugggacuacagaccgagacucccuuccaacuuccuaagccccuuccaggccuagagaggguggugcaguauuccgguuccucaaagaggaagcagcuacucaggcuggaggugaaggaacucagucccagggucaaguuugaugagugcaauaaaugucuguuuuaggugaucccaaaacuugagggaugucagacaggccaagagccccuccugguuugauaucccaaagaguugugauucagagccucggcuucacucacucagacuucugggaccuagacuagagcgaggcaagacuagagcgaggcagaacaagagagaccuucccaucugggagaguggaucaaagcaugccugagauaacagugacuggccgaaccccaggaaccagucucaggagaugucugcagagagucagcauuuuuguuucuggcugaaucuucugcacuuggcucagagauagcauaacccaggaaggcagggagguagcagguggcacagaacuccaagaggcgggccgggcgugguggcucaugccugucaucccagcacuuugggaggccgaggcggguggaugaccugaaguugggaguucaagaccagccugccaacauggcgaaaccccgucuguacuaaaaauacaaaaauuagccgcgugugguggcgggcacccauaaucccagcuacuugggaagcugaggcaggaaaaucacugaacccaggaggcagaggcuucagugagccgagaugcgccacugcacuccagcuuggguaacagagcgagacuccaucucaaaaccacaaaaaaacaaaaaacaaaacaaaacaaaacaaaacuuuaaaaggcaguuuagccugcuggcuuugggcucaaacagucuuagggacaaauucuggcucugccacuugcuugcugugugaccuugggcaggucauuucaccucucugugcuccagcuuccuucuccauacugugggagaugcucaugacuagucacaggauuccugcgacaaguaaugaguuauacacauaaagugcucugcaugguggcuagggcauggcaagaggaggugaauaaauagaguugccauagugauggcaaugauggcgaugaugauggugguggcagugauguaauuuaagagaugcugggugccagaaggcauuuacuucuggcugcagaggaagugggggagcaucugccaaucaggaaagaaaugagaaggauggagaggaauuugcucccaugaagaauggagagugguagcuggggaauuuccacugcaucucuugaucauaauacugccuaacaccaaguugccccagaggcugcaauucuuuucuggccaaugauggcaccugacagccugguccugcccagcucugagccuggugcaggcugccucucaccauuuccaguuccccagauaccgcucaggaagccaagugggcagcaacccauggaccgacaauuucuccuggcaccaaggcaacgucuccuaaguguggcauggcaacaggaggggcaagugugccucaugaccuaacagcuuucuaauaauacaagcuggccaagaguaugcacaucaaagcucccucuugccgaaugaaugucuucaaggagaagccgaaugagggagugccuggugagcggggaggggacugaugcgcugagcgggaauuuggacuagacgacuucuaaggucagauccagaaaucuaugaauaacauuucugacagcaggggaaagagagaggcagccucucguagaggaaaaaauaaaaauaaaaugccagcucugauuuuacacagaccaggguuuaaaucccagcucugcuuccuaucgacuguguaaccuuaggaaggcucuaucucugaguccagcuucuuucucuauaaaacagccaaaagaacuauguagcggaaaagagaaaaugagauaacagacauuagguauguugcagauauuuagaaaaaaaaaaaagcaauuauuaauacuaugauagaaacacgaaauugacugcaguaaguuuuuuuaucuuuuacucuguggacugaaaaucucuccuauuuccuguuucuccuccaucccgcuucucuaaaacccagaguggaacaauuaugguuaugaugacaagaauacuaacauuuauugacuacuauaggccaggcacugugcacagcacuuuauuucauucccagaaucaccuuaagagguggauauuaguaugcccaauugauggauggacaagggaaucgaggaacagagagguuaaguaaucugucuaaggucacauggccagaaagaggaggccuguguaaucugacucuuaagcaugcuguuguguaagggaagaugggugggacagaaggauaauccuuguucuuaaguucacuuccucaagcucuggauggaaccuauuacaagggcuaauucagaucacuuucugcuucucugggacagcgcggagggcacuuccgaugcagaagacuccccuaagaagauaccagauuaugggggaggcgugcauggaagaaacaacaagcccuuggaaggaucuaaggaacagcaaagauuagaaggaauuugaugugagcagcuuagccaaaugaggaagacgacaggcagaaaagcccaaaguguccuaaauugagaggcugguaaacugaccaagauaggaugggguuggggauacagacgccaauagcucacccgaggccauagguaagucacuuaaccccucccucugaaugucaaucaaguuccuugucuggaaaauggaagaauuggaggaaaacaacgccaucauucccucuuccuuuaaauaauaccugagucucuucuauggccuggcaacagagggcuagaaaaauacgcagagcccaccuaacccaaaacccuauaggugcaaacccagccuugcaugaaagaugcuuuagagaugaucauguucuuucuaaaaggaauuuuugcaaaaacaaaaacaaauccaaguguauggcgauaaagccaccacagaaagugacuuacaugcaaccccugcucaacacaucacccgggcagccuacuucuuaauggaaaaacuccugggcccuaaaaccacucggguccuauuugagauacucugacuuaacucaagaauuauuggggaagaauuauuguuguuugguuccuuucaguagcaaugggaucuacuucaaaauccacaauucugaaggcuuagaggccaucagagaggcucacagacccucaaaggauaugaacgagucccugcccuugcugcugggaagggucuucagauucugccgguuuuaagggacuuggccagucccuugaaugacugaggugccagucaaguucacugacaucuuaaggauccacccuuuucauuuuacauccuagaaaccccaaagcuacacaguuucuuuccuaagccuugugcaaauucccaaacacaguuucaccccgaccgccaugcccaaagccugggacacagaaaacggcaauaggaggguguuugggguagaagcagggaggcagcccuggacagaaccccugggaaggauagcaagcuccagccacccuuucugugcccaaccucugagacagauggugagauacccccaauccccagccccagaucuuggaaacuccaaaaacauaccuuccuugagagauuucucaguggauacuugacacaguugcccauccuaaguugaggcagccccucuugggauccccggguccaugaaggaggcuccugggggacugagggacuuccgucccagucucugccaaccccagccucccuccgucugugccguucuuccuccaggacggaugugagcccucucuugcgcgcgugcucucuuacucgucugccugcuccugcucuccgauuuuuuuuuuuuuuggguggauuguguguguguuuguguguggguuuaacuuucugggcacuuucuuaaggagaugaaagcagaaggggagagugcagggcacagggaaagucaccuggagagcugauggcagaggggaaccaagcuggagaaggcugccggaucaucuacaucagauuagcgcucaguccugucucugguucucuccccuucucucggccccuccuuuccccgcugccaaaucugcagggagauggccucagggaggggggcccagaauggcagcugcggcugggaauuaggccagcaggcccagaaagggaagcuggcuaguuuggguucccgaagccagggugccugccgcacagcucccagccuugugugugugcgcgcgcgcacacacacacacacaaacgugcaugcacacacacacgcgcgcacaaacacacacacacaugcaugcacacacaagcgcucagggagaugaaugccccuuccaaagagcagugagcuggacaagcacucacugccccuggcaauuccagcugcauugagagcugcggcuccagucgagagccugggaggucuggugacgccuccaucaugcuccauuuuucacacuugccuugucacugaaaugggacgaggcucgggggccggcagugcagaugagccaacagucagaucagauccuucugcucugugugcaauuucucugacccgaaggaaaccaggagauggccccgaggggagcaugacggaggcagcgcaggcagagagggcaugagcaaaaggucucugaaccuccuccuccucgcccccugccucauccacagcaaagaccucuccccagcuuccuuggggugccgggcagagaagaagcccuuuacgaagcgcucuucgaggucccacagcuggagcuuuuuagaugacuggcucuuccucgucccuccagggucggcuuugauaugaauucaucucacgccucagauguccgguuugagaccuacagccccagccagauuccccgcgugcaagugucccuguuuccugcacccagcuuuuuccagcagggggcaccagagauagacuggaagcagaacuccucccaagcccauucuugcacgcuagcucaguuuucagcccggagagccuccuuucccaggaacuuuucucccgugugggggggcugcucagaacuccuguuaggaagaugggugggggcgcugcccagagggugcucacuccuagggagcugggaaggaggucccuggauaacuccuggaccuccccggugcugcugcugacaaccacgcaaugguuuaaucaggggaguuacucagcagccuuguuugggccaaaccucuggagggggagauggaggaggaggagccuggggggcggguauugaugacuaaagaacagaaaagagggugaugaugcgugucuccuggaaacagcaugaaggaagcaggcccaggcaggggucaguggacuccaaugaaugggaaggacggggaggucugggguugagucuagcucugccagcuucuuuuuuuuuuuuuuuuagacagugucuugcucuguugcccaggcuggagugcagugccgcaaucucagcucacugcaaccucugccuccuggguugaagcgauucuccuggcucagccucccgaguagcuaggauuacagacgcacaacuucaugccuggcuaauuuuuguauuuuuaguagagaugggguuucaccauguugaacaggcuacucuugaacuccugaccucaggugauccaccugccuuggccucccgaagugcugggauuacagacaugagacaccaugcccagcgcugccagcuucugacuggguggcugccucccauuccugaacuucaguuuccgccacuggaaaaauggggcuuuuccuagcuugcuuauauagcauacaugagaaaguguaagacaccgaauagcuacuggaucaguaauuauuuaaauggaagaaagaaguaucacuuguccaguggagaaaugucaggcaccgugcuuggcucugggaacguuguugggggauaagagaaacacaguuccugauuucaggacgcuuacauucuagcaggugggcaggagauauuagagcugggacacaguuaucugauuacauuucagauaaaugcuaugaagggaaaacacaaaaacucugggaaugugagugaggggaaucugucugagucuaggggaucaggaaagacuugcaggcaaaaucuagaaaauagaccauauguagguuccuuugaaacaauagugcucacuagggaccccagagggaagcucagguuaagguccagguaugaauggguggauauauguaaaggccaaaacagcacagcauaaagcagagauucucaaugcuggcuguagacuggcauaacuggggagcuuccccagaaauucuaacuuaauucugucuccaaugggcacugggcauugguguugcuuaguacucccagguaauucuaaccugcagccaguguugggaagcacugauguagaggcuaagagcuuggggcggggcgugguggcucacaccuguaaucccagcacuuugggaggcauaggcagguggaucaccugaggucaggaguucgaggccagccuggccaacguggugaaacgcugucucuacuaaaaaaaaaaaaaaaaaaauacaaaaguuagcugggcgugguggcaggugccugcagucgccgcuacucgagaggcugaggcaagagaaucccuugaacccgggaggcggagauugcagugagucgagaucgcgucauugcacuccaggcugagcgacagagugagacuucaucucaaaaaaaaaaaaaaaaaaaaaaaaaggcuuggacugaggagucacgcugacuuggauucaaaucauauccugggccgggcaugguggcucacaccuguaauccuuggaggccaaggcaggaggaucauugagcccaggaguucgagaccagccuggacaacauagugagaccucaucucuauuuaaaaaaaaaaaaaaaaucuugucugcugcucaguaaccauguggccuagaggacauguugaucuuucucggcuucaguuucuucauuuauaaaauagggauucuaauagcaccucccacagggcucuugugaggagcuaaugagauaauacaugcaaagggcuuggcacugugccaagcaucuagaaagcgccgucuuccccugcccagcauugguauuaaagggccaagcguggcauccauuuauucagcagggcaucaacucagucaaaucuggugguuccugcccccugcaggccaguccgggcauagcacccacuugucgaccuugggauaugccucugucguuggaaacaggagacaggagccggcaaaaccuggucccuauggaaaaaucacacacuuugaagaaaucccauccugcuuugggggcaggugcaggagcugauacuaccuugagguuugaggauagcaagggauccagggauuucgacgugcuuuaaagcuuacuuaagcuaacuugagccgggcagauaggcaggagggacagagggcucagccuucaguaggaaauuuuaaaagggcugaacagcuggguauggcggcuuaugccuguaaucccagcacuucaagaggcugaggugggaggaucaguugaggccaggaguucaagaccagccugggcaacauagcaagaccccaucucuauuaaaaauuuuaaaauuagccaggcauggcagcugugccccuggucauagauacucaggaggcuagggcaggaggaucacuugagcccaggaguuugaggcugcagugagcuaugauuguacccugcacuccagccugggugacagagcaagaccuugucucuucaaaacaaaacaaaaaacaaaaaaggcugaacggugggggcuuccuguaaggagugaagcauguuguaugcccucaccucccaucucuauccacuguggcagcagcccuugggccuccggaagcccuacuuugagugcuggaauggaaugauaggaucagagggaugagaaggauaaacucauugcugauuauuccugauuagaagggaggcuggccuuuggcgcuggucaguucuaucaccagcauuugaacuaucaccagccuuugaacuuggaugacagcccgguacuaagacacucagggaaagcuggacuguaacgugagaggugcuuugcagaugcuucugacgaacagggaacacacuuaugugaccucccaccaaagcagcauggcacacacagaacaggcagguauuuucggaggcaggcagaccacaauucucagcacaguccugccaccuacuuauuuacuuauuuuuagagacagggucucacucugucacuguggcuagaguacaguggugcaaucauaguucacugcagccucaaacucuugggcucaagcaauccuccugacuuggccucccaaagugcugcaauuacagaugugaaccacuacaccuggcccugccauguacuuacuauaugaccuuuggacaagucauuuccucucucuugagccuuccucauuucuuuuuuuuccagacagagucuuccuccgucacccaggcuggagugcagaggcacaaucucagcucacugcaaccuccaccuccuggguucaagcaauucucaugccucagccucccgaguagcugggguuacaggcgcccaccaccacacccagcuaauuuuuguauuuuuaguagagaugggucucacuguguuggccuggcuggucucaaacuccugaccucaagugauccacccaccuuggcuucccaaagugcugggauuacaugugugagccacugugccuggccaagccuuccucauuucuaaaauuguuguggugggguuggggggaguugaugaugcuaaccuucacagguagcugugaagauaagaagacacuuuguccacugugcagugggcucuagacugaggccucaagugcuauuguugccucucaaaaacagcuggagguaaaggcugaccuccuggaggcucucacugaacugacuccaagccacuccuaucaccuguggcugauguuaaccacaagcugacccucacuuucccucuccccaggccccagagaaagccuauaggggcuccaagcccucucagagagaaggagggagacacaugacuggaguaggagugaggaauagacacagcccuaucuuaggaaccuaggcuuagugcaauuaaauccaugacccaaaccaccauggccucucuccccaucucaaccacaggaacuggccgggcgugguagcucacuccuguaaucccagcacuuugggagguugaggcggauggaucacuugaggucaggaguucgagaccagccuggccaacguggugaaacuccaucucuacuaacaauacaaaaauuagccaggugcgguggcaggcaccuguaauuccagcuauucaggaggcugaagcacgugaauggcuugaaucuuggaggcagagguugcagugagccaagaucauaccacugcacucuagucugggugacagagugacacugugucucaaaauaaacaaacaaaccacaggagcuaaggaagccucugaaguccggaggcuggugauaccauucauucacucauucauucauucauuaaauacugugauccugcuaugugcaaagcaguaugggaacagggauagccuaucuguauuaggagacguguuucuacagcuggaaaaaugggaaggaugggacagagcuguggguuuuauccacauuugccuccuccacaaggcauguuucuucucaagcucaggguaaggagcagaaagccuguuucuuaaaauagucuuccaagaccuaaagccccaugucaucaugccucugccgaguuaauuucugacaucacaucuucucuagacagcuggguggcauguccuuagcuggccacaaagagggaguacggaagauccuuugacauucagcuccuucccuuaauagccauccucaccuggcucagaaucagcuuucaaaguaccuuacccaggcccucauucaauuacccuauuaauaauagcaauaacauuaaugaaggcugcccuuuauccagcacucacuaugagccaggcauuugauauccuuaaucuuguguaagccuccuaauaacugcaaagcaguuuuugucaaucucauuccuggaugaagaaaccaagaccagagagagaaaauaacaugcccaaggacacagagaucgaaagugacagagccaggauuagaacuugcaucucugcugucucccaagccaccauuccacaccuuagccucaaaaccacgcugucuccaugcauaugcaauaaggaugcucuaugaggucacugggagaguuuucaucccuguuuccuuuaagguaggaauucaucuuugugccuucagugugauucugaacacuggcucucugagacuauuacaaaugaaaaggaagaaggccuugguaguuaaucaacaauaacaacaaagaagaagaauaacuaacacugauagaguuagcaagggcuccgugccaggccugggccaagcucucucuaucucuccguaucucauuuaaucucccaagcacccugaugaucccuacauugcagguaaagaaauagacuuggccaagcacgguggcucaugccugucaucccagcacuuugggaggcugaaacagguggaucacuugagcccaggauuuccagacugcccgggcaacauagugagacccugucucuauuauaaaauauauuuuuuaaaaaagaaauagacuuaaugagguuaagcaauucacuuaaguuaaaaacaaaugaaacuuggggagucaugaaaaauauacuuccccagggcuguauuuuucucuaagcagaucuuaacuaaaaguuucuguauucagaaccccaucugccuucucuugguucugacccugccucuaaggacagaaaucucaauacggagaaaagggaagaaaagauuaauuccucucugucacaggagacuggaggcucugacacgaaagucccagccuggguuugcuguuguugcucacguagaugacuucgaggugucagauggaagcccaaacugaaugugcugggcuuuaaaguaaaagcccgcagcugagaggcaagagcuuccacagggagguaguaaauauuugaugggaacuuccagcuccuccugacucaggugacccuggugacauuucagaacauugggccggagaauucacuuaaugacugagaaauuagaaggagaaacaaaagcacgucgcuacaaugcucggagcucagaaagggcucauguaggcaaauucugcaagacaggaaagaaaggacucuuuuuuuuuuuuuuuuucaggagcugagucagaucagcugcaaacugaguaaccagaaaguguaugauucuaggccaaugaccuacccuuccaaacugcuagguacagccagggcccuggcuaucugguucacuguugucuuccuggugucuagcaaaugucugaacaaacaaaccacaggaacuaaggaaaccccugaagguuuccuuaauaaaugcucaagaaauaauugauaaaugaaugaauugguaucacccauucaacaacccagcauuccugcugcaacccagccccaauccaaagaccacucgugcccuggcagccuacaccuccucauuaacacaaagcacugcagugaacuccccugacacaucgccucacuaacucucacggcucugcauccacaucucuacuccagagaacuguuuccagcuaacucggcuaacgagggcucccugcaggaacaaagccacacaccacugcccuauggccccaccacagcagcaccacgcaacccaaauccaugugcggcugccuucaugucagaccuccaccagcaucagccacugccgaguaguauuuugaaaagaaaugugcagaucugaagcaaaacacacagggccuccuuggaauucugauccggcguggcaagccaggagcuugaaacagcuucuuuaugcuagaucucagcacagaaaggcacagcccccccuguuucccuacaaaccacgcaaacgcucuaaucagaccucugcaugacaccucucggaggcugccacagaacugucucaaagcugugccaaugaguuugacuugauuacagacuccgaacuaggggaaacccuggcuuuuuugcucaggaguucagagguuuccuucuacugagccuguuuccccagcagcacagccucaaacuguagaccuauauugugacuacggagcugcuuuuaaagggcaggcucccaggugccugggacucuugagggaaaggccugagggaaccacugaugaccucuuuguggccuuucucacccuuccaauggcaucccuagagugacagccuccuuaaaccaccccaaaguuccaguuugagccacagcucugcaugccccuccaugccuacccagacaccucuucucuuuccucauauuuuuggaucuccuaacuuuucucaggccuucagggacaugauaggcaguggccagugucccucgcccucaaguaauucuguguucucugagguccccucucuugacccccagacuccaaaccgcuugcucuccugagucccucccuggcgguacuggccagaggccagaggaguggguuuggcgccaccugcucggagcgccccuccuugacccccgcaaaucuccaggacggucguagaggucgcucucuuccaggacuggcggguucuggcggguaugagggaggcuagcggggagggccuugccccaagaggcccggagcguggacagcgcacggggugcugaaucaggcacggggaggaggagugccggcaagggcgccggcccggggaggacgaggugagccgaggcgugauccgugggggaccacgggccgcgggaggaggcuguggacgcgcaaccgcggccggcagggucccgagcgccuuucccgggagcgcugacgggaggcgcggcccuuaccuggccaaaggcggagcugagcauggggcgcagccgguggaggaacggguccgccucggacgcggcggcuggaacggaguccccgcggccccgggcucgcagagagccccggaggccgagcgccggggacaguccccguuccuccccaucccgcccgcgggccggcggcagcggcgacgacggcgaaggucgggacgccgcggccggcagcgccucccggggccugcagugcgccugggggagcacacgcuggcucccccgcgcgcccuccucucgcggcgccggccggcacaggggccuccgcgaacugggguccccggacgacugcggcgucgccgggcaggagccggguagccggcggcuaggcagccccgggucccgggcagggccguggcggggagcccggcugcccccgcucgccgccgccgccgccgccuucagcagcgacgucuuggacucgcuuuuggcgaugugcgagcucaucgcggcggggcccgcgcucgcauggcccggcgggggcggcgcggugcggcgcggcgcggggcccccggcgggcagagaacggggcucccggcgggagccaagcccgaggacgcgcuggag

SEQ ID NO: 14431 - RNA, 4771 nt, Homo sapiens
acuggaaggagcuucauaaaccaucaacccagucuuaucuccauagcaacaugguuuucucacaucugaauaaaaaaacaaaaaagcugccaacuugacaguaaauaugggacagaucauauucaacuaaaacucccagugucuagcuaucagucuugaaucagcuuuugggucuguagcuagagacagaucauccguucugaguagggcuuaacuggacaaacuaaagcuuuggaggccaaauucccugugggcuucaaauagaaauauagccaggucacuaaagagggaaaagggauagaaaaaauaugaguuaggccagguucgguggcucacaccuguaaucccagcacuuugggaggccgaggugggcagaucacgaggucaggagaucgagaccauccuggcuaacauggugaaaccgucucuacuaaaaguacaaaaaaaauuagccuugcgugguggugggugccuguagucccagcuacucgggaggcugaggaaggagaauggugugaaccugggaggcggagcuuucagugagccgagaucgcgccacuguacuccagccugggcgacagugagacuccgucucaaaaaaaaaaaaaaaagaaaaaauaugaauuaaaccgggugugguggcucguaccuguaaucccaacaccuugggaggauugcuugagcccaggaauucaagaccagccugggcaacacagggagacuccagcucuacaaaaaauucaaaaguuagcuaggcaugguggcauguacuuauggucccaguuacuuuggaggcugagguggcaggaucacuugggcccaggagguugaaguugcagugggcuaugaucacaccacugcacuccagccugggcaauaggagucucaaaaaaaaugaaaguuagaaaaaaggaacauuuucggucuguuuauauaaauacaaacauaaaauuaccccaguugcagucuccuguuuauuccacaguaccucauccuuuuuugcagacagcagggaaaaaacuggcacaauagucaaaauugccagguuugguggcucacgccuguaaucccagcacuuugggaggcagaagugggcagauuaccugaggucaggaguucgagacuagccugaccaauauggugaaaccccaucucuacuaagaauacaaaauuagccgggcaugguggcacaugccuguaaucccagcuacuugggaagcugaggcaggagacuugcuugaacccaggaggcagagguugcagugagcugagaucacgccauugcacuccagcuugggcaacaagagcgaaacucugucuuaaaaaagucaaaaucuugcaccucuacccugaaacccuuccaauccuaaaguagcacaacuuugcuaggauucuuaaaaccacacauucugaagaaaaauaaacuuccaaauauguuacugaccuaauucuacucuuacaaugggaguuaucacccaucaauuccaaucuaucgcccucuucuguguagcagucaccuagcugcuuagaaaucccaauggcaucuuagagauccaugggaaaacauaggcuaacuacaagucaggacccuucuugcaguuucccaagauggguguggguuguuccagccugucuuauuuccuuuccaccuacaagucugccauauuugcuuuucuacgacugcaguccucuuaaaauugauagcaggaaaccucugauagcuacuuguccccagcuuuaauugggucuuuucaggaaaagguaucaauucacacuuguuccugaccacagcaaagcacagcacagcaggcugauaaagucuuugcaggaauuuacauuauuagaagagcaugaaaacugcugcucagaaacauuuacuuuccccuaaggccaccuucuuucuaggcaggggagggggcuagacaaggguccuggaauccauuucauuaucccaacuuuguuuugagcuuauuuccauuuuauagccauagaaagcuucaaguacuacuacauacacauccaucaccacaaccugaggccaaaggcccagaacauucuauagcaaugucuuaacaaauauccuuaaacauugauuuuuuucagauuaggacuaaagauuuaauuuaaauguuucuuuaucaugcacugcauuucucaacaugcacaacaguugcaggaugggugagagaaugugacuaaagaguacugaaauaccccacagaaacuuaacuucuguaaggauggacucauccccaccaaccugggcaucugaucaagugaccgucuucaacgcuguuauuugaacaaauuguaauucacacacauacacaucugcaucagauuuauuuuuuaaaggaauggauuuugagagaaaacaacgugggcagaaguauggaauagaaaauaaauacaaauguaggcuauucugcuaauuguuuuauaaccacgacaaacuaguacagagaaugcccuguacaaaacacaacaaagguucaaacaucgagauguucccuuagcaaggcugaaaauuucagucucugguauuuggaauuuaggcugcaguccuuguuuuuggauggaucacuggguguguggcacaguccaugcuuuuaaccagauuugaacagaagaauggccacuuggcccagguagaaguagaugaaguguuugguuucaugugucacauaacuaccgaaguuccuccccacgaugcaaugccaggugggauuguacuucuugucaaauuccuggaaaagacaaaagaaaagaacuaggauuuuaauuaccagaggucaguguuugccucuuggauaagccagagccuguaggggcagaaaggaggaacgucagcaucugcaaauucuuagaaugaaagaauguuccccagcuccaagccgccuacauaguacauuaauacaaacauacuugcagucugagcgaagaugggaauggaggcugaggaggucaaaggacgaaaggucagcccuaaagacaggguguuuuguuauuaugguaauuacaccuucauaccuucuauaauauucauugacagacggugacaucaacagguguaguuuaucauguucuguguagagaacuaaacuacccuacuguauuugccaugcccccaauuccaagaaaacggcaaaaaauuagcccaucccauuccucaucacaaagaucuuaacugcaccccugcaacacaagacuuuuccaauaggacaaaacuucaaacagcauuguauaccaaaugauugcggaucaaaauuaaauuuacaggaacacaauacugaagcacuccacuguugcuguaaaaacugcuggaaacagaaucugucaacuggccaaauuuuauccuuaauuauuauccaaacagccguccucuucacaucuauccggaugaugcuaaucuacuacccuguccacuagguuagcaaguuguaggaacaacucuucaccauuucucccacccuaagagguacuggggaguagaaugccuguggggggcauuggguggcaacgguuaucuuucucugcaaaauucuuacaaguguuuguggagcgucacacaagauuuagcuacucuaacugcacgcagugcgaaaaccuuuuaaagcuaugaaggggaguaacgcucuugcaagcuagaggcacgcacugcugcguuugucaaaaaaggcauuuauuucuguuccaucugaagucuuucaucuucccauucucgacuggaacccucccacggcuuaggcugccagcuuucuucccuuccagcaaacacugcucgagaaguuggcaguccugccggcuuucuagacugccauuuaccaagccccuaccccagcccccagccccgccaccacccaccaccuucccucaacuccccacuggaaggcuggcaagaucuccucccggcccggcuggaaacacccacgcagcuccccccuccggaacacccagauggauccucggcgcaggaaccacacagaagggggaaccgcugcucccugaucuuagauaccguugcuagguggcgcuuuccccccgcggagcuggguaauuaaaaaaaaaaaaaaaaaaacuucggacgccgggggucuggucuucuccacaggagcgcaaaaugcaucugcguccuuucuggaagcuucuacgccccaagccgccagcaguauucccgggaccugucaggcgcccuuaggaaagcaggaucggggggaaggaacccccugcucccggcugcguaucggcccccgcgcccauccucaccuucuugauaugagccgcaauguccuucucuauguuguauuucuccagcgccugaguagcgcacuccaccgaguccuguugcaucucuuccgacauguccgcauuuuugaucacggccuuucggucgcacaugguuaccuagugggcaaggccugggguaagggguugaguugggccgcgccccccaggcacuaacugcccccaccccggccggcgccaccacgggacgacgccccccaccccacuucucaggaagcgcgggcuacgcggagggcuaaguccggaguggggcgaaauaaggcagcgaggacacccccuggccccccgaguuucucaccguggagaagggggcuggccgacugcaacggucuccugggggaggugcuagcacagcucaggcccggcuagagauaccgucgcuaccgaaaccguggcgcaucuaagcagccccacgccagccgccgccgccuagugcucaggccccgcccugcucccgccggccccg

SEQ ID NO: 14432 - RNA, 4771 nt, Homo sapiens
cggggccggcgggagcagggcggggccugagcacuaggcggcggcggcuggcguggggcugcuuagaugcgccacgguuucgguagcgacgguaucucuagccgggccugagcugugcuagcaccucccccaggagaccguugcagucggccagcccccuucuccacggugagaaacucggggggccaggggguguccucgcugccuuauuucgccccacuccggacuuagcccuccgcguagcccgcgcuuccugagaagugggguggggggcgucgucccgugguggcgccggccggggugggggcaguuagugccuggggggcgcggcccaacucaaccccuuaccccaggccuugcccacuagguaaccaugugcgaccgaaaggccgugaucaaaaaugcggacaugucggaagagaugcaacaggacucgguggagugcgcuacucaggcgcuggagaaauacaacauagagaaggacauugcggcucauaucaagaaggugaggaugggcgcgggggccgauacgcagccgggagcaggggguuccuuccccccgauccugcuuuccuaagggcgccugacaggucccgggaauacugcuggcggcuuggggcguagaagcuuccagaaaggacgcagaugcauuuugcgcuccuguggagaagaccagacccccggcguccgaaguuuuuuuuuuuuuuuuuuuaauuacccagcuccgcggggggaaagcgccaccuagcaacgguaucuaagaucagggagcagcgguucccccuucugugugguuccugcgccgaggauccaucuggguguuccggaggggggagcugcguggguguuuccagccgggccgggaggagaucuugccagccuuccaguggggaguugagggaagguggugggugguggcggggcugggggcugggguaggggcuugguaaauggcagucuagaaagccggcaggacugccaacuucucgagcaguguuugcuggaagggaagaaagcuggcagccuaagccgugggaggguuccagucgagaaugggaagaugaaagacuucagauggaacagaaauaaaugccuuuuuugacaaacgcagcagugcgugccucuagcuugcaagagcguuacuccccuucauagcuuuaaaagguuuucgcacugcgugcaguuagaguagcuaaaucuugugugacgcuccacaaacacuuguaagaauuuugcagagaaagauaaccguugccacccaaugccccccacaggcauucuacuccccaguaccucuuagggugggagaaauggugaagaguuguuccuacaacuugcuaaccuaguggacaggguaguagauuagcaucauccggauagaugugaagaggacggcuguuuggauaauaauuaaggauaaaauuuggccaguugacagauucuguuuccagcaguuuuuacagcaacaguggagugcuucaguauuguguuccuguaaauuuaauuuugauccgcaaucauuugguauacaaugcuguuugaaguuuuguccuauuggaaaagucuuguguugcaggggugcaguuaagaucuuugugaugaggaaugggaugggcuaauuuuuugccguuuucuuggaauugggggcauggcaaauacaguaggguaguuuaguucucuacacagaacaugauaaacuacaccuguugaugucaccgucugucaaugaauauuauagaagguaugaagguguaauuaccauaauaacaaaacacccugucuuuagggcugaccuuucguccuuugaccuccucagccuccauucccaucuucgcucagacugcaaguauguuuguauuaauguacuauguaggcggcuuggagcuggggaacauucuuucauucuaagaauuugcagaugcugacguuccuccuuucugccccuacaggcucuggcuuauccaagaggcaaacacugaccucugguaauuaaaauccuaguucuuuucuuuugucuuuuccaggaauuugacaagaaguacaaucccaccuggcauugcaucguggggaggaacuucgguaguuaugugacacaugaaaccaaacacuucaucuacuucuaccugggccaaguggccauucuucuguucaaaucugguuaaaagcauggacugugccacacacccagugauccauccaaaaacaaggacugcagccuaaauuccaaauaccagagacugaaauuuucagccuugcuaagggaacaucucgauguuugaaccuuuguuguguuuuguacagggcauucucuguacuaguuugucgugguuauaaaacaauuagcagaauagccuacauuuguauuuauuuucuauuccauacuucugcccacguuguuuucucucaaaauccauuccuuuaaaaaauaaaucugaugcagauguguaugugugugaauuacaauuuguucaaauaacagcguugaagacggucacuugaucagaugcccagguugguggggaugaguccauccuuacagaaguuaaguuucugugggguauuucaguacucuuuagucacauucucucacccauccugcaacuguugugcauguugagaaaugcagugcaugauaaagaaacauuuaaauuaaaucuuuaguccuaaucugaaaaaaaucaauguuuaaggauauuuguuaagacauugcuauagaauguucugggccuuuggccucagguuguggugauggauguguauguaguaguacuugaagcuuucuauggcuauaaaauggaaauaagcucaaaacaaaguugggauaaugaaauggauuccaggacccuugucuagcccccuccccugccuagaaagaagguggccuuaggggaaaguaaauguuucugagcagcaguuuucaugcucuucuaauaauguaaauuccugcaaagacuuuaucagccugcugugcugugcuuugcuguggucaggaacaagugugaauugauaccuuuuccugaaaagacccaauuaaagcuggggacaaguagcuaucagagguuuccugcuaucaauuuuaagaggacugcagucguagaaaagcaaauauggcagacuuguagguggaaaggaaauaagacaggcuggaacaacccacacccaucuugggaaacugcaagaaggguccugacuuguaguuagccuauguuuucccauggaucucuaagaugccauugggauuucuaagcagcuaggugacugcuacacagaagagggcgauagauuggaauugaugggugauaacucccauuguaagaguagaauuaggucaguaacauauuuggaaguuuauuuuucuucagaaugugugguuuuaagaauccuagcaaaguugugcuacuuuaggauuggaaggguuucaggguagaggugcaagauuuugacuuuuuuaagacagaguuucgcucuuguugcccaagcuggagugcaauggcgugaucucagcucacugcaaccucugccuccuggguucaagcaagucuccugccucagcuucccaaguagcugggauuacaggcaugugccaccaugcccggcuaauuuuguauucuuaguagagaugggguuucaccauauuggucaggcuagucucgaacuccugaccucagguaaucugcccacuucugccucccaaagugcugggauuacaggcgugagccaccaaaccuggcaauuuugacuauugugccaguuuuuucccugcugucugcaaaaaaggaugagguacuguggaauaaacaggagacugcaacugggguaauuuuauguuuguauuuauauaaacagaccgaaaauguuccuuuuuucuaacuuucauuuuuuuugagacuccuauugcccaggcuggagugcaguggugugaucauagcccacugcaacuucaaccuccugggcccaagugauccugccaccucagccuccaaaguaacugggaccauaaguacaugccaccaugccuagcuaacuuuugaauuuuuuguagagcuggagucucccuguguugcccaggcuggucuugaauuccugggcucaagcaauccucccaagguguugggauuacagguacgagccaccacacccgguuuaauucauauuuuuucuuuuuuuuuuuuuuuugagacggagucucacugucgcccaggcuggaguacaguggcgcgaucucggcucacugaaagcuccgccucccagguucacaccauucuccuuccucagccucccgaguagcugggacuacaggcacccaccaccacgcaaggcuaauuuuuuuuguacuuuuaguagagacgguuucaccauguuagccaggauggucucgaucuccugaccucgugaucugcccaccucggccucccaaagugcugggauuacaggugugagccaccgaaccuggccuaacucauauuuuuucuaucccuuuucccucuuuagugaccuggcuauauuucuauuugaagcccacagggaauuuggccuccaaagcuuuaguuuguccaguuaagcccuacucagaacggaugaucugucucuagcuacagacccaaaagcugauucaagacugauagcuagacacugggaguuuuaguugaauaugaucugucccauauuuacugucaaguuggcagcuuuuuuguuuuuuuauucagaugugagaaaaccauguugcuauggagauaagacuggguugaugguuuaugaagcuccuuccagu

SEQ ID NO: 14433 - RNA, 2473 nt, Homo sapiens
ugaugacaucagagugcgccgucgucgccgccgccaccacugucgccaugaacagugugggggaggcaugcacggacaugaagcgcgaguacgaccagugcuucaaucgcugguucgccgagaaauuucucaagggggacagcuccggggacccgugcaccgaccucuucaagcgcuaccagcaguguguucaggugagcccucccgccucuguucccaggcccugcauucucggcgcugugucccaccacacucaucguauuuuacggggauugggacuggacuggaaggguggagaaaagucgcagugaggccaguggcaggagcucgcuccccuaccaucaccaccgaggccacuugggugucucuccgaaugacaaauauuggggcagugcuuuucaagaagcacagucacauccuuugguucauuugguguucacccuaaacucgcaaggugggcauaguuacucauauuuuauacauaaaaaacuaacacccagaaauaggaagugauuaauccgaguucacuagcaucagguuuccuugguucuuucgcagguggugcacuuuuccacuauuacugcuggggucugggcgggauuauacuucagaauucagacuggagggucacauuuuuuuguuguuauaaacccuucguuagccuguuucucucucuugaccaguccccgcaacugcagccaggaaauguuuauucuggcccaauggauguggaacugcuuugaauuguuaagaacagcaccgggcaaagcacuuccaauaaguuaacccaacacauccucacagcaauuccccgagguaguugcugucuucaucccauuuacaguuagucacauagccaguaaguccuggaacccagauuugaaccuaagucuuucacuaacacaaagugaugauuauuuuucaaauuucacuuaauuuuaacgguucccucacaacuccuuuuccagucucccucaggucuuacacuugauuuauucauuaugguacuucugguuuuuauuuauuuuugaggcagagucucacucugucucccagccuggagugcaauggcacaaucucagcucacugcaaccuccgccucccagguucaagcuauucucaugccucagccacccgaguagcugggcuuacaggcaugcgccaccaugcccagcuaauuuuuguauuuuuaguauaaacagggucucgccauguuggccagguuggucucuaacuucuggccucaagugauccaccugccuuggucucccaaaaugcugcgauuauaggcgugagccaccacaccugaccgguacuuguuuuuuaaaaaguaugugguuugaaucaugguuauaagucuuuauaaucagcuugauuuuacuuuuguacugucauauuuuauuuacaaagcuugcaacuuaagcuucauguaggucuuuauaauguguuuucuccuccuaccagaaagcaauaaaggagaaagagauuccuauugaaggacuggaguucaugggccauggcaaagaaaagccugaaaauucuucuugaccuugacagucaccuugaaggauuucgcaaguccagaaauugaggacucuggauuuuugucaacuaacucugugaacauagccaucagauuugaugaggaacuuaggagagaggaguuuuauuuccuccuucgauguuuuccucucaguuguaaaagaugaacucuuugagaugauuucucaccugcugugguaucuugcaggaacugugugcuaaaauugaacaauuuuuuugagauuaugguugcaauacuuggcguggaaucagcuuuacauaaauauaccuuguaugcaaacgaugauaaacuagucaggaugagcagagcugccugaccucuugauuucugcugcaaaagacauauacacuguacuggggucacuauuuaugaaagcaauugguuaggaccucuuuuuuuccucucagggaacuaaugcucugaaaagggaucugggcacaacaguuucagugagugcuuuugagcacacuuuuauuuuuauauaguaacuaaugguuaagauugaugguggccuggauuagcaaagaggaagacagcuuuuaacacaguucccugccuucacaagaggugucagauuaagaugugaaagcugcaagaauguugcagugaacaccauuucagagcucucagugugcaguucaggaauuaagauacuuggaauagcuguggaggaagaaccuaaauugcaaagaucugcuauugccagcucucaacccaagucagugaauugucaaccugcauauccuaaaaaugucaaaaugcugcaucugguuaaaugucgggguaggggggaagcugaaggugcucgcuucauuugccuuguuuacucauccugcccuguaaugucuguaauccugaagauggaauaaauuguaacauuuaguuucuaucauuauuugccucuggaac

SEQ ID NO: 14434 - RNA, 654 nt, Homo sapiens
cucuuccgguucuaggcacuucgggagccgcggcuuauggugcagacauggccaaguccaagaaccacaccacacacaaccagucccgaaaauggcacagaaaugguaucaagaaaccccgaucacaaagauacgaaucucuuaaggggguggaccccaaguuccugaggaacaugcgcuuugccaagaagcacaacaaaaagggccuaaagaagaugcaggccaacaaugccaaggccaugagugcacgugccgaggcuaucaaggcccucguaaagcccaaggagguuaagcccaagaucccaaagggagucagcugcaagcucgaucgacaugccuacguugcccaccccaagcuugggaagcgugcucuugcccguauugccaaggggcucaggcugugccggccaaaggccaaggccaaggccaaggaucaaaccaaggcccaggcugcagcuccagcuucaguuccagcucaggcucccaaagguacccaggccccuacaaaggcuucagaguagauaucucugccaacaugaggacagaaggacuggugcgaccccccacccccaccccugggcuaucaucugcauggggcugggguccuccugugcuauuuguacaaauaaaccugaggcaggaaaaaaaaaaaaa

SEQ ID NO: 14435 - RNA, 2059 nt, Homo sapiens
uaguuuagaucauugcuuuauuucacuaauuguucaacaacaaaguucauuccucucaagguggaucuugaaucauuccuuguguucucuuccucguucugaauaaaaaagguaaugaagaaaaagccuguacuuuuggagaccuagaaucuugauugaugcuaauaagcuuuugacagcaauuucguguuacgguauauccugcuggcaucuugguggucacacggagcuccccacccuccagugaagauggcuguccacaacuaccaccauugaaaccaaaaguaaguguugaaaaaugcaccuuuuacaauaaaaaaguagaaaccaauucaauuuccucuuuuuuuuuuuacgaauauaaaguuucuuguaaauauguacagucuuuugagcuaguucuauauagcagaaagcaguucacagaugagacacacaauauacauuuucagggcucaagaagcccauuucucauggagauccuaaaugaaaugccaagacugaaagacccauuuucagugaccuuuccaaauacuguggaccaagagacaaaacuucagcaaacauucaaucaaaucugcccuggggacgggaggggagggaguacgaccccacagacuccaagcaacacauaaaacgccacagcaggacauuugccaaaggagcuaccacauggagguuuguaggcguuucaaacaagaaagcacuuagguuaagacacgagcaggaaggagcugggaugcaggccagguugcaaucuggaaagggaucugaacuguggacacaguugaaaacacggucauguucaccugcugcgguggaaacgggucuaccuuugagccuaccuaggaggugccuggguuguugaggcgggccuaagagucguggaggacccaaagcaacagaugccuugugggagauuaaaggcagaaauaaggccgcgaguuagcuugccaacugcaaagccucuagguugguucuguaccaguugccaggaauuucguacucuaauaggaggguccgcagacccagugggagccgcacugcaccuaaggacuucccaacccuggcggagcuggaagaguugagcugcggcugcuuucucaaacuuccuggucuuaggucuagcccuagggaaaggcucauuuggaaagucacaguuucgugggguagaaccgcgcuggauugggugugaacagagucauccucugcaggcagggaagugugaaguuuggaggggacacugagugggagguggugguuugcugaaauccuucucuggucguaaggcuugagcguuuuguuuuuuguuuguucagugcuacagacugcagcuugugguggccaguuagucggcaagucgucagagggucucgauuuggcaggagcuaugggaugguauuaauacauuggcagagcaacccaagggggcagcacaugcagugaacugccaugcagaacucccgacgggccucuuccccaucccagaguggggaacaacacgccgucacagacaaggaagugggugcccccguccccuccccgaccccgagacccaggagugcugggcuccgagcaagucuauugcaugcuuuccuggccaaagcuauauggaaagcgggaacagcaggcuggggagaugacgcugggggguggggaaggaaagcgucucgaggucccuuggccccaagucacugccuccgagcugaggccccgaugaccuccauacauucucagcuggugggaggggaagucgucaaggccauaaaaggcaaugaaaacaguaaacauuuggcuacgaugucacccuggggaaagcagggccaucuaugagaaugaacaggaacaaggaugaaccuacuuggcugcgggagguuggccaacugaccgggacuguucuacacuaugccucgguggcaaagaccugaugauguggucgagcuaaaaaugacuacaacaggaaauacgucgcuauucaaaucuauuaagaauucuguugucuuaaaaaaaaaaaaaaaaaaaggaaagaaacaaagagaaaaaaaaaagaaaaaccaac

SEQ ID NO: 14436 - RNA, 13727 nt, Homo sapiens
agcuggccgccgccaccuccacgcccuaggccgggccgacuuacggagucgccggaagcggaagucgcugagggguggugaagcgguugggaaagugucgguuuaucuucgcgccccuugcguucuugccgcggcuugccugggcagguaaagcgcgauugcgagagcucggcaacccugccgacucagccggaaccggcucccggcccgaggggcgugguguccuggugcuccgacuccuuccgcaggcuccuugggacccgcgguuccgggagucccuugcucagggucccuuuccugcagugaggcgccguccgccuucccuguguccccgcagacccccaucaugggcaauaccagcagugagcgcgccgcgcuggagcggcaugguggccauaagacgccccggagggacagcucggggggcaccaaggacggggacaggcccaagauccugauggacagccccgaagacgccgaccucuuccacuccgaggaaaucaaggugcgagcgguguggaggaacccgauuccccuugacuaauguugaggagaggaacccuccacuagauucccgucacauccuuucgaaaaacaccagaacggagagggaggugguacauuacccggugcacuuaaaagccagaugguccuguaagaguucucuuagcgguccaagaaccugugucuaauuaccaauaugagaaagucacccugagggaggaggugcucacuugguuuaacaucauuaaggagaaagcagcucugggacagaguuucaaauucuuaauuaauucagagucgagcuaacaguaauugagccccagcuucugcuuuucucuuagguguaauuaauugcacugcuuugagacaaauucccucaccuuuacacaaacuggagcuuuuguaaaaguuaguuugggaauuuauccauuuuggaggcaaaccagguacauauacaagcugaaaguagagcggaacagcugacggcaguugccagagguguuuaguucugcccaacacuuuugauucacccuacuuauuuuuuaaaagacgguggucucacuaauuagccgggcgugguggcgggcgccuguggucccagcuacucgggaggcugaggcaggagaauggcgugaacccgggaggcgcagcuugcagugagccgaggucgcgccacugcacuccagccugggcgacagagcuagacuucgucucaaaaaaaaaauauaaauaaaaauaaaaaagacgguggucucacaauguucuccaggcuggucucgaacucccggguucaagcaaucuuuaugccuuggccucccaaagugcugggaucgcaggcgugagcuacggugcuggccgguucagccuacuuuuuuuuuuuuuugagaccgagucucgcucugucgcccaggcuggagugcaguggcgcgaucucggcucacugcaagcuccgccuccuagguucacgccauucuccugccucagccucccgaguagcugggacgacaggcacccgccaccacgcccggcuaauuuuuuauauuuuuaguagagacgggguuucaccguguuagccaggauggucuccaucuccugaccucaggagauccgccugccucggccucccaaagugcugggauuacaggcgugagccacugaacccacccuacuuauuuuuuuuuuuuccuucuuugagauggagucucacucuguugcccaggcuggagggcaguagcacaaucucggggcacugcaaccuucgucucccggacucaaaccauccugccucagccucccgaguagcugggacuacaggcgugugccaccaugccuggcuaauuuuguguauuuuugguagaggugggguuucgccauguugcccagguuggucuugaacuccugaccucaagugauccgcccgccugggccgcccaaagugcugcgauuacaggcaugagccaccacucccggccucacccugcuuuuuuuuaaagcguacauagaaaagucuuucagcuucuagaggucagugggcggugagggucugucugaaggaggcagccagcagcuacugaacuucucucuaguguuguuuaaauaugacuuaaucgugcuuaagcaggccagugcaaacauuuuucuuccugcugcagccuguuuaaauucaaaaacucaggugacuuaacuccugcuucaaccacacuccuguuaaccaccuucauaugguggauauuuccagccgcagggcucaguccaaggacacuuagugauucuggcagcugguauuuauguguuauguccaaaaggaacuaauuguuucaaggaacaaaguagguuuaggaaagauaaagcugcccucugcccaacauacccuguuaguauccaauuucauguuaaucaucauccauuuaauugcuuggcagcucauuccaucuguguuuguccucauguugagcgaggugaucacaucucacaccuucuuuuggaucuuaguuuugagccugacuacaaagaggcugcuuuuauguggcccuacaaccugugguuugaacuugcucucugaauuuguugcauucuugaagagcugugugcaaagugaacuuuagaaucauguuucucuaaugacuugacguccuuuccccaggagguaauuuuggucccuggucccaagaaggcuauuuaagacaccaaaggaaucaaaacuacuuucuucagaaguauuuguucuguuacuauuccaaaacuccuccaggaaauguugagcacacacaucaucuauggggaaugauuucaagcagcguccauucucacuucauuagaaguuacugaaauccccagauaccaaaaaagucgugaauucuuuuaacuacacuagggugcuauuuuggucauaauuaguuauccuuagugugaagugauuccagucuguuauuuaauauguagaucuuguuagaauucaaagaauacaggcaucauuuggauaagcugaggucgguauuugagaugaaggugcuagaagccugcuuaacucccugaagagucuuuuccagccugaaccuucugcucuuuuuaagucuuuggcuucugacugggaaaaaaucuaaaaggugcaugacuacauaugucauccagauagauuuggaugaguuuauuucuuauucuggaauaccucaguuauacggagcuuaccacacuggagguuaucauuuauccuaaugaggguucagucuuugucuugcuuuauuccccagucccuagacagaacuuugugaguaguuuuucccuuccucaaaaucuggauuugccuauuuucaaguugacagcucuagaauuguuccucuuaaauuuucauguacagucauacaucacuuaaugacagggacauauucugagaaauacaucauuaggugauuuuaucauugugugaacaucauagaguguacuuacacaaaccuagucuguucucaugcuacuauguagaaauacccgagacuggguaauuuauaaagaaaagagguuuaauugacucaguuccgcauggcuggggaggccuuaggaaacuuacaaucaugguaaaaggcaccucuucacaggacggcagaagagaaugagagcaagcaggggaaaugccagaugcuuauaaaaccaucagaucucaugagacucacucacugucagagaacagcauggggaaaccgcccccaugaucgauaccuccaccugguccugcccuugacacguggggauuauggggauuacaauucaaggugagauuuggguggggacgcagagccaaaccguaucaccuagucuauaugguguaaccuguugcuuauggacuauaaaccuguacagcauguuauucuacugaauacuguagacacuuauuccacaaguauauuuaaggauuuguguacuuaaauguaucuaaacauagaaaagauaacaauaaaaauaugguauaaucuuaugggacuaccauauacacaguccgucguugacuaagacaucaugcacaugacuguacuucaaaucuugcuugauuaagggaggaacaugacauuaagcuagucuuggauucguaguagccccuuccaaguguguuucauagcuucuucuagaauuuugaugucaacuucuuuaaugacaacaauagcuaauaauuagcacucacugugucagacacuauauagagcacuuacauggacugucucagucuucacaaccuuaaaaaauauauuucuauuuugcaggcaaggaaacugaggcaccacuaguaaguuuccgauccuaaccaugaaccaagauaguaacagcugcgucuuuagaaugaauugucaauauugucuguuguagggagcucgcuuauggcuuucugaguaaacugcucugcuucuaggcaccagagaaggaggaauuccuggccuggcagcaugaucuggaagugaaugauaaagcucccgcccaggcucggccaacgguguuucgauggacggggggcggaaaggaaguuuacuuaucuggguccuucaacaacuggaguaaacuuccccucaccagaagguaauugccuggggaguguucacauauuugucuuaacauaaauucucuucuuucuaaaacaucucugagagagaacagaaaauggauguuucuauaaaauggaugccuaguggaaaaauaauuuugcuuaauaagucuuaagguucaaauguuaaaccuugguggucucuagguuuagaguacagaagaaagagaauauuucugugucacagacaucuuucacuucagauccucagcuaucuguucggucaggacuuuuccacagaaacacaaaaaucugucuuaaugcaguaagggagcacugggcuggaaucuuagaaacccacauuugagcccacauuggccaugcugucagucaccuaacguuaguuaaccugagccucagcguucguuucuguaaagagggaauauuggaccagaucaucucugagguuucaucuaacuuugacucugcguaauacuuuguuugaaaaguacauguuggcugggcaugggggcucaugccuaugaucucagcacuuuugggggcugaggcaggaggauugcuugaggcuaggaguucaagaccagccugggcaacauagugagacccccaucucuacaaaaaaauuaaaaauuagcuggacaugguggugcacaccuguauccccagcuacucgggaggcugagaugggaggauuguuugagccugagaggucagugcuguagugagcagugguugcaccacugcacuccagccugggcaacagagcaagacuuugucuccaaaaagaaaagaaaaauacaugcuauguaggugucauuagcaaggauuauaguaagacauuuuaucaggaaccccagcauggacuucugucuuaaguugucagugagagaacaccuuuagugaguauucuugauaaaaugagggagaaagugucaggccuauugucaggggcugccugcuuuccagcguuuccauuggagaaggagggagccacucagcacagcagucacaggucaguucaagccaggggacaaaacaacccagugaaggggcucuuccggaguuugguuuuucagucauuaggcaaguuucuuuagagaacauuugagcuuccuauucaauugaucccuucuccugcccaaggcaaagugacaaaggguaaaacgaggcagcuucuguuuaucuuguguugucauccuccuuggcauccaggagccuugcgagcuugagacgcacaaaugccugacuguugaccuuuuaacauuagggaugugguuuccugguauuugaguaaggugaguuuucaggaaacugugucgcacugcugcuuccuuauagccuuuucagauugaggucauuaugcugaauugucuaaaugggcuaaaaauguuuguucuccugcagcugaacucuugguuuuauguggaaacguuuuguucuguagcugguuuggcaaguaagcucggggggcagcccaccccacggaaguccucugcuuccuuuuuccuugcagccacaauaacuuuguagccauccuggaucugccggaaggagagcaucaguacaaguucuuuguggauggucaguggacgcacgacccuuccgagguacucuuccucccaccucugguccucugggugcccgcacauuccaaacaaaucaccuucccaagagauugccgcuaggucccuuugcccagcuaguaaaaguccccguguguggcagagcugaguagcagcacuaccugucagacaguuggcauacuugaccaagaugagcaggguggcuagccaggagaugaggccuuccagccaggaauuccaaguccucugaagaauaacuccgcagaccuuccacguuaugauuucugccuaucugucucuucccagcccauaguaaccagccagcuuggcacaguuaacaacaucauucaagugaagaaaacugacuuugaaguauuugaugcuuuaaugguggauucccaaaagugcuccgaugugucugguaugaacacaguuauuuuauaccacaugcgugcaggugggggcuguacagucuagacauacucuuguuucucuugccucucuugagcugaagcugcccagucagauaggcauuuauagcccccacuuaaaggccacagaacuuaauuccugucagguuguugaaauuuagcccuaagggagcuacaagucauuucccuggucaucucagguauucaguaggucugcuuggccacagaacgcagacagcagaaauggaaccauagcuugaucucgugccaagggcagggcugaagaggcccuggaggguggcacugagucagugacagcccagcacuggggaagccugugucucaucccacuuguggugccugaagaauuucagccugacagguguaaauggacaccucagugaccuuagcagucacuuaugugguacauuagcaccuugucagaaucccuuuggggaggaugcggcuccccacgggaaacagccugcacagcccaacucuccuugaugggaagcuauuugguacagaaauacagacccaguaaaacuucuccaucuuguaagagccuuucaggcaucgagguuucaauaaauugcuuucccuccaagccccacaggaagaaacuaccuggaacaugauucauacaguucgggggaagaggguugcgaucuaaaguguuccccuucuuggaggcgggggcuuaacaauuccuggacucugagggaggcaguggaaagaugcccuggcagaauaucuggcgcccuaagaaaacagauuccguucguugacaggagaguucuucaucauugucuaguuaggccuggaaguucugccaccaggauuucuuguuaccaguucagaaaucacagugguaaaaugaucacaaugggcucacugugguugacaguuuguugagcaggacuuggaaauccgaaaucugugcuuuuaucuggguaauuagucuuuuagagauaucaucuaguuuuuuugcagauaguugagaaucagggaauggaggaagugugcccaaauauccuccaaaauauauaacuuacugauacauguaauuuuaagccacuuacaagcuuuuuagucaaauuuccaccuagggaaaggaaacggaccccucacugauacgaagcuaauuccacguucucuacagacuucuguuucgacacuuacuuccucaaaauguuauuuacuccuuauggcucaguuuucugcacuucaugcuuuucucaguuucuugcugugauaugguugggucacauaaacggggcuuguccccugaaaaaugacauugagggaauuggcagagcuggggcauagcagauuuucccuggaccagucccaggaucuggcgaccagaaccaucccacgcguucuuuggaugauggcuugguaccuucuggcuggccaaacgucacuauccaguguucuagcauuaugaaauccugcucuuguagcagcuucucaguguaucugaauaauccagauacucaagcaagaguuuggaaggaacuugaguguaauggaguuaaagagccuuuagauauugggcuuucaauuuucccccccauuuugaaaugugccucguuuagccuguuuucuccacggccucuguguaaacagacugccucaucuucuguugcauugcggccgggggugcccauaacuuggacuuagcuacucaauccucacuuagccuccagcuucuuugugguuuugccagcccagccugaagggagaaggaagucuuauucugccgugcgugugggauuaaguuaucgagaauagccuccuugugaucugacgcagacucacuggcugggccgugucuuccaccagggcaucugaguugacuacugaguuguaugcuagucacccagauuccaaaaggguuuucuccucuccucuauucugcacucuuggaaccagugcauccuucaagagaauguaaaucugcauugagggaacaagagacaaggaaaaugagaugaugacaacauaaguaaggcugcuccuagaaugccugauuuucaaaguaaaguccuguuaccaucucccaacagagcuguccaguucucccccaggacccuaccaucaggagcccuacgucugcaaacccgaagagcgcuuucgggcacccccuauucuccccccacaucuccuccaggucauccugaacaaggacacggggauuuccguaaguaugugggcaucugcccggaccauccgccgugggucauguucaguugcuuucuuuccuguguccaccucuugcaaagcagcuggugagcaagcucagugucacccccuagugugaacugugccguucaccucugcuguggggaugggcugauaacaagagguucccaguguggacaccgcugccucgucuugcaaagccuuucugcacuacucuuccuuguccuucacgccugccucagucuaagcccuguucaauuuacauuucaugacaaacuguaucaccaucucuucuuaguaagcuacaugcucuggcccccacauuuuagaaucuaguuuuaaucauucaauugcuuuuagaaauaucaguacuccuggaucaaaauuugggauaucuagguaacacacauuucuccuccgggaaauuauuacaugcagaaaagaaguguguguccuccuggaucuugaagaacagccaguucuguugugauucuguuuucuguuccaucuaaccuggauugccugcccaguccgccuagcucugggaugcauggcacagccguaauucuugggaauccaggaauucagcuugguccaagcuaccucuuaagaggcauuguuuacgaggugcuuaaaguaaccaugcugcuacugaacacuccacccugaaguggagggcaugugugcugagacgaggaaugcacguguacacaugcaggugucccuacaguggucccugccgggcugccaggacagggucucagugcuuguuacccuacaggguacccaacagggcuugccuuucucaggucaccuccugugcugggagugccccugcagcuggguagccauccugguauaggcccagaagaggccagugguaaggacagcacgccucagcuggcagggcccaccaucuuuccagcacugaguuggcaacagucucaaauaggucacaggugaagaguuucaaggacauguagcuucugccuuagaagcacuuaguugacacugcuucccuuagcucuaacuuuacaaagguugguggguaagaugacuuucagugcccuccuaagcuagugagguuuguuuuuuuuuuuuuuuuuuuuugagacggagucuugcucuguugcccaggcuggagugcuguggugccaucuuggcucacugcaagcuccgccucccgaguucacgccauucuccugccucagccucccgaguagcugggacuacaggcccccgccaccacgcccggcaaauuuuuuguauuuuuaguaaagaugggguuucaccauguuagccaagauggucucgaucuccuagccucgugauccacccgccucggccucccaaagugccgggauuacaggcgugaaccaccgugccuggccagguuuuguuuuuucuagaaaagggaggcaucacuagccaucuucucugauggagacugcugcugggaauagacaagcugagaguggcccagggggcugggaauaugagaaugucaggaccccucuguccaagguagcacuaagcucuaauguaaacugugguuacaguugucacuacuaaaggguuaacauuuauuuugccccaaacuaaucuuaagugcuuuucguguauucuuauucaagccucacaacaaccaugugaaguaggugcaauuauuacccccauuuuagggauggggaaacugaggcacagagcaguagggagaacacuuaaaaucuacugucuuagagauuuucaagaauacauuguuacuaauagucaccguguuguacaguggaucucuugaacguauuccuccugucuaacugaaauguuguauucuuugaccagcaucucccuacccccaccacuccuagccgcuggcaaccaccacucuacucucuacuucugugaguucgacuuucuuggauuccacauaagugacaucacaugggauuugucuuucugugccuggcucauuucacuuaauguccuccagguuuauccaugcugucacagaugacaagauuccuuuuguaaggcucagcagcacugcauuguguaucaguaccucauuucuuuauccauucauccauuguggacaccuacguugauuccacgucuuggcuauuaugaauagagcugcagugaacgugggaguacagauaucucgacaugcugauuucauuuccuuggaguaucuacccuguagugggauugcuagaccaugugguaauuuuaguuauaacuuuuuaggaaccuucaugccauuuuccauaaugguuguacuaauuuacaugcccaucagcagugcacuaaaaguagcuuuuaaguguucucaccacaaaaacaugguaagcauguucugcguguguugaugagcuugauuuagccauuccacaauguguccauauuucaaaacaacauauuguacaugguaaauauacauaauuuuaucugucaaucuuugaaauugauuaauuuuuuaaaaaccccucuuaggcucacacagcaacuggcugagccagcagucacaucaggcuuggcuggugccagauccuugguaguuggugcucucagcagccacccugaauggccucccagcgggagcuugcugaguauuuguugacacaaugauuggcccagccucugggauccuaagccuacagcaguuguucuacacuuuuuuccauuugaauugcauuuauaacaguuggggguauacaaugaaaaaauaaaucccgauuucuggcuucucuuaaaacauaggaaggugcggcgggcagcucugagugccagcccgguggcagauuuuccagaguaguggugucuugcccagguauccguuucauucuucagguucauugagucuuacagauacaaguuuugaauccauugcucaggagcguuuagugcagauggucucuuccuguguucucugaaagugcuguuaauagcugcuuucuuccugccccacccuccauaagaggacagggccguggcccacacuugaaagaggccgggguaaaugccuggccagagacacacaccgaugccuccagcaggcaugcagggagcucccuucaggucagaaggcgugaccuucaucucaccugucgucuuggacaagcccuugcgcugccugauuugggaagagaggucggccugagcgcugccuccuguccuuugauaucuggcacugggaaguaaaggggagaaucuugguuuccaaaucccaaaugcucaccgcugccuuuguucccucacagugugauccagcuuugcuuccugagcccaaucacgucaugcugaaccaccuauacgcgcugucuaucaagguaaugacaugucuguccccaugagagcuguguugcccagugugugcucugaggacccccagcaguggaaugaccuggcgggacugacuuaaagggcagcuuccagggucuggcacaggccaucaggcucagguucugaagcuggcccgggaauuugugguuuuaugaagcccuuaaugauucucauguccucugaggcuugagccccuuaguccagccuuugaucauuuccaccuuguuccuuaggauggagugauggugcucagcgcaacccaccgguacaagaagaaguacgucaccaccuuguuauacaagcccauaugaagagcugggggcggaugguggcccaggagacagcacaccaccaggcuccacacgugcaugcuuuccccaagagggaauggacuguacauugcucauuucacacucuucagaagacauuucauaccugcccugguccugcuugaagguuuguccaggcagagcagcuccugcagcgccucggucugugacaguccuccuagcacccccauggcuuugagccucggggacucaucaaguccaagaaaagagggagggguggcagaggaucugcagcccuggccccgcggugcaugaggcugggugcaguucuaaaccuacauucucgauuuuucuuaagccaaaaaugaaugcuaacuccuuugccaguaaaauucugggaaacagggacugaggccacacaucauuuccagucaucuguguguuuuuaaggccagccacuugucccuguugaggccuggcuauggaacuaaauacaguguuggucuugccuguccuucaaaaucaacaacagauugucucucggcuccagggaggugucauuucuauagaaauuagaagcuuucugauuucuagaugagguuuuacaauuguuucuuacagucaugugcacuaaguacucuuuuuguaagcagagguggcuggcucugcagccuuaaggccauuuuuuaagucaccacgucuagaagucacaugaacucugcucagcaauaaucuguucucagaacagacuuuucaaccugcugccggauuucuccauucagcuggaugauccucaggacugaccaguuagcuggcagguuguccagcuuuuuauuccagucauaauaggugacaguguuaaccgugaaaacuugagaggcacucugcccucuucccuauaaaaucacacagcgugauuuuacaaggucccguggcaccuugcucaggaccucugccccuaguuagcaagacugcagcaguugcuguugcuuauucugaaaggaauguagaacuugacagcagccuucugagucugggucaggaagauguccuuuggaccaaagcagacuucuuuauacgcagcucaguuucccgggagucgccacagauguacccacuagcccagguugcugugagucagcggaagcucccguuaugcccuuugcuccuggugggagagggaggagugagcucccuggguuccaguauuuacuugguauaccugaguuuggggguacccuuuuuugugacuuuucaaaacagugaauuacugucaccuugauggacaaguuucaauaaaacuuuguaaaaauaauuggac

SEQ ID NO: 14437 - RNA, 1999 nt, Homo sapiens
agauggagguuucuaggaagagcagcaggugcugguauuuacaauguugagcacaaacauuugcagcauguuuaaaauugucuaguagaguucaaguuguggauuugcuuuuccuuuuauucuuauaaccuucaguaacuccuccucugggagucagcacucccaugcccagaguucacccaucuggucaucaaacacucaaagaaggggcuuuucuggccuuuugucuugaugcuuauauuuccaaauaggcccccucccuugcuugcauccacguuggucaacuugaccaaaaccucacucuucacucaaacaggcucugagaauggacuuaguggccaauucuagguacaugagcacuuccuguaucccaguuuugggaauaaacuggcuguauuuauagaaugugcuuuuuuuuuuucaauuucucacucucucuccuaucucuagcaagucucaggcaagaucuuugauuuuccuggaugccaccuggaaaugccacccauuguguuucuuuucugucaaauguaaacccuuuagaugugaauguacugguuuaaugaugccauuauucugccugccagaacgcaguaacccagugucucacagagcacaaggggugugccacuggugguacacaagauaauuuuuaaguaguuucuaggaacaacauuaaguaauaccaaaucacaaagaauguuuccccuuuucuauucuuuuuucauccugauuacagcaaggaaaaagucucuguuuagugcuagcagguccuuuacaccuuucagacacuauggcucuuuucccuuuuuagcaaagaaagagcaggccucagagucuucugucuagauagaauuuaaugauauuguuuugugucaugguauuuauuuuauuuauuaccuuccauuuacagcuucccacagugggggaugugacauauuguuucuguucaaauaaauuaagaaaaacaagagaacucaagaaaauaucaaguaauuaacacaccagauaaguauauguggcaaaagucacuucaaagaauuaaugucagaaagauggugauaaugaagcaaaagaaaggcagauuaugcuggccgggcgugguggcucacgccuguaaucccagcaauuugagaggcugagaucacuuaaggucaggaguuugagaccagccugaccaacauggugaaacuccaucucuacuaaaaauacaaaaauuagccaggcgugguggugcaugccuguaaucccagcuaauagagaggcugaggcaggagaaucacuugaauccagaaggcggagguugccgugagcugagacugugccacuacacuccagcccggggugacagagcaagacuccaucucaaaaaaaaaagaaaagaaaacgaaagaaaaagaaaaaagaaaggcagauuauucuaauugaaugaauaagaggcugagagucaauaccuaguuccaacgcccuuuuguuuuugcaggguuuuuauuggccacuaacuagcuaugcaagcugauuuuaggcaaguuucauagccucucugugccuaaaauuccuucaccugcaaaauggggauaagaaugccugccuacuuaccucacagugcuguuaugagaauuaauuguuguaauaguugugacuaaccauuggcggggagaauucuaaguacuauaccaauacaaauuucagcauuuuuucauauacugaacccuagcaaaaaaaaaaaaaauucugaugaacaucagauucaaccugucauuuuacccggauguugugaugagccagcacuugucccaggaggacguugaaucagggacacgaaaucucagcacacagagauucuagcaucauuccaauagauuggacccugauuucuguuucugacauccuguuuuuuguuugugcguguuugggucccuggucuuuuacccaaaucaaaugaaaaguguugcucagaggcagaauaaaaaugguuuuaaguaagccuguguaccacagu

SEQ ID NO: 14438 - RNA, 1137 nt, Homo sapiens
uguguguuuuaggcuuuacuuggaucagguaggcuuaaggcaggggccaugcugcaggagaagggccuguaaaccagucaguacugcucuuucaugcagcccugggaccucagggcugagcuccacaggcaaggggcccguuaggccccucaaagcagacacaaccacuaacaggaaggaaggucaggcuggcuuuagugcagggaaggguaauguugggagggagacguucaugaaggaaaauggguagcugaggcuuuaaagggcuuggaugggacacggguuuaggggaagugaagaaggccaauaaagucuuggggguaaagaagggaauaaacaggagaaaggaacaagaaggcaggugcugggguguagaguccagcugcucuccacagccugggcaacaggcugaguaugggcaacucaaucccaccuccuggccuucaaggcacuacuuguugccccagacagccaucuuugugaacacaggucucaggaggaagcagcuggauuucauguaggcagagaucuccaagcccucaaaucgggagaugaaguccuucagguuugggaaggcguccaaccacuugggcucaaauacuugguuucucucaaggaugccauacgcgaugaaauccacaagugugaucuuguccccaagaaacaauagcugcuuccccagaaacugugaguagagcuucagcauugcagggagugccuccagguauucuggcuucaguuucuuaaaaucuggguuguagcagagucuggccagcugcacgugguuguccacaagcugguucuccaaaaugucuucccaaaucuucuccccuucugucuccccacacagguugugcuuguaggcaaugcagcccaggauggccuugcucugggugaucuugugagccccaucaaucaaguagggcagauugggaaaguccaggcccagcuugaauuuuucauucagccacuggcuucugucauagucaggagcgucccccaucauguacuucuuuuccucauagcuuaagucuguguauugcaggagcaggcagacggcgugggccagcccucagaugucccaguaccccagugucacgggcauggugcuggucgguguggauucugcagaaaggc

SEQ ID NO: 14439 - RNA, 1137 nt, Homo sapiens
gccuuucugcagaauccacaccgaccagcaccaugcccgugacacugggguacugggacaucugagggcuggcccacgccgucugccugcuccugcaauacacagacuuaagcuaugaggaaaagaaguacaugaugggggacgcuccugacuaugacagaagccaguggcugaaugaaaaauucaagcugggccuggacuuucccaaucugcccuacuugauugauggggcucacaagaucacccagagcaaggccauccugggcugcauugccuacaagcacaaccuguguggggagacagaaggggagaagauuugggaagacauuuuggagaaccagcuuguggacaaccacgugcagcuggccagacucugcuacaacccagauuuuaagaaacugaagccagaauaccuggaggcacucccugcaaugcugaagcucuacucacaguuucuggggaagcagcuauuguuucuuggggacaagaucacacuuguggauuucaucgcguauggcauccuugagagaaaccaaguauuugagcccaagugguuggacgccuucccaaaccugaaggacuucaucucccgauuugagggcuuggagaucucugccuacaugaaauccagcugcuuccuccugagaccuguguucacaaagauggcugucuggggcaacaaguagugccuugaaggccaggaggugggauugaguugcccauacucagccuguugcccaggcuguggagagcagcuggacucuacaccccagcaccugccuucuuguuccuuucuccuguuuauucccuucuuuacccccaagacuuuauuggccuucuucacuuccccuaaacccgugucccauccaagcccuuuaaagccucagcuacccauuuuccuucaugaacgucucccucccaacauuacccuucccugcacuaaagccagccugaccuuccuuccuguuagugguugugucugcuuugaggggccuaacgggccccuugccuguggagcucagcccugaggucccagggcugcaugaaagagcaguacugacugguuuacaggcccuucuccugcagcauggccccugccuuaagccuaccugauccaaguaaagccuaaaacacaca

SEQ ID NO: 14440 - RNA, 3100 nt, Homo sapiens
uaaagcccaguuugaaaagcaaggcucugagacucugugaugacagugcaaagagcgugggacugaaaacacaacaccuggggaccauuaagcaaaucucucccucucuuaccuguuuccgggaggggggcggguggggagaacauuuacggaguauuuacaguaccaggccaaguacuuuaugcgcaugucauuuaaucccuauaccgacccuaggaagugccuucuagggcaggugugggaauuaaacagcuccauuacaguuggguaaaucgaggcuggaaaacuuaaguuuacaaagcugaguuaagugacaaagccaaauuuaaaccuguaucuggcugguucuaggucccuuuccuuuaaccaaccugaguucucaauaguguacuaccuaaaguauagaugacuuaugcauuucggggguggggaggggcaacuuuggacucugaugcucucacacacaaaaaaggggcgaacuacacucgauguauucaguaaaugaguuucuaauuccuacuagugagugagguucaaucagaaacggcugggagggaggacggggucuuaaagggacccccagcgugacaacaucuaaguccccucuccccaucacggucgaguguaacgcacccagggcuuccccgcuacuccagcacggauggggguaacuuccccgagccccgcaacucccggcggccccuccacgcagccccaggccccggaggccgccccgccccucucccgaacagccccacccccucccccagcggucccaccuccgcuccgggcggccgggcgagcggcaggacucaccuucguccgacucgcggccccgacagcugcgcucgucguccucggcgcucuccagcucuucauccuccucgggguaguacucgggggccggcggcgcuccagccugggccggggccggggccagcagccccgcggcacucaugucgccucugaccgcagcugagcguggcccacggacaccgcggccacccgcgcucgguacucgccgucugccuagcaguguccgcggcagcccccaacucgaggaccggcagccacggcgaccccuuccccgucuccgccgagcuccgccccccgcgcccgcgcucggcaacgggggccucgcgccgcgagcgacuuccgggucgagagcugcccgacaacggccugauuccgccauccuugggggaguggagaugccgcuggacgcccccgucgccacaaccucagcccuuucaucgccgucuuaaaauccucaacguauagugggggaggggcggagccagguucgcuagagucaggcaaaucuacgggcaggcccagcagcggucaggaccccgaggcucgcaggcgacuuccggagacagccgccaggcggcgccuggagcuagaacuaaagcggugaucguuagcgaccuaggggcggaggguuugaagggcccuuggcagguggagguggucucuaauuuaagcagggaacgacgcgaccugcccccuuauuaggucggaaaaccuagacguccagagugugcgugaucaugcagccuggcuccuccugugacuaguuagagcuuuauuaagagcuaaaagacaaggaugcugauauuccauccuggggacagcaaaauaguauuuucccagcccuuaggaauccuuucuguuuguguaagguuuauucgguaagauguucccccgguuuuacaaaugagaaacgagcugucguuugccuaaaaaaaaauaguaacguccagucugauuuuuuagacuccgagacccaggcccuccgcgguacagcugccuugaauauuaauuuuuuaaaaggugcuuuugcuuaauccaacagcuugcucugagcucucaacugaagaaggggagaauuugccuaccagaaguuauuuggcuaaggcccacguggaagcuuaaaaaacaggagagcugaguaucugcaagaauuaauuugugcgauucccucugaguagaaaaggaacacgguguuauaaguuuugcugaacgaauagauuuaaggugucccuuuagcuaagagcaauguggucuaguuguguguagcgagaaaaaaggguaagguuuuuaaugguuuguccaaaguagccccacuuuuauguuccacccgagucuccguaggaaacgcaaccaguagugaaaaugaacagaugugaaaaccaggguggaaccgaauauucccauucucagaccuuuugugauuaaauuuaucucugaauuguucccuauggacucuucugaaaaugaaacguuauucucaucccacuuauuuugacauuuauuuacuaccuuguuuuaauuaaaaucuuggcucuauuuguaagugauuuuuucucccaacaaaacuaaagaauuuccagaauggaaugcuaagaugucuuuccaggaguucugagaucuucugaagccccuucuaaauaagaaucauucucagaucgcaccguaggucugccaucuauauuuaaacuaggauuccagaacugucucuuguccaaaagaugaagucauuuucuuucuuugugcuguuggagaacaucuaaauuacuugcaaucaacuauauugaguaacuugcguuccugucaguagcaguaaucauagugcagaaaaagcaaagauuuuagaaaucaagaguucauugauacaauuaauuuuuaaguuuauuucguugcuaaaugguuuccuuucaagacgcugagauuuuuauccugcuuauguuuuacugcugucuucuugacugcaaacagcaucuguuaauggucaugcauuucuuuuuuauauguaaugaauagacacaacugagcacuuggguuaugaaaacuuaccccauuuuuuucuguccagauugccagcugcagaacuaaaaaaugcucuuuagugaagguggaccuacucaaaaaaauucucuuauggcuuuagucuuaccuaaccuuuagauuuauuuaauaugauuuuggacagucgcuauacuccuguaaaaaucaaguucccucaaaaccaaguuuuaccaccuugaaaucuuuuuauauaucccuucucaaaacgguacucagccacaccgcucag

SEQ ID NO: 14441 - RNA, 3100 nt, Homo sapiens
cugagcgguguggcugaguaccguuuugagaagggauauauaaaaagauuucaaggugguaaaacuugguuuugagggaacuugauuuuuacaggaguauagcgacuguccaaaaucauauuaaauaaaucuaaagguuagguaagacuaaagccauaagagaauuuuuuugaguagguccaccuucacuaaagagcauuuuuuaguucugcagcuggcaaucuggacagaaaaaaaugggguaaguuuucauaacccaagugcucaguugugucuauucauuacauauaaaaaagaaaugcaugaccauuaacagaugcuguuugcagucaagaagacagcaguaaaacauaagcaggauaaaaaucucagcgucuugaaaggaaaccauuuagcaacgaaauaaacuuaaaaauuaauuguaucaaugaacucuugauuucuaaaaucuuugcuuuuucugcacuaugauuacugcuacugacaggaacgcaaguuacucaauauaguugauugcaaguaauuuagauguucuccaacagcacaaagaaagaaaaugacuucaucuuuuggacaagagacaguucuggaauccuaguuuaaauauagauggcagaccuacggugcgaucugagaaugauucuuauuuagaaggggcuucagaagaucucagaacuccuggaaagacaucuuagcauuccauucuggaaauucuuuaguuuuguugggagaaaaaaucacuuacaaauagagccaagauuuuaauuaaaacaagguaguaaauaaaugucaaaauaagugggaugagaauaacguuucauuuucagaagaguccauagggaacaauucagagauaaauuuaaucacaaaaggucugagaaugggaauauucgguuccacccugguuuucacaucuguucauuuucacuacugguugcguuuccuacggagacucggguggaacauaaaaguggggcuacuuuggacaaaccauuaaaaaccuuacccuuuuuucucgcuacacacaacuagaccacauugcucuuagcuaaagggacaccuuaaaucuauucguucagcaaaacuuauaacaccguguuccuuuucuacucagagggaaucgcacaaauuaauucuugcagauacucagcucuccuguuuuuuaagcuuccacgugggccuuagccaaauaacuucugguaggcaaauucuccccuucuucaguugagagcucagagcaagcuguuggauuaagcaaaagcaccuuuuaaaaaauuaauauucaaggcagcuguaccgcggagggccugggucucggagucuaaaaaaucagacuggacguuacuauuuuuuuuuaggcaaacgacagcucguuucucauuuguaaaaccgggggaacaucuuaccgaauaaaccuuacacaaacagaaaggauuccuaagggcugggaaaauacuauuuugcuguccccaggauggaauaucagcauccuugucuuuuagcucuuaauaaagcucuaacuagucacaggaggagccaggcugcaugaucacgcacacucuggacgucuagguuuuccgaccuaauaagggggcaggucgcgucguucccugcuuaaauuagagaccaccuccaccugccaagggcccuucaaacccuccgccccuaggucgcuaacgaucaccgcuuuaguucuagcuccaggcgccgccuggcggcugucuccggaagucgccugcgagccucgggguccugaccgcugcugggccugcccguagauuugccugacucuagcgaaccuggcuccgccccucccccacuauacguugaggauuuuaagacggcgaugaaagggcugagguuguggcgacgggggcguccagcggcaucuccacucccccaaggauggcggaaucaggccguugucgggcagcucucgacccggaagucgcucgcggcgcgaggcccccguugccgagcgcgggcgcggggggcggagcucggcggagacggggaaggggucgccguggcugccgguccucgaguugggggcugccgcggacacugcuaggcagacggcgaguaccgagcgcggguggccgcgguguccgugggccacgcucagcugcggucagaggcgacaugagugccgcggggcugcuggccccggccccggcccaggcuggagcgccgccggcccccgaguacuaccccgaggaggaugaagagcuggagagcgccgaggacgacgagcgcagcugucggggccgcgagucggacgaaggugaguccugccgcucgcccggccgcccggagcggaggugggaccgcugggggaggggguggggcuguucgggagaggggcggggcggccuccggggccuggggcugcguggaggggccgccgggaguugcggggcucggggaaguuacccccauccgugcuggaguagcggggaagcccugggugcguuacacucgaccgugauggggagaggggacuuagauguugucacgcugggggucccuuuaagaccccguccucccucccagccguuucugauugaaccucacucacuaguaggaauuagaaacucauuuacugaauacaucgaguguaguucgccccuuuuuugugugugagagcaucagaguccaaaguugccccuccccacccccgaaaugcauaagucaucuauacuuuagguaguacacuauugagaacucagguugguuaaaggaaagggaccuagaaccagccagauacagguuuaaauuuggcuuugucacuuaacucagcuuuguaaacuuaaguuuuccagccucgauuuacccaacuguaauggagcuguuuaauucccacaccugcccuagaaggcacuuccuagggucgguauagggauuaaaugacaugcgcauaaaguacuuggccugguacuguaaauacuccguaaauguucuccccacccgccccccucccggaaacagguaagagagggagagauuugcuuaaugguccccagguguuguguuuucagucccacgcucuuugcacugucaucacagagucucagagccuugcuuuucaaacugggcuuua

SEQ ID NO: 14442 - RNA, 877 nt, Homo sapiens
cgaugugaugaacacuuuuauuuacaaauauaauuaaaagcucugacaguuaucaugcucuuccuuggaaccugaaaaauguuuuguuuuguuuuuaaagugcaugcaaaagaaguaaagccuuuuuuuuuuucaucauuuuuuauuguaagaaaauacacaguuugaaagugugaauaaugcaauauuuaugaccaagaaaugggacuuaggaaggggaagggagauaaagaaaaagaucaagaugaucugauugagagacaguguugaacuccaaauacugaacuggaaaaggagggagguggggaggaacaggaggaggaaguaaaaaaauuugaucagagaaacaguuaaaauacaauaugaaaauaaguaauaccucuccuuaaauuccuucuauacacaaaauacacgauuugccaaagcccaauuugugcuacugggauucugugagcuccuuaaguguauucacauccucugcaacagcagaaaaugauuaugauacaaucagaauaugcugaagacaaguuaaacucuugccagcagguucuuaaaaaucacaagaucucuucaccccacccaccccccguccccaaaaaaguaauaauaugucaccacugauauguacaucacaauuaguuucuguaaaauguaucaaauuuucaaucuuuaauaaaacuuuguuuuuuuuauuccugaugaauaaauaccaaaaaaauaaaauaaaauaaaauaaugcagcagcuaguuaagguguaaggcugcggauauugugucucucucccccuuggcauuuauuauuauuauuuuuugcuuuacuuucacagauuggugguaaugagugauugcuuaaagcaauauacauccacuuuuuuug

SEQ ID NO: 14443 - RNA, 9165 nt, Homo sapiens
caggauugcucuuuaaagggaccagagugacauacugaugccuacugaggcaucugagaugcacuguguuggagguuagccucaaugccagccucugguugucuaggugagugacaucaccauaaaaucacauuguguaccauucuggacucaggaucacaaaggcagaggcaaccaaucuuuuuuuuuuuuuuuuuuuuuaaaccucccuuaaagauucuuugaugcuuugcucuaucacuguagaccuggucuuuuuccccccaguuuuuucuuuuuuacauucuggguugcuauuuucagauuaauaauuugaugaccccaucacaguaccaaaauaccccccaaaaugaaguucaaauuugaucaaaacauaaaucagagugagugaguaaaauuauaaaggccaggcagcaggaaaagucacccucaacuaccaucugacuggucaggucucacccaugccaaggggggcaggaagaggagaaaucuauuauacaugcaacacugaacuggggaacauggcuuggggccuccaggacaguucagguccccaagcuaacccccuacuucccagacagcugcucguacaguuugggcacauagucaucccacucggccugguaacacgugccagccaccggggcccugagcucauacuuuuuacggaaggacgccaccuugaauuugccacgguggucuccagaucgguugcugaggaugggcucgucacacuuuagcggccuguccugcucguaaaccagccagacauagcgguggaggccuguggggagaggcagagggaagauguacacacagcccagcacuugagauggggacaucauccauuuuuaucgaauguuucaacauggaggcacccagaccacaccauuuacaaggaggacaccgaggguccagacagguauuuggugcaaauuaacauuuaauggcaauuaacacauuaauggcaaaaaccgcaauuacuuuugcaucaaccuaauagaauguguuaggccccugcuguaacuggugucaagcccaagcccuuaguuccagccucuccuggccugugggaucuggccucugcacccccuuauccucgccucccaacgagccucugugcucuucauucaucccacuucaggcucccggaccuucucaagucaccacccaccaccccccaucagaacacccauuucacuucugucagguaggagcaaccaauuaaggacaaagcaaaucaaugacccgggcccaccauaccacagucgagccucuaggauaaaggagaacauuuucuuucuaccuccaaaauuuacuugcuuagaaaacuggaggacuacuucgaagugacccaaccucacuuuaacuaagcagcuuucuacaagcuucaaugauguacuggaugcaaauagguaccaugagcucuuauuuuuuuaaaaaguggguuuuuuuuuuuuuuuugagacggagucucacucuguugccuaggcguggagugcaguggcaugaucucggcucacuacaaccucagccuccuggguucaagcaauucuccugccucagccuccugaguagcuaggauuacagguacgugccaccacgcccaguuauguuuuguuuuguuuuguuuuuguauuuuuaguagagaccagguuucaccauguuggcaaaacuccugaccucaagugauccacccaucucgcccucccaaagugcugggauuacagcugugagccacugcacccggccagaaacaaaguuauuuuuuaaaaaguuguuuaaauauuugcacacccauguucaaugcagcaguauucacaauagccaagaagcagaagcaacccgacuguccacugauggaugaaaagaugaucagaaugugguuuauacacacaacagaauauuauccagccuuuuauuuuuucuuuacuccccuguguuacucuaggacuauucagccuuaaaaagaaauucagacacaugcuacaccagagaaccuugagaacauuacauuagugaaauuagccagucgcaagacaaauacuguacaauuccacgagguaucuaaaguagacaaacacugcaacagaaaguggaaugguggcugccagggcuaggggaagggaaauggggagcuguuggucaauggggacaggguuucuguuggggaagaugaaaaaucuagagaucuguuucacaacaaugugaauguaguggucgggcaugguagcucacauuuauaaucccaggacuuugggaggccaaggugggagggucaccugagcccaggaggaauuugagaccagcuugggcaauauggcgaaaccccgucucuacuagaaauacaaaaauuugcuggaugugguagguagccugugccuguagucccagcuucucgggagccugagguaggaggguugcuugagcccaggaggugagcugagcccugcagugagcugaaaacgugccacugugcuccagccuaggggacagaguaagacccuaucucaaaaaaaaaaaaaaaaaaaaaaaaaaaaaaagugaauguaguuaacgcuacuguaguguacacuuaaaaaugguuaagauggagggggcgcaguggcucacaccuguaaucccagcacuuugagaggcuaaggcagguggaucacuugaggucaggaauuugagaccagcuuggccaagauggugaaaccccgucucuacuaaaaauauaaaaauuagccagacaugguggcacgugucuguaauccuagcuacccaggaggcugaggugggaggaucacuugaaccugggagguggaggcugaagugagcugagaucacaccacugcacuccagccucaaaaaaagaguuaagaugguaaauuuugccaggcaugguggcucuugccuguaaucccagcacuuugggaggcugaggugggcagaucaucugagcucaggaguucaagaccagccugcccaacauggagaaacccugucucuacuaaaaguaaaaaaaauuagccgggugugaugguggacaccuguauuccagcuacucgggaggcugaggcaggagaaucgcuuaaaccugggagguggagguugcagugagccgcgaucacaccauugcacuccagccugggugacagagcaagacucugucucaagaaaaaaaaaaauuuaaaaaaaaaaaaaaaaaaagaaugcauggcagccacuccacuuuguuucagugagcuuggcuacuuuagguaucucauagaauuguacgguauuugucuuugugugacuggcucauuucacuaacauaauguuccucaggguucauccugguguagcaugugcccaaauuucuuuucaaagcuaaauaguccuagaauaauacacagaaguuuaaacaaaaagacuggauaauauuuggauauuucuucauaauauccaaauacuggaaacaucccaaaugcccaucaauagagaauggcuaaacaaacuggccuguucaccaacgggaauauuacugagcaauaaaaagggguaacuauugauacaaucuauggaccaaucucacagauauuaucuggaaugaagcagaccagucacccaaauuuuuuaaaauacacauugcaugauacuuuuuuuuuggaggcagaggcuugcucuaucgcccaggcuagagcgcaauggcacaaucucagcucacugcaaccuccaccucccggguucaagccauccucccaccucagccccacagguggcugggacuacagacguaugccaccaugccuggauaauuuuuguauuuuugguagagacagaguuguaccauguuggccaggccggucuugaauuccuggcuucaagugauccaacugccuccaccucccaacaugcugggauuauaggcgugagccaccgugccugguccaugauaccauuauaugaacacaagaauagcgaaaguggcuggacacaguggcucacgccuguaaucccagcacuuugggaggccaaggcgggcggaucacaaggucagaaguucgagaccagccuggccaacauggugaaaccuugacucuacuaaaaauacaaaaauuagcugggcgugguggugggcgccugucaucccagcuacucaggaggcugaggcagaagaaucauuugaacacaggagguagagguuguagugagccgagaucacgccauugcacuccagccugggagacagagcgagacuccaucucagaaaaaaaaaaaagaauagugaaagugauuuauggagacaggagucagaauaugguuagcucugggggaauuuaaguaaaaaggucacaugagaaugucguugggcgauggaaaugucaucugucuuuccaauggcugcuaccuuccauggguguaugcauugaucacauuugcugacugaacccuuccgaucuguggauuuuguuaccauguaaauuauaccauauuacaagaauauggaaaaaacaacaagaaaaugaguuacugaggcuuuuuuaaaaaugagaacacagcucugccgggcgcaguggcucacgccuguaaucccaacacuuugggagaccgaggcagguagaucacaaggucaggagauugagaccauccuggcuaacacggugaaaccccgucucuacuaaaaaugcauaaaauuagccaggcaugguggcggacaccuguagucccagcuacucgggaggcugaggcaggagaauggcaugaaccggggagguggagcuugcagugagcgagaucgugccacugcacuccagccugggagacagagcaagacuccaucucaaaaaaaaaaaaugagaacacagcucuuacuugagagaauugccuuauucucauggguaagcuucccauaauuaaccugccuaauuuuauaacugcccuagagaacuuacuaggucccugggaaaucugucccuuuaccaucuacuaugcaugcgugagaggguuuaaaggcaucugaagcuuccgggucuacagagaaaccaugagcccaugaccaacuguccaugucagagauguucuuguaccucuucauguuaacuccuggcuggauaagcuguacaaaaagcuaggauuaugacaguuccaccaaauggaaacauccugaacugaacaccaggcaauaagaaugcauaucucaccaucagcuuagguggcacuuacccaaccuggaaaguuucaauacggugggcuuucucuuucuaucucuaaauaucuacauguauuuuauauauaauagcuauaacacgauacuacacaauacaaugugugugugugugugugcgccuucaauauaguucuacugaagucuuccaaaucuguuuucaauauacccagcuagacuuuuucagaaacaaauacagaaagcaaccuuauauaguuaauuuggaaacuaugaucauuucugaaauguuuuaaagaaacucaaagaucaccccgggcaaaggcuugagauaguuuaacuguguauuccacucacugcagccccaaaaggccaugcuaagcuuucugcaacagugcuucccucucaccaacuucccugcuugcuaaagggcuaggggugcagagacagcucuacacaaaggguccgucuguccagaacccaaggcucuagccaccugacacugcugcaggucugaaugugugcccugaaggcagcugcccuagagguaagcugagaugcuauuuccagcaggguuaagggcucucaaaagaaaagcauugggucaauccuaaugugcccccgagcucccuccccaaccucccaccaaaaacaaccuuuacuaaccugugcccuugggaggccccgagcccacauaaucggagaggacugugccacugcugaugucauugcccuucauguugaccaccaggaaaugaugccauucucugcaugaagaaacacgggaugucagcaccacaggagaucagggaacauucacugcacagucagcaacugggcaucaagaacaugcuggcugccacaacacagccacgaacaacaguccuuucuuuuuuuuuuuuuuuugagacagagucucacucugucacccaggcuggaaugcaguggcacgaucucggcucacugcaagcuccuccuccugggcucaagcaauucucugccucaggcucccaaguagcugggauuacaggcgccugccaucaugccuggcuaauuuucguauuuuuaguagagacgggguuucaccauguuggccagacuggucuugaacuccugaccucgugauccccccgacucggccucccaaagugcuggaauuacaggcaugagccaccgcgcccggcccaguccucacuuucuuagaggccagcacgaaccucauguguuugcagaagagcagacccagccccucccacccucugacauuuucuagagcaaaggucagcaaacuuuccacuaaaaggccagagaauaaauuuguuaagcuuugggggccacagucucuguugcaacuauucaacuuggccuuggcagcaugaaagcagccacagaugacacauagcuuugcuccaauaaaacguuaacugauggacacugacagguaaauuuuguguaauuuccacaucauaaaguacuauucuucuuucaauuuuucaccaaucauuuaaaaaugugaaaaccaggccgggcauaguggcucacaccuguaaucccagcacuuugggagacugaggcgggcagaucaccugaggucaggaguucgagagcagccuggacaaggugaaaccccgucucuacuaaaaauacaaaaauuagccaggcaugguggugggcgcuuguaauuccagcuacucgguuagcugaggcaugagaaucacuugaaccugggagguggagguugcagugagccaagaucaugccacugcacuccagccugggugacugagacucugucucaaaaaaauaaaaaauaaauaacuaaauaaaaauguaaaaaccauucuuagcucauggggcuguauaaaaacaggccacagguggauauggcucucggcugugaguuacagacaccugcuguaggggggcaaaagggcaggaaaggcacucucuggcuuaagcaugggugggggcaucccaaaccaggucuacuucucuguguccagcaagggacuuacacccgauaacucaucucugcaugaccugcucuucucgucuuucucaccucucaccuguauuugggauccuuccugcugggagcauccgggucugucaggaccaagguguagagcuucccugaaucaagaccaucccacgaaaugcuggugggucuauucuuaaccuguaugaaggaaccaguuugcaguaaaaaagucagaaaugcugaagaaacuggcugggugugguggcucacgccuguaaucccagcacuuugggaggccuaggagagaggaucacuugaggucagggguuugagaccagccuggccaacacggugaaaccugccucuacuaaaacuacaaaaauuagcugggcaugguggcgggaaucuguaaucccagcuacucgggaggcugaggugggaggaucacuugagcuggggaggcagaggcugcaggcggccaagaucaccccacugcacuccagccugggcgacagagugagacucugucucaaaaacaagaaaugcugaagaaaccaauacucuuucuuugaucucagacucuccaaagacaaaacagaauagauuuuuaauaaaaucaaugacccuguauugacuguaagagccaggagcuggaguuuuauauacguuauguauuuuauuugagaccaggucuccuucugucacucaggccggaguguagugacgcuaucaaggcucacuguagccucaaccuccagcgcucaaucgaucgauccucccaccucagccuccugagcagcugggaacuacaugcucacaccaucacaccuggccaauuuuuuuuuguagaguuggggucuugcuauguugcccaggcuguauauuauuucagucccaacaacaccauggggcuaguaucccagcacacuauuaagagaaacagauaaggcugggauuccaacccuggcacugaguccccucucaacgacacccuuacauugucuguccggaaucacagcguuucuggauuuggugaucaggagguuaccuggagccugcugaagugaaaucugcauuaacuguacguuucaaagugcaaagaaaaggagaaagccaaggugaugagaggcgggcagggagcaggaaaagggaggcuguguuagaugggcacuacauauuuaaacauccaaaaaaauuaaauucugugaacauccaaaacaauguaaggucggggcaguuuauuuuacgcuguugcccggagcuucauaaccaacuagcaguggcgucugcaaaucuaguuucuucacuuucggcagccccagccgugggcgugggaggucaaagaccaaaacuaaaccguugcccuccagcguaccggcuggacgcucucgacccauuuaacaaaggagaaaucggccggcgcgcucaucgccaguuacauaaugcgucacaggcucucgggugaggcuucagcccuccaaaaccaggccuaaaaugcugaggcccuaggggaagcucugggggcguccgggcagccacagccuacucugucccggcgacgucccucuccagcgcccuggccuguggggggagagggggauccggccuguuuccgaaccuaggucccucuugggucugaagcccgggaaaagugaaugaauuucugccgcaggccgaaccugccuggccacgccacaggccggguucccggugcucgggguggcccccaggcaugggacauggaccccgggaccucuggccugggggggccucgacacacgcaggcugaaccuccccaccgccccuggcccugucuccgcugggucccacccaggaggccggcacaggccuccgcgccgugccgcucgcugcacgcccgccgcccgguguaccugggugggcgucagcacuuugcccagcucguccaccgccgccccggcguaggugacaugcagcgggugcugcggcugcucguccacuucuugcaggcucaagggcccggaccacuugcugagguccaccggcauggcga

SEQ ID NO: 14444 - RNA, 9165 nt, Homo sapiens
ucgccaugccgguggaccucagcaagugguccgggcccuugagccugcaagaaguggacgagcagccgcagcacccgcugcaugucaccuacgccggggcggcgguggacgagcugggcaaagugcugacgcccacccagguacaccgggcggcgggcgugcagcgagcggcacggcgcggaggccugugccggccuccugggugggacccagcggagacagggccaggggcgguggggagguucagccugcgugugucgaggcccccccaggccagaggucccgggguccaugucccaugccugggggccaccccgagcaccgggaacccggccuguggcguggccaggcagguucggccugcggcagaaauucauucacuuuucccgggcuucagacccaagagggaccuagguucggaaacaggccggaucccccucuccccccacaggccagggcgcuggagagggacgucgccgggacagaguaggcuguggcugcccggacgcccccagagcuuccccuagggccucagcauuuuaggccugguuuuggagggcugaagccucacccgagagccugugacgcauuauguaacuggcgaugagcgcgccggccgauuucuccuuuguuaaaugggucgagagcguccagccgguacgcuggagggcaacgguuuaguuuuggucuuugaccucccacgcccacggcuggggcugccgaaagugaagaaacuagauuugcagacgccacugcuaguugguuaugaagcuccgggcaacagcguaaaauaaacugccccgaccuuacauuguuuuggauguucacagaauuuaauuuuuuuggauguuuaaauauguagugcccaucuaacacagccucccuuuuccugcucccugcccgccucucaucaccuuggcuuucuccuuuucuuugcacuuugaaacguacaguuaaugcagauuucacuucagcaggcuccagguaaccuccugaucaccaaauccagaaacgcugugauuccggacagacaauguaagggugucguugagaggggacucagugccaggguuggaaucccagccuuaucuguuucucuuaauagugugcugggauacuagccccaugguguuguugggacugaaauaauauacagccugggcaacauagcaagaccccaacucuacaaaaaaaaauuggccaggugugauggugugagcauguaguucccagcugcucaggaggcugaggugggaggaucgaucgauugagcgcuggagguugaggcuacagugagccuugauagcgucacuacacuccggccugagugacagaaggagaccuggucucaaauaaaauacauaacguauauaaaacuccagcuccuggcucuuacagucaauacagggucauugauuuuauuaaaaaucuauucuguuuugucuuuggagagucugagaucaaagaaagaguauugguuucuucagcauuucuuguuuuugagacagagucucacucugucgcccaggcuggagugcaguggggugaucuuggccgccugcagccucugccuccccagcucaagugauccucccaccucagccucccgaguagcugggauuacagauucccgccaccaugcccagcuaauuuuuguaguuuuaguagaggcagguuucaccguguuggccaggcuggucucaaaccccugaccucaagugauccucucuccuaggccucccaaagugcugggauuacaggcgugagccaccacacccagccaguuucuucagcauuucugacuuuuuuacugcaaacugguuccuucauacagguuaagaauagacccaccagcauuucgugggauggucuugauucagggaagcucuacaccuugguccugacagacccggaugcucccagcaggaaggaucccaaauacaggugagaggugagaaagacgagaagagcaggucaugcagagaugaguuaucggguguaagucccuugcuggacacagagaaguagaccugguuugggaugcccccacccaugcuuaagccagagagugccuuuccugcccuuuugccccccuacagcaggugucuguaacucacagccgagagccauauccaccuguggccuguuuuuauacagccccaugagcuaagaaugguuuuuacauuuuuauuuaguuauuuauuuuuuauuuuuuugagacagagucucagucacccaggcuggagugcaguggcaugaucuuggcucacugcaaccuccaccucccagguucaagugauucucaugccucagcuaaccgaguagcuggaauuacaagcgcccaccaccaugccuggcuaauuuuuguauuuuuaguagagacgggguuucaccuuguccaggcugcucucgaacuccugaccucaggugaucugcccgccucagucucccaaagugcugggauuacaggugugagccacuaugcccggccugguuuucacauuuuuaaaugauuggugaaaaauugaaagaagaauaguacuuuaugauguggaaauuacacaaaauuuaccugucaguguccaucaguuaacguuuuauuggagcaaagcuaugugucaucuguggcugcuuucaugcugccaaggccaaguugaauaguugcaacagagacuguggcccccaaagcuuaacaaauuuauucucuggccuuuuaguggaaaguuugcugaccuuugcucuagaaaaugucagagggugggaggggcugggucugcucuucugcaaacacaugagguucgugcuggccucuaagaaagugaggacugggccgggcgcgguggcucaugccuguaauuccagcacuuugggaggccgagucggggggaucacgaggucaggaguucaagaccagucuggccaacauggugaaaccccgucucuacuaaaaauacgaaaauuagccaggcaugauggcaggcgccuguaaucccagcuacuugggagccugaggcagagaauugcuugagcccaggaggaggagcuugcagugagccgagaucgugccacugcauuccagccugggugacagagugagacucugucucaaaaaaaaaaaaaaaagaaaggacuguuguucguggcuguguuguggcagccagcauguucuugaugcccaguugcugacugugcagugaauguucccugaucuccuguggugcugacaucccguguuucuucaugcagagaauggcaucauuuccugguggucaacaugaagggcaaugacaucagcaguggcacaguccucuccgauuaugugggcucggggccucccaagggcacagguuaguaaagguuguuuuuggugggagguuggggagggagcucgggggcacauuaggauugacccaaugcuuuucuuuugagagcccuuaacccugcuggaaauagcaucucagcuuaccucuagggcagcugccuucagggcacacauucagaccugcagcagugucagguggcuagagccuuggguucuggacagacggacccuuuguguagagcugucucugcaccccuagcccuuuagcaagcagggaaguuggugagagggaagcacuguugcagaaagcuuagcauggccuuuuggggcugcagugaguggaauacacaguuaaacuaucucaagccuuugcccggggugaucuuugaguuucuuuaaaacauuucagaaaugaucauaguuuccaaauuaacuauauaagguugcuuucuguauuuguuucugaaaaagucuagcuggguauauugaaaacagauuuggaagacuucaguagaacuauauugaaggcgcacacacacacacacacauuguauuguguaguaucguguuauagcuauuauauauaaaauacauguagauauuuagagauagaaagagaaagcccaccguauugaaacuuuccagguuggguaagugccaccuaagcugauggugagauaugcauucuuauugccugguguucaguucaggauguuuccauuugguggaacugucauaauccuagcuuuuuguacagcuuauccagccaggaguuaacaugaagagguacaagaacaucucugacauggacaguuggucaugggcucaugguuucucuguagacccggaagcuucagaugccuuuaaacccucucacgcaugcauaguagaugguaaagggacagauuucccagggaccuaguaaguucucuagggcaguuauaaaauuaggcagguuaauuaugggaagcuuacccaugagaauaaggcaauucucucaaguaagagcuguguucucauuuuuuuuuuuugagauggagucuugcucugucucccaggcuggagugcaguggcacgaucucgcucacugcaagcuccaccuccccgguucaugccauucuccugccucagccucccgaguagcugggacuacagguguccgccaccaugccuggcuaauuuuaugcauuuuuaguagagacgggguuucaccguguuagccaggauggucucaaucuccugaccuugugaucuaccugccucggucucccaaaguguugggauuacaggcgugagccacugcgcccggcagagcuguguucucauuuuuaaaaaagccucaguaacucauuuucuuguuguuuuuuccauauucuuguaauaugguauaauuuacaugguaacaaaauccacagaucggaaggguucagucagcaaaugugaucaaugcauacacccauggaagguagcagccauuggaaagacagaugacauuuccaucgcccaacgacauucucaugugaccuuuuuacuuaaauucccccagagcuaaccauauucugacuccugucuccauaaaucacuuucacuauucuuuuuuuuuuuucugagauggagucucgcucugucucccaggcuggagugcaauggcgugaucucggcucacuacaaccucuaccuccuguguucaaaugauucuucugccucagccuccugaguagcugggaugacaggcgcccaccaccacgcccagcuaauuuuuguauuuuuaguagagucaagguuucaccauguuggccaggcuggucucgaacuucugaccuugugauccgcccgccuuggccucccaaagugcugggauuacaggcgugagccacuguguccagccacuuucgcuauucuuguguucauauaaugguaucauggaccaggcacgguggcucacgccuauaaucccagcauguugggagguggaggcaguuggaucacuugaagccaggaauucaagaccggccuggccaacaugguacaacucugucucuaccaaaaauacaaaaauuauccaggcaugguggcauacgucuguagucccagccaccuguggggcugaggugggaggauggcuugaacccgggagguggagguugcagugagcugagauugugccauugcgcucuagccugggcgauagagcaagccucugccuccaaaaaaaaaguaucaugcaauguguauuuuaaaaaauuugggugacuggucugcuucauuccagauaauaucugugagauugguccauagauuguaucaauaguuaccccuuuuuauugcucaguaauauucccguuggugaacaggccaguuuguuuagccauucucuauugaugggcauuugggauguuuccaguauuuggauauuaugaagaaauauccaaauauuauccagucuuuuuguuuaaacuucuguguauuauucuaggacuauuuagcuuugaaaagaaauuugggcacaugcuacaccaggaugaacccugaggaacauuauguuagugaaaugagccagucacacaaagacaaauaccguacaauucuaugagauaccuaaaguagccaagcucacugaaacaaaguggaguggcugccaugcauucuuuuuuuuuuuuuuuuuuuaaauuuuuuuuuuucuugagacagagucuugcucugucacccaggcuggagugcaauggugugaucgcggcucacugcaaccuccaccucccagguuuaagcgauucuccugccucagccucccgaguagcuggaauacagguguccaccaucacacccggcuaauuuuuuuuacuuuuaguagagacaggguuucuccauguugggcaggcuggucuugaacuccugagcucagaugaucugcccaccucagccucccaaagugcugggauuacaggcaagagccaccaugccuggcaaaauuuaccaucuuaacucuuuuuuugaggcuggagugcaguggugugaucucagcucacuucagccuccaccucccagguucaagugauccucccaccucagccuccuggguagcuaggauuacagacacgugccaccaugucuggcuaauuuuuauauuuuuaguagagacgggguuucaccaucuuggccaagcuggucucaaauuccugaccucaagugauccaccugccuuagccucucaaagugcugggauuacaggugugagccacugcgcccccuccaucuuaaccauuuuuaaguguacacuacaguagcguuaacuacauucacuuuuuuuuuuuuuuuuuuuuuuuuuuuuuuugagauagggucuuacucuguccccuaggcuggagcacaguggcacguuuucagcucacugcagggcucagcucaccuccugggcucaagcaacccuccuaccucaggcucccgagaagcugggacuacaggcacaggcuaccuaccacauccagcaaauuuuuguauuucuaguagagacgggguuucgccauauugcccaagcuggucucaaauuccuccugggcucaggugacccucccaccuuggccucccaaaguccugggauuauaaaugugagcuaccaugcccgaccacuacauucacauuguugugaaacagaucucuagauuuuucaucuuccccaacagaaacccuguccccauugaccaacagcuccccauuucccuuccccuagcccuggcagccaccauuccacuuucuguugcaguguuugucuacuuuagauaccucguggaauuguacaguauuugucuugcgacuggcuaauuucacuaauguaauguucucaagguucucugguguagcaugugucugaauuucuuuuuaaggcugaauaguccuagaguaacacaggggaguaaagaaaaaauaaaaggcuggauaauauucuguuguguguauaaaccacauucugaucaucuuuucauccaucaguggacagucggguugcuucugcuucuuggcuauugugaauacugcugcauugaacaugggugugcaaauauuuaaacaacuuuuuaaaaaauaacuuuguuucuggccgggugcaguggcucacagcuguaaucccagcacuuugggagggcgagauggguggaucacuugaggucaggaguuuugccaacauggugaaaccuggucucuacuaaaaauacaaaaacaaaacaaaacaaaacauaacugggcgugguggcacguaccuguaauccuagcuacucaggaggcugaggcaggagaauugcuugaacccaggaggcugagguuguagugagccgagaucaugccacugcacuccacgccuaggcaacagagugagacuccgucucaaaaaaaaaaaaaaaacccacuuuuuaaaaaaauaagagcucaugguaccuauuugcauccaguacaucauugaagcuuguagaaagcugcuuaguuaaagugagguugggucacuucgaaguaguccuccaguuuucuaagcaaguaaauuuuggagguagaaagaaaauguucuccuuuauccuagaggcucgacugugguauggugggcccgggucauugauuugcuuuguccuuaauugguugcuccuaccugacagaagugaaauggguguucugauggggggugguggguggugacuugagaagguccgggagccugaagugggaugaaugaagagcacagaggcucguugggaggcgaggauaagggggugcagaggccagaucccacaggccaggagaggcuggaacuaagggcuugggcuugacaccaguuacagcaggggccuaacacauucuauuagguugaugcaaaaguaauugcgguuuuugccauuaauguguuaauugccauuaaauguuaauuugcaccaaauaccugucuggacccucgguguccuccuuguaaaugguguggucugggugccuccauguugaaacauucgauaaaaauggaugauguccccaucucaagugcugggcuguguguacaucuucccucugccucuccccacaggccuccaccgcuaugucuggcugguuuacgagcaggacaggccgcuaaagugugacgagcccauccucagcaaccgaucuggagaccaccguggcaaauucaagguggcguccuuccguaaaaaguaugagcucagggccccgguggcuggcacguguuaccaggccgagugggaugacuaugugcccaaacuguacgagcagcugucugggaaguaggggguuagcuuggggaccugaacuguccuggaggccccaagccauguuccccaguucaguguugcauguauaauagauuucuccucuuccugccccccuuggcaugggugagaccugaccagucagaugguaguugagggugacuuuuccugcugccuggccuuuauaauuuuacucacucacucugauuuauguuuugaucaaauuugaacuucauuuugggggguauuuugguacugugauggggucaucaaauuauuaaucugaaaauagcaacccagaauguaaaaaagaaaaaacuggggggaaaaagaccaggucuacagugauagagcaaagcaucaaagaaucuuuaagggagguuuaaaaaaaaaaaaaaaaaaaaagauugguugccucugccuuugugauccugaguccagaaugguacacaaugugauuuuauggugaugucacucaccuagacaaccagaggcuggcauugaggcuaaccuccaacacagugcaucucagaugccucaguaggcaucaguaugucacucuggucccuuuaaagagcaauccug

SEQ ID NO: 14445 - RNA, 17646 nt, Homo sapiens
gccacguccaguucuggacagcuccuaggguccuguccucacugaagcacuuaugccggaaagcccuucgaaguuuccuaacaacuuaccaaguccuagcacugccaauccccaagaaaaugaaagaguuccucacauacaggacuuuuuaagcaacaccacaucuugugcuucuuuguagcaggguaaaucguccugucaaagggaguugcuggaauaaugggccaaacaucuggucuugcauugaaauagcauuucuuugggauugugaauagaauguagcaaaaccagauuccaguguacuagucauggaucuuucucucccuggcaugugaaagucagucuuagaggaagagauuccacuugcacggcaacagagccuuacguuaaauuuucaguccaguuaugaacagcaaguguugaacucuuucugcuuguuuugauucaaagugcaguuacugauguuguuuugauuaugcaacuaaguaggccuccagagccucucuaguggcagagcagcucacacucccuccgcugggaacgauggcuucugccuaguaccuauccuuguguuucugaugcagugguagcauugguucaaguucucuccugcuguggucagaguugcuucgauguuggccaagugcuuuucuucuugggcucccuucugaccugcaggacaguuuuccuggagccauuugguaugagguauuaauuuagcuuaacuaaauuacaggggacucagaggccgugcuccugaccgauccagacacuauuacuggcuuuuuuuuuuuuuuuuuaacaauggugugcaugugcaggaaaugacaaauuuguaugucagauuauacaaggauguauucuuaaaccgcaugacuauucagauggcuacugaguuaucaguggccauuuauuagcaucauauuuauuuguauuuucucaacagauguuaagguacaacuguguuuuucucgauuaucuaaaaaccauaguacuuaaauugaacaguugcaaagaugucuuaauuguguaaagaauugguguagucaugacuuuagcugauacucuuauguacgagaucugucucugcuguuuaacuucauuggauuaaucagcugguuucaacucuacugcgaaacaaaaauagcuccuuaaaaguacuguucuccuucaguggcauguaguuaucuaaucaagacaccucauucaaacaaaaccugccuuaggaaaauuuaauauauuuuaaauuauuuuaaaagaaauacaacaucuuauucuuuagcuuucuuaaucggugcuuuauggaggccaguguaacguuacaugacucguugagaaaguugaggaauuuccucuaccaccuuuguugcuugaagaaaaacaugucuuuucaaaaugagaggcuuucauugaagaaaagaaaaaaacaacaguuaaaagcuuuuggcucucuguuucauuuuuuuccauuaagaaaaaaaaaaguccccuuuuaaaacaagcagggcugggugugacggcacaugccuguaaucccagcacuuugggaggcugaggugggaggacugcuugagcccaggaguucaagaucagccugggcaacagagugagauaagacccaaucuuuauuuaaaaaauaaauaaauaaauagccaaaaaaacuuaguguggugcuggugugcaugguagccccagcuacucagggggcugaggaugugguggcauuuaccugugguucugugguuccggcuacucaggaggcugaggugggagaacugcucgagccugggacauggaggcuguagcgagccacgaucgugucacgguauuccagccugggugacugacagagcaugaucuugccucaaaaaauaaacacauaaaacaaguaguacagcagaagagcugggaauggauuggccaacguuuacauuucaugguuaucuugaaguuccagguacagcagaugcugagccucugggugguuugaggccugguuggccaucagauauuuagcuucauacuuugccgcuguccuuaagggggugaguccuccaugaacaaagggaauagugacuuuuuccauuugacaguuuaagaauuugacauuuuauaaagaacagcaucuaaagaaaguuuauucugugauauuagagacagaagguuuucauauaaaugcaaguuugacaaagucagcaucuuucuagcugucuaaggaagagucacuuguaacacagccagccaggaggcugcuuuguuuuuuauuauaaagaacacuaacacaaaugcagcaugauugcuguaaaauaaaugugaaauuuguacaaaagucccaguccuuccgcaguucuagguuuacagucaggcucaaccuuacuugccccgcuccugcaugaaaacaagugcguuuuauacagccucugccacccaguggcauaguuuaaggcucuauauuauauuuaaaauuaagguuuuuuuccuaucauacacaucaauuuggaaccugcuggugacucuucuaccacagaggguaaauaaaaagaccaguuuuuaaaguaagaggauucagcucaucuuauaaaaguauaauaguuucggccagacguccauuaacaucuguuuaaauuagauacagacacaaugccaaauauuagaaucauaaauguaauuuuggagauaauguuuaccuugaguaggaagacacuuggaccauauuaaauuugaaagucuucuguuccagaccaaaaugggguaggcuaauucccugucauccaagcaacuaaaagguaaaaaccuuauaacuuuaaaauaaaaaagguuauuuuuuuccccuauaaaagacaggcaguaugaguuaauacauuaaaauuauuuuguacaucccugcuccaaacaaccacaaaaaugguacuuuuuaaaugccugcccauccucuccuggaaggggguuuuuccaagauucggggugacugauucaucccacagccccaggcagcaguuuauccuggaacuguccucuguucucccaucacugcugagcccugagaauugugaauggcccucagagcaucuaggccucugcaacaaucaggucucuggugacuugaaaugcagcaaugagggagcucagcuggaucuucucguuggugccaacagaaagccuguaccuaacagaaaccaaacacaggguaagaaaaaagacaccaaacacagcugccuuuucuuaagggaccaagagaucuagggcugaaaaucuguugaaggaguggggaugggaauugauagaacaaaugugcccuggauggcaaucuuguaugugucccccuaacauuuucuucucugcccuacacauugauuuauaaaugugauguuucaaacuuguaaggaccgauucaauuuuaaaaauuauuagguaucaggccgggcguggugguucacaccuguaaucccagcacuuugggaggcgggccaaucacuggaggccagccuggccaacauggugaaacccccgucucuacaaaacaaacaaacaaaaaacaaaaauuagcugggcaugguagugcaugccuguaaucccagcuccucaggaggcugaggcaggugaaucgcuugaaccugggaggcagagguugcagugagccgagacugcaucacugcacuccagccugggcgacagagugggacucugucucaaaaaaagaaauaaauuauuaggugucaacagcgguguucugaacuuaacuuuguccuaacuauacagauauacaaaauuuauguaaugaaggauuauuucgucggcaaaauacguuaagagggaaacaaaacagagauuuccuuccucuuaagccauuucaucgggaaguuuggcugauacauuggugggucuguggucuagucaguaaagcaggacacuggaguucaucucgccaccuuuuaaaugcccagccacugauagcaaaaucaucauauucacaaugcaaugaggagaggugaccuaauuugugccugugaaagccaaugccacaaauuagaguuggccuaugcugacgucuauguugaacccaaugcucugucuacuuaaaugauagcugccagcuucacugggggcuaauaacaguguuuacggaaccaggcaaagcagaaaauugaguuuguguuuacuuuuccccccaauaugcuuuaguaugccaaaaugccuuaauaacagcugggugguugaagcaaagcaggccucccaaauaacaagggcauuuucagaaucaaugugggccgagccugugagguccaaggagaggccuucaucucagauauguaacugaucuguacuugaccugugaauuuauccccauguucuuuaagcagcucacacccuuccccacauuccauucaauaucaccagacuagauuguaccguaugugaacgauuuaggaaaaaaaccugaaaccaagaaaguugaaacaaauaacucacaacaggggaaaaaaggaagaaaagaauuaaaacuggggcaagaaguacucacucaaugucugccauuuuggucaauaaauguauucgaacugaagauggaaagucaacugagggaaaaacaaaaucaaaugaguuaggucacucucuacugucaaaaaacccacagaggacaaaugaguuucaacaugaaauccuuaacacugaacuaguccugaggccucagccugcucacuagauaccagaccucuaagaaaguagaaacagugcugguuucauacuuuuuacccacucgauuuugugcuuuauaggguagacaaaaaggaaaaugagcagauaccaaagugauccuaagagcaccaaagaucacacugcucuuagcagcuggguagcucuacaaguuaacuugaaugcugaguucccacuugcuguuuuuauuuuauauuuuacuuuauuuugagacggggucucacugucuugcccaggcuggagugccauggcauggcgugaucaugacucacugcagccuugaccucuugggcuugagggaucuuccaccucaagacccuugaguaacuggggcuacaggugugcgccaccuugccuggcuguuuuguacuuuuuguagagaugcgguuucaccguguugcccaggcuggucucaaacuccugggcucaagugauccacccauuuugacuucccaaaguguugggauuacaggcgucagccacuauaccgauccuguccccauuuaaaaaccaagcacaaacaacugauuuuuuaaaguugguuuaugcucagcuuccacaaucaaggugcagagcugggccugagccaaccauaccuugggcagaaggcauggcaugggccagccaggaagaggccugugaaggccugggcagaaccaacauucauugacccgguuaagucuccaucuugcaguuggccacuguggaaggaagagcuucuccgaaagccuacacaagucaccuggggagcuuagagaauacggaugccugguuguccuccgagaagcugacuuaauuugucuggagugccccuaucugcugccaagguugagaaccaauucucuguguagaagguacaggcaaguguggaacuuaagauguuuuccuuaagccugcuuugguuuacaugguuuacauaucuucucuuucuuuucugggaauauauaucuagauagacagauagauagacagacuuuuuuuuuuuuuuuagaaaugugaauuaauauauacuacuuacugcuauaaaauauaaaccccuagaggaaauaaaguuagccuccaggaguuuucacuuuccccagcaguucuagauauuaaaagaggguuuauggaacacguuuuuuguguuuuguuuuguuuuuuuuuuugagacaaacucuagcucugucgcccaggcuggagugcaguggcaaaucuuggcucacugcaaccuccaccucccagguucaaaugauucucccaccucagccucccacguagcugggauuacaggcgugcgccaccaugccaggcuaauuuuuuguauuuuuaguagagacgggguuucaccauguugcccaggcuggucuucaacuccugaccucaggugaucugccugcuuuggccucccaaagugcuaggauuacaggcuugagccaccguacccagcucuggaacaaaauuuuaaacaguggcaagacagaacugcuaacaagaagggucugauuuacaauucauuaguuucuuugcuucaagaaugaagccuccuguccuaaccauccuuaaccccaaagcaggcuaccuucuccacagcuucucagcugggggauaauguaaguuaccucuaugcacaaacaaguguaucucugucaggauaucaugcagugccaaccccuucagaguuuucaacucuguaauaucuagaggagcaguuaaggcaaagggaacaaguuccagaacaaacauacugcagagaauuuugaauccaaacccgggcaagagacuuuuuaaaguaaggcuuuuaaucccaacacaacuguuucucuuucaacuugaagcugcacguguuggacuccaauucuuuauuuuucuuuguuucaucuucaguaagggcuuucugaaagauagaguuguaacuccuucuaguagagaauaaagccaacugcguuuucuuuuucuuucuuucuuuuuuuuuuuuuuuaagauggaaucucccucugucacccaggcuagaguacaguggcaugaccucggcucacugcaaccucugccucccggguucaagcaauucucaugccucagccucccgaguagcuggaacuacaggcacccaccaccacgcccggcuaauuuuuguauuuuuaguagagacgggguuucgccauguuggccaggcuggucuugaacuccugaccucaagugaucuaccgccucagccuccaaaagugcugggauuauaggcaugagccaccacacccagccccaaaugcauuuccaaaaaggcuuugugucaccauuccuagccuuucauuucacagcacaagagcuaucacuaucaugaccacuugaaaauuccugcaucuucaaugccaaggccuaagcuuuucucccaucugugagugaagcugcuucaagccuuacccugacuugaaggucagagcccuccaagaagaacucuggagugcuaaagacaaguacccacuccaccuacagacaucucacucccacaacaagcugaccagagucgccugcagccagucauccuuugccagcaaggugugggugcuggcugcaaccugaacuccuggggccaccuucaggucucgguggccaggaggucaugagaaaggauacuucuguaggcuguggugaaaucuugauucaacauccaguccaggauguuggcaaugucugacuugagcgggugcccggugcagguguagacagucuccucugucaccuucccaaaggccauauuggugcucuguguagacagagggggaaaggggagaucacaguggcugucacagcugccaccaagcugcagggagccaagaagaaauugccaaggcagcaaugcaggugagcagcaaaguucuaugggcacaaggcagugggaacccacauauucaauaccggaagagucaccucaucagaggaugccacagccuguuggcuauuccagugccaaauccuucccucccuuugccuucuuugcaacaaaugauuccuuuuguuuuuaaaacauuuucuuuugcucucucuuuguuuuuugagacagggucuugcucuguugcucaggcugaagugcaguggcaugaucauggcucacuguagccucgaccuccuaggcucaagucacccuccugccucagccuccugaguagaugggacuacaggugugcaccgccacaccuggcucaugauuuuuuaguggagacagagucucacuauguugcccaggcuggucuccagcucgugggcucaggcaauccaccucccucggcaucccuaagugcugggauuacaggcgugagccaccauaccuggccugcaacaagugauuuuuucaauuaaucaaaauacaaagugaggagggggaauccugcagguuaugagaccaaggucuuaccagcuguagauuucaaaauuuacagauugaucaugccuuugcuuaggucuuucuucaaaaacuauuacaaaacaaugacucaggauuugcugggaccaggcugggcaugguggcucaugccuguaaucccagcacuuuaggaagcugaggcagauggaucauuugaggucaggaguucgagaccagccuaaccaacauggcgaaaccccaucucuacuaaaaauacaaaaauuaguagggcgugguggcgggcaccuguaaucccagcugcucaggaggcaggagauucgcuugaacccaggaggcggagguugcagugagcugagauuguguugcugcacuccagccugagcgacagagcaagacucugucucaaaaaaaaaaaaaaaaaaggauuugcuugagaccauaccugcaaaauguucagagcccuacgcaugucuccacuggaaagagugacuagugcuuucauuccaucuucacuuauaucaacucugaaagaaauaagcaaaagggauuuaugaggcccccugagagcaccagcauucaccaaaggaacaagauggccuggaaugauuaaggcuuuaaagggaugaaggaaggagaggaacagaguuaauaaucuccugaucuauaugaucuagaauucacucugguuuuuagggaccugggcuucacauuaguagucacagccaaccaaaaucgagaacagccugaauuuaggaacaagcauucucccauggagccagucgucuugaauucugcucucuggggaggacagaggccuggcacaagccaugaucacacagccgaaacuccuccuucacaacaagcagcugcucaggucggcuacuugcuuggcaucugacuacacagaaugugaugucuuagaaccuucccuucuagucuaaaaaggcuggaagcaucuuugcagaagggacucagcagccugcaguuuccaaugacaaagaagaguaggaggaaauugggacagcuuccaggggaggaggauggaaucaagaaaaaugaaguaccaaaugacuuuuaugaggaauggccuugagacagcagagaaaaugauagcaguggacgguccccagugccuccccugugcuaggcacucugcaaagucguuuuccaacauuccucuccucuacauacgaaccagccagugaucccacaagccuguuucuacuacacuccauccccaaaggcccgcaaaauacucacuucucuucuuccacgacauguuccaggcggggaaccaugaguucaggagucaggggaccgaaccgaaaccucgugcagcgggacugcaaggcagggaugaucuuugacagauaguuacagaugaggcagaaucugguauuuucugugaauuucucaauuacuaguaagagaaaauaaaaccaccucaugucaaaguccauucugauuuuucagagagcccagaaaacuugaauuuuucuguggucacaaggguauaggaaaagauucaauacugcaaacaagugaggauguuggccgggcguaguggcuuaguggcucacgucuguaaucccagcacuuugggaggcugaggcgggaggaucacuugaggucaggagguuuggccaacauggcaaaaccucuacugaaaauacaaaauuuagccaggugugguggcacaugccuguaaucccagcuacuugggaggcugaggcaggagaauugcuugaauccgggagguggagguugcagugacccaaaaucauuccacugcacuccagcgugggcaacagagugagacucugucucaaaaaagaaagaauguaaacaagugaggcugcagccuaugacaagacagggcagugcuggccuguucagaucagagauuagccacuccucuuuuuucuuuuuugaaacagagucucgcucuguugcccaggcuggagugcaauggcacgaucuuggcucccugcaaccucugccucccggauuaaagcgauucuccugccucagccuccugaguagcugggacuacagacacgugccaccacgcccggcuaauuuuuuauauuuuuaguagagacgggguuucaccauguuagccaggauggucucgaucuccugaccucaugauucgcccgccuuggccuuugggauuacaggcaugagccacugugccaggccaauuuuuguauuuuuaguagagaugggguuucaucgguuagccaggcuggucucgaacuccugaccucaggugauaugccugccucagccucccaaaguacugggauuacaggugugagccacugcgcccugccuagccaccccucuuucacaaacugguaaacaugccuccgugggauuuuacaaaaugcuuccuuuuuaccauuugccaugauucuggcacuuuugccauguaaucccauuaagacuaugagacuucuuguccuuuuacauaaaauuauauuuggcagguugaugacacuucaccuucuaugggcagggagggcggcuuuuugcagacuuuuccauggagacugucuggaggccuuagagcacucaagggagcaauaacccgaacaaagaguugcuuaugacaccgguuccauucuguagguacccaauguucucacauggggaucugcccagaaugacagucacucggcagaacaagaugccgaagaaaggcugccaagcuucuaggaccagaagauauucucgcuguccuccuccuccuccuccucccccaccucuccuccuccaccucccccuacccuccuccuccgccuucuccucccccuccuccuccucacccccuccucuuccuccccuccuccccccuccuccuccucccccuucccccauccuucucuuaacaugugcugccaucuacucccucgccacaaacuccuaaagaucguucuucucucaaagcugauucacuuggaaucuuaaugagagaugacaaguguccuuuaagagaaaagaacugcgcuaggccccugaagacagacaaaucgcagggugcugucccucccgcugccaaaucauucacuuggcaagcagugaaguaauaucagcucucugagcaccucaacuucagauaugcuuuuccuagccauugugguucaaaggguaccauuaguagaaaggagaggguacuauuagcagaaggacuaucugauagcuuaaggaugaaagauuuuccacaccccaucccacggaaagauaugaauucccaacucugaaauugaacccagugucaaaggagguugaacaccagugacuggccagacuuaaaaguccccgcagggcuuagucccuaggcugcugaaggggaagucccgcuacagagguaucuagccugugucauuagaugggagacacagagaaaggcauagagauuucucugggccagaagaugaaaacugaaaacaagccaagccauaucucacauccuaauucuccuguaaucccagcacuuugggaagcuuaaaguuccuaauucuccuguaaucccagcacuuugggaagccgaggcgggcggaucacccaaggucaggaggucgagaccagccuggccaacauggugaaaccccaucucuacuaaaaauauaaaaaucagccgggugugguggugcaugccuguaaucccagcuacucaagaggcugaggucagagaaucgcuugaacccaggaggcagaggcugcagugagccaagauugcgccacugcacuccaaccugggugacagagcaagacucugacucaaaaaaagaaaaaaaaacucccccccgccuaaaaaaacaaugacaacagcaacaaacacaaaguuccuaauucuccuuccagugugcacaccagcccaaacgcuccacagugccucugcuuaccucuucucaaggcauucugggcguccugagucauggcgucugcuucauccaagaucacuagcuuaaagccuuuccuagaaaaacaaauggugcugucuaaagauuucuucaaucucaucucaacaucugggcucaaaccuauaucuucccauugugccaucgggcccugucucagaaagacaauuucuucuagaacuuuggccaaggcagacaucuuuggucacucagagaggaaaugccgcaucacuccuucaacccuuggugggaauggaggagacuucucuacuucugugcgcuguguccucuggcaucuucacuuuccuccacauggcacccuaccaugcuacugcuuuucccgucucccucacucaugccugagucccucacccuuuugcuuuuuuugagacuaaguuuuugcucuguugcccaggcuggagugcagugccgcgaucuuggcucgcugcaaccucugccuccuggguucaagcgauucuccugccucagccuccugaguggcugggauuacaggcgcccaccaccaugcccagauaauuuuuguauuuuuaguagagacgagguuucacuauguuggccaugcuggucuugaacccuugaucucaggugauccaccugccuaggccucccaaaguccuaggauuacaggugugagccacugcgcccggcccucacccuuuuucuuucuuucuuuuuuuuuuuuuagccaccauccuaguuguccuuccugaucucaauuuauuuuuaaauucaaacuagcucauccagucuuaggguaaucuagccaguucucaggaacuaaaaaugaaguuaaugcucccuaaagaacuugguaaugcaggcugggcucacguauguaaucccagcaguuugggaggcugcggcgggcagauugcuugagcucaggaguucgagaccagccuaggcaacauggcaaaaccccaugucuacuaaaaaauacaaaaauuaguugggcgugauggcucacgacuguagucccagcuacuuaggaggcugaggcuggaagaucgcuugaacccaggagguggagguugcagugagccgagaucaugcuacugcacuccagccuguacgauacagggcgacccugucuccaaaaaaaaaagaaaaaaaaaacaaacuugcuaauacaagcguagauaacauuuuauuuuaacaguugcauuauaacgcuucuuacuaccaucccucucguuuaucucuuuuccaugguugcuuuggacaaagucacuuuuuuuuucaacccauauaaacuggcuaaggagaggauuaaaaaauuaacccauaucaucuuacuaaucaaaaucaagggagcgaaauuacacaaauaauucuuacuuaaauauuguccuugugcuagcaaagcucaggaucgguccucgaaugaugucuauuccucggucaucugaagcauucagcuaaauguggaagacagaagacaaaacaaaaaccauguugcugugcuaucugugaguucuugguguuaguguauuuccucaucaguccagcucagcaggcuagcucucuaugucuaaugauggcuaagagaucaucauaaaauaaaaaaucaguuuuacacaaaauucacuaaauuaauaaagauggcuauauuacccccacccuuugaggacaaugacugacauaaauuggagaaauaauuaauugguaugguuacacugaacagcaccucugguaugagcagaaugauacaaauuucagcuaccacaauccuaaguuaccaaguucuuaauaaacugaaauaaggacauuaguagcagcaaaguucugagaccugcgucuaaaaaguaaguuaaacuuuucuugcaauagacaauacucagauuuuugaaucuaaguauauuagucaaggucccagcaauauacagauggcauacucaaaugcagcaauuugaagagaauuaaacaagaucuuuuuaaaggugugauauaggaaaaccauggggcuaugcaauaccugucacccuugagccugaagggcuuagugaagggaguggcuguaggcaccuggagagggcugcaggaaagguaccaccugugagauguacccuacaggugggccaugcugccagccugugucagcccccagggaaggcccaggcaucacucacuuccuucccccaccccugccaaggccccuauuggccaaacccaaccaggagccagaggguaagugagcuuauagucaguagggcucagccuuccaggcaggaauaugguggagaaacguggagaauugaucuagaggggccauggcagacaggcagcaaccaagucaccauaaaguaagguuuggggagaaguuggcaagagcaaagaaaaaggugccaaacccuacaacugcccucuagcugaccaacgcuaauccagaccaaaaugaccauuauaggaaaaagggaauuaaaauauucaaauuuacuucuuuccuaacuguccguggggcaacuuacuuuuaaaguaaaauaaaaccagcagaacugaaauuaagagacuggagucucuuaaguuauuuguagaguaagaacaaucuuauuuaccuccaagaccauggagccaaauucuuugucuuuauauagcuguuucgcacaggcuaggaugguagaugucuugccugucccugggggaccguagagaagcaaguguggcagucggucuucauugauaaacuucugaacugaggaucaggaaggaagaagggcaccaucagucuuugggagcugccucauucacccugggcuccugaguugggcugaaagcucuucaacccaauucaauguccaaaucagaggcagauacaacuugauguaggggccucauaucuacuuucguggaacaacuggaauucacucaauagcgcagccagucaacaaguauuuauugagugccuacuguguuacaggcaccuuucugggugcuggcaacaucugugaacuuaaaugauucuccguaaugcuauuuuuacuccacuguguugcaauuuuaugcucauguuugugacuuacccacuggacuguagcaaccugaagaaaaugaaugaaugaucuuaaagccacauucuacaaagcgcaaucagauucuuugaaguuauuacuuaggagagacaacaucaccaagcaauuuauacaagucgcucaagcaggacaagagcaacugacacaugaauacuuacugguacucagaauguccugaugagaaaugagaucauucagggucuguggccgguauuuuucaacccugaaauacaauuuaguauguauuaugacauauauaaaugcaagaauauuuuaugugcaaaagaauccuugcaggucaggcacaguggcucaugccuguaaucccagcacuuugggaggccaagguggguggaucauuuggggucaggaguucaagaccaaccagcccggccaacauggcaaaacccugucucuauggguaccuccuagggucuuuguaaggauagaacaacuaacagggugucugcuaacccgauaauaugccauucaauaaaaaauaccaaaaaauacaaaaauuagcugggcaugguggcauaccccuguagccccagcuaccccgaaggcuggggugggagaauugcuggaacccgggaggcggagguugcagugaaccgagauugcaccacugcacuccagcacuccagccugggcgacagagugagaccuugucuuaaaaaaaaaaacagaauccuuucauauccuaauuuaaaaaggaagaauaagaaagcacuuuaaguuugaacagaccagugguucccaaccacaggugauuuugucuuccuaggaacaucuagugauaucuagaaacauacuuaguugucacaggugggcagaggguccuauggcacucaguguguagucuccaggaaugcuguuaaacaugcuacagugcacaggacagcuccccuaaacccacccagaguaucuggcccaaaaugucaauagugcugagguugaaaacucuguucuaacuucaucuuuccagcuguuugccuauaaucucaaccugaugggcaccuacuauugcaaagugcauuugaaacugaacuccuacccaaauagacuucaacagaagaauggauagguaaaaucucuucuguccauacaauggaauaugauucagccauaacaagaaauuaacuacugauacaagcagcaacaugcaugaaccuugaaaacaugauccugagugaaagaaaccagacacaaaaggccacauaguguaggauuccacuuacaugaaauguccagaauaggcaaauccauagauagaaagcagauuagugguugccaggggcuagaggaaggggagaauggggaguaacugucaauggguaaaggauuuccauuuggggugaugaaauuuuggaacuagauagcgggaagacuccacaacaguacacugcauucugaauguacuuaaugccacugaauuguacauuuuaaaaugguuacaggaugggcuugguagcucgccucuaaaagucccaguucuucggaggcugaggcaggagaauggcuugaaccccaauguuugagguuacacugagcugugaucacaccacugcgcuccagcaugggcgacagagcgagacccugucucuaaaaaaaaaaaauacguaaauacauaaaauaguuacaacugucaaucuucuggguuuuuuuuaaccacaauaaagacaaauugaacuaguuacuagacaaugacaacuugcagcuuuucgaagccaagccaaauugcuucaaagucuuggaagcauugcgagaacauagcuguuuaaguaggaugguuaagaguacaagaucugaauucagacuuccuagauucaccuccaagccaauuuucucccuuggaccauagggaagucauuacaucuuucuaaaaugcaguuuccuccuguguaaaauuugaagcggugccuaccuccuacggucuuuguaaggaucgaacaucuaacagggcgucugcuaaucuaauaauaugccauucaauaaaaguugaccagggagcguuauuacuaguuuaaaaugugaccaauagucgcaucgcagguuuugaagagugggaagagggcauuuuggcauggaggccauugcaggcgucaggagacgcgggaucgaaccccugugcugucaccaggugcgaaagccgccuucuucuucggcaaauggagcugggggugaaagggugagaacuggcaaaagcccuaaacagaacggacgagucuggguagcuggggggugucgggggaaaccucugcaggucggucccggcugcaggccuggagacgacgggaagaggucggguugggguccggucaccugccaccccagccaccuccuccccgcgcggccgccuggcccccucugcccaccgccgccgcucggccuccuccuaccagggcagguuccugaucuuggucgccgcgggcugcuccugcugcuugagugcugaggucuccauggcggggagacgaaggugaccagauccgcugagaucgucgcgucacccaagcgccugcacagugaccagccgcgaccugacccugagacccuggcacuuacaguucgcgcgcaaaagcaacucucg

SEQ ID NO: 14446 - RNA, 10898 nt, Homo sapiens
accuuggauugucagucaauagaagcccuugacugauauugaccacuagacuuuuguauccagggaaccuaguucuucccuuuuucucaccucccaugccauauacacacaucaugccccuccccacaaacacacgaaaccagccuuaucucaccuuccaccauucccauccccaccuacagcugaucaucaaagguacacggaggaaguaguagacacggagcucaggccaaucauuaucuugagaaaucuaaacccagggcugucaggcuaugccccauaggccauacccagccugccaaaugguuuuuacauguuuuaauugaggaaaaaucaaaagaauaauauuucaugacaugaaaauucuauaacauucaaauuucaugucaauaaacaaaauguuauuggagcacagucaccucuccauuuacacaaccacggcugcuccuaugcaacugugacagagccagcuauuugcaacagagacgauguggcccacacagucaaaaacuuuuacaaucuggcccuuuccuaacuuugcuagccuuugauagagaggauuggauauggcugucaggggaggaacaggagccuuugauagagaggguuggauauggcucucaggggaggaacaggaaguuggagggggagagaacuuguuucagcggaagaaggccagcuugccccaagaugcagcgggcugccuccggaaguagagaacucccuguccuuggauaggguggagcagauguugacugcuuggccugugugauauggaggcaauucaggcccugaaggcuggaccaacucccuggacuuuaaaacucuucguuugcuaaggggggccauaauaacaaaaugucacacacugaguggcuuaaacaacacgaauuuauuccucacaauucuugaggcuggaagucccaagaucaaggugucagcaggguugguuucuggugaggccucuuucuuuggcuugcagacagcugcccucugaucgugaccucacguggccuuuccucugugacugcacauccccaguaucuccuccucuucugauaaagacaacaaucuuauuagauuaggguuccaacgcucugugauuuuauucccauccccggcuuucuuuccccacacugguucucaaucuugagucccgaaauaugcccucccuauccucauccugugccuaccuucacuucacccauccauccccugcaggcuggucuuguuccacugugccaccauauccccaagccccccucaccuccgugaggcuccuaggacugcugcagcaaaccaccacccacuggggccuacaacaacagauguaucaucucucacccaucuggaugccagaaguccaaaaucaaaguguuagcagggccauguucccccugaaaucuguaagggaauccuuccuggcggcuucugaauuccuggugcuuuccuggucaucauuggcauuccuuggcuugcagcugugucaguccaaucccugcccucaucaucucucugugugucccuaucuucauauggccaucuucuuauaaggacacgagucacauuggauuaagggcccacccuauuucaguaugaccucaucuuaacuaauuauaucugcaaagacccucucuccaaaugaagucucauucugagguacuaggaaugaggacuucaacaugucuuuuuuuuuuuuuuuuuuuuuuuguuggggacaccacaacuuauaacacccucuaagacauuuucucuugugccuugacugguccuccacuguagaacccaggugcccuugaagauagauuccccagaauuccuggucuacaaggucaggcuguugcugucaugcuuaccaagcuugccccaaucaacacgucccaucacugaauuccaacagcucuggaucucaguucuguggcuguaugggaacagccuguguguaaguggcuugucuguagcggacugucacuugaccccugaaugugccucaugacccuauccaaagcaguuggugacacagcaucugauuuuaucuauacucuuguucauugacaaaggaguggauuuugaugagcuacauuuugcuguuuccuuuuuuggcuuugccugugauguggggaaguuccuaggcagacucauguggccacucucccuggcucccagccucaccuccucccguaccaccucacccucaccugcacacaccugcaagggaaucacuuugaacuccaaggggagugacaggcagcaaaugucagucuggguccuggaauguggagccgcagugaaccucuguccucucuggucagugccugacuaugauauuaacccaaaucccagacucccuucucgaggcccugcaauccauacccauucuguuaccaguuuaguuuugaaaccaguaguggggcaggagguugauggaaaaucugcggucccagugaccuccuggacuugucuuaguagugccuggcacauaguaagugcucaagaaauguuuacagaaugcagacagagagguuugcuggguaagaguaagacccuggcacagggaguuagaagggcaccauuggcagggcuggaugguauugggauuccccuuugccagaccauguugugggugccauaucaaccccaaugaguuuguuuguuagguuuguuguugugguuuagaguuagagucuugcucugucacccaggcuggaguacagcgugaucauagcucacugcagccucgaacuccuggccacaagcaauccucccaccuuagccucucaaguugcugguacuacaggugcacaccaucaugccuggcuaauuuuuuauuuguuguacagacagggucuugcuauguugcccgcgcuggucuugaacuccuggucucaagcaaucccccugcuucagccucccaaagcacugggauuacagggcuaagccauugugcugagccaguuugccagguuuaauaucugugacguaugaagcgacccauugagucagguggcccaggaugucuaggaggcagaguaacaauccacccugaacagcccucauucacagagcacuuacuacgugccaggcuggaauuccuaugaugguuuggggagaucaguagucuuauucucguuccaauggggcaacugugguacagggacagaaaccagccuccaaauugcagacccagcauuuuaaaaacgagucuuugggcucauccauucccaggaacccaccuccaggucaagggguucauguccagcugcucauggggauguuacaaucccagccucugagacuuauuggcaacuuggaaccaggaaagagagagaggaaaagcaggaaguuguggaagggagggugcaggggcuggcagggaccauacugggaguuugcacggaagcuugaacuuauguucucaaacugacaggcugccagcagcagcccggauuuccaggaaauguacaucuggguuggcagagucccuccugggucccuccaguaucccugcuccaggcuuccuauccccuccgucucuccugcuggauguugcacuguggucccguguuccugagaggcguacaucagugagugcucuucccucucaggggugggaaagggcccuuccuucccacucauugggaucaugcagcucccauuuccuaacaccaagaauaugaaggauucaucucaugggguugagaauggcuguccuccuuccacugaggacugagcuggaggagauggacucugucuagaaugugccugaucuaaauaagaccuuguuucccaagcaugucccauagaccuuucauuccauggaaaacucgccggauuugcauuauugaaaggguccugggacaagcaugcauuggaaaugcuuagguaaaaugaaacuaauuucuugauugcaggacuuaucagaacuuuuaagacacuauugugugguugaaucucuaaaugccugauaggaggcuguucuucccaagcuuucccaggcuuguuucugaaucuccaacaaggucaaccucugugaaugagacuugauaccuuaccugguacugaaggaggcaaugucaauguacuggcccacagaaaagagcugaccacuagcauucauagacacugcuaggagaugagaaagguagcuuagagcccgauuccauccauguggacagugguuccaugaacaagaacaccacaucuggcugauggugucuuccaauggaggggucaaaucugcuguguguugguggcuucuccaacauaccauggcuuggaggccaaugugaaaaguauauaagauguaacacccucagaaggguuaaguuuucaccugaguuuucaucuucaaccaagucauugggauggugaucuagaaggaccucuaagaucuagaaggauaaagaucugguccaaggaguacaaauauguaauggaucuaccaccaguguccccugcuguacucuuggcagacaucacuaauccaucacagcaugccuucccacugaucacagauguagcuucagggcauucgaguuaccacuuaagauggauaugagugacccucccuuaucucacucuucuccuuucacagaagcaggaucugaggcccagagagggaagcuauaauaaacuccccuaagucaggucccuucuaagaggcagagguagguuuagaacucaggccucagaaacuuccagaagccaagccauuugggcuguaguugguggacagucuaucagcgcucugcagauguuucuucucaguuagggaacuuggaaaaugcagaaagaaagauucugucucuaagacucuguguaugauccuacucgguaaucugccugcuuggagaaaaaucauuuaucuucugggacggcuucaccacaaggccugaaugcuaugcccagucuaguaacagcugggcuggaagucacggcauaugggggccuuaaggaauaacagugugcgugguggugugcaggagagcugcaagggcuuuucuuucuugaggagguuuguaaaauuucugcuguucagucugggcuucugggaagucagggggugcugcauauaaagggcaggaaaaggagccugacuccaauugcucuuugguuucuucccugaauggaaggcucaaaaucaaguuuccacccagauaagaucuugagguccuaguggaccaccagcucuacuccugagcucuugaaauaccucuaaucaccagcucgguggcugagaguaccuucuuguccacugccucuucuuuuccuucucgucuucacuuaucccccauccaacuucugcccgauaauaucuccccuguauuguaaacugaggagaaaguugcacaauuguagagaugaaaaauagcugccauguauuuagcuuaaauuagcucagaagaaaggcucccucccuccauugagcgggcagcacuuguuuaugccaacaugcuauuugcaucgcgccuucuuaaauuugaaagucuaaugauuaaaaacaaaucuuaguuuuucuuuuccaccacuuaaaaaaaaaaaaccagcuuggcuaguucuucuaguuuaaaaauacccugaccuccagcacuacagugagaauuuuggaaaggcugguaccaggauaucaggaggaaauaaauacaggccaacaauaaccagaggccuuuucugaguggugggcgacaggaugaacaagguagaagagaggucuuuguguccucacacagaugcuggcauucuggguuugucuggaauucagugaaccucuguccucucugacagagauuucuucaccaaccauucauucagugggugauuuguugagcaucuacuauguguuagacccugggcauucagugaugagugauacaaugucucaccuguucugaagccuaaagcccaauggggaagagagacaagaagcaagucaaccacaaauauauaaauuugcaacucauguagaucuauggaaagaaaacucacgggggaccagaaacaugggagaggguauacugugggagagcugcugacaaaggucuuucugaggaggugacauuuaagucaagaucuaaaggaagagaaggauaaagagauguucauucuaagccaggguuucucaaccucaguacuguugagcuauuuggggccagauaauucuuugagguggcgacuguccugggcauuggaggauguuaagcagcuuccucaacucuccccacaagauaccaguagcaccugguacuggugacauccaaaaacauccccagacacacccugacuuugcugucuggaaucaauccucauaaagccccaagccuuggagcacagaggcuggaagcccauaugguggcaugucaggcauggugucaccugagcuucucugacccccacuucugauauggcauccaguuuggagucucuguucuccaugagcucccauagcugucccauauuccacaaggcauugcuucugggccacgguccucuaguuccagcauagcccuauuuuuggguauguugguggauuucaaaagccuccaguugacauccaaagugugacauccaaaaccaucuccagacauugccagauguccccugaguugucuccaggccacgcgacuaggauucaaauccagcauccugccaucugcaaccuuccaugggagaaaggaaaucagaggagaacaggaaaacacaaggaggggacuccuuaagugaacauugcagggaaauagguuuuuaaagcacuaguuagcaucaccagugguuugaaggcugucuagguaaggagaauguggacuugccuuucaccgucugcacggacaggggcugaaaucuccagucauucucuccauccuuccacagcccuucuaagaagcagauccucuugcugagcugaaaucuugagacuugcauccggcaaucuugguguugcuuucugaggcuacucagggaaagcccuucuguauuccccaggaaggaaagucucccagauagugaagggccuuuucuaccuuccuugcaauucccaguucacugugaagaagagagucaggccggguuagaauggcugucucugguagcaaugaagcaacaacauagacagucuggacaagauguggcaguucuguccagucccgugugacugauuugggcauggagacaggcagugggugaggauggccucuguagguccagcuguuuuaccccuagaaucaaaucccuggagcuuccggcagucccaggauugggaaggguaacagagaggacgagucgggcacugcaaaagaccagaucuuggaaaauugcuuugggaauugggacaccuuccaagaagacaguugaguuggcuggggcucugcccuagauggggucaaccucuccccaacacagcccugcccagguuggggcauuggcagcuuaagugcguccuggacaacaaauguaauguauugguccuguaagauucuagccauuuuccucugcuuauuuuucuacauguguuacaaguaauaauguuuagauggguacauaugaacuuguguaaguucaaguaacugcuauguagcuacagcaugggcaucaagguacucuaagguacuugcccugccacaccgaggcccccugccccggcccccuuucccuccuagccagccuucuagggagcacugcacacccugccccuucaaagcuaucuggacaguccuggcucgacuggagcauuaagggaggggcuguccuuggucaggcuucugcccaacugugugaugcauaaaucuuugccuggcuccuucuuccuucuuuucggaagucuaucuccuccugagggccucugcgguccuaaccuaucaaggaauaucauagauuguacuccccaccccaucaaaacacacccugacuuugcgucuggaaucaauccucauaaagccccaaggcuuggagcacagaggccagaagcccauaugguggcaugucaggcaugcugucacaugagcuucucugacuccacuuccaagauggcauccaauuuggagucucuguucuccaugagcucccauagcugucccauauuccacaaggcacugcuucugggccccgguccucuaguuuccucauagcccuauuuuuggguacauugguggauuucaaaugccuacaguugagcagccgaaggauucuaagaaaauuuugcuuguauuucaaaggcucauguccccagccccauucacuacacccucagcagagcccagcguggagcaaccuugucccuucauuccccaaaucuucauuuuauauagucauuuaguaaauauuuguuaagugccuccugugauucuggaaaaaauggagaaaagugggugcugccuucaggguacuaggaguccgaugaagagagggaggaguuccaguagggucccgaggccccacaggagcucccaacccagagaaagacccuccaggaaggauucucagaggaggagacuucugaacccugucuugaaauuugaguagaaugguagggaacggugugucagacagaaggaacagccuauguguggacucagaggcaagaucaugauuuauugaggguaacugcaaguggcuaaaauccugcccccuggcacuugccugccuuucccugcuuuccccaaagccugauuuugggacccuggagucuccaucuccaaacagagggugcccuggcucagauguggagaccuugacuucuuuccccagcaugcucugguuccuacuguuagccuugguguccugugggggaagaugucugaggagaguuuugugcuugcuggagucagaccaguacucaggccaccucaggccugcucugcaucccucucuggcucuacagaccucucucucucucucucucucucucucucucucucucugucugucugucucugugucugucucugucucugccugccuccacacagugaaggaugugucucuauuucuuagugcccugcauuggguccugaaguccaugggcaucuuggcuauagauggguuggccaugagcccuucucucuaaugcauuuuucauuccuguuccucuuuugcuucacuuucccucuaucgacucuugcgaccugugucucugaugucucuggggcccccaguucugucuugccauaccaaaaaaccuucuucagcaaaaaaccucuuucugggacaguucauaucacucuaugaauaggccccugaaguguugaggucaaggacaugugugaacguggaaauguauuuauggaaagacccuacacugagggucucuaacuaaacauuucagguaugaugggcaaaaugcugguuuguuacagaaaugacugaagaagaccuaggggccauagugggccacaggccaagccugcaauacagccugaagugugggaaagaauguaucaguccuguugauggagugguguguuugcugucucuauaaauaugucaggguuugaaagacagaaaacaaagcaucuuugcugaccgccagacucccaggguauauguggcuacugcaaauuagcgaggcuuguuuaucugcuucaacuugacucaauuugcauuucuugagccacugucuauuguggauaaugauuucaucaacacuuucucagcaucagcagccccuccagaguauuccuugaauuuucuuagcuuugugcaacccacgagcacuuaauauaucacuaacccuugaguuuauuggagggagugaaugaaauaaugaaugucaauaacguuacgcaauaccuggcacacaguaggugcuucaucaauguggcuuuucuucucaaucacccaaaugaaccucccccagaaucccaccucuagggggacauuccugaaaaauaagggacuagaauagcgaggugguggguguuacccauuuauuuagauauuuguguccuggugaacauggggagggaugcccaagugucauaaggacacccccuccccccgucuacaaggcagaggucucuuaggaugugagagagucucuggcaagaccagcccccaccccaccaaggcccucauagaaacagaacauucuuccucccuaucccaaagcagaaguugacuggggcagauaaggcaagucacauuacaucugugcccuugaccauaccuggaccaggcagagaagaucccagacuuagguggucaacguuuccaccccaagccucucauuucucgcucucuuugagacuugaucuuguaccaggauccacucgacagacuuaacgcaugauuaauuugauugauuacucuugaaguuacugaccuuaggaaaauuccucaauuguaaaaaggcuuucucuauauguaaauuaugcuguuaucuuuuucuauacacaaaguauauagaccuauaaauauuauacauauauauuauauauauaaagacuaauucuuguacagaccaacgcggaccgaugguccauauucuuuucuccauguuuguuugugucgacuguugcagagugaguugauguaagaaggugguuucauguuuucuuuuggggggccacuucuuucuuuuccuuuccguuucuaucucugucugucuccgucucugucucucucuuucucacuuguugccaaugucuuguugcugagaaggaacacucuauucagaugccauccaggaaagaaaggccagauggauggaggguccacuguguauauuuguacagaaucauuuauaaaguuuucuacacuucuaaaaaaaguauuucuaacuugggcuguuggacaguuugugugccucugagccagcaagccuguuguuucuuguguuuagugcaauguuuagugagaaaccaaugucugaauuauuuaugccaauaaaaaauuugagaauuacugca

SEQ ID NO: 14447 - RNA, 22540 nt, Homo sapiens
augaaaaugacuuuuggauccuccaccuaauuuggguguuuaugccgccucgccccucuuuuggccuggacaauugaaauauaucugcucucaggggagacgcccacggugucagggcuggaguuggcaagagacagggggaagaggacuagaccuggagucagagaugaaguucuugucugggaucugucacuaagucucagcggggacccaggaagucacuccaccucucauaguuccucauccacaaaguggaaauacaagcaaguuuaauucuccaucguaagguuggagcuccugucugugaaaggacuggaaauguaaaaugcgcucuucaaguacaaaggcagagaggauccauaaacaggcacaggcugcccuuugguauaaacuguucacauuaaaucuauguuauguugcucaagaguuaaaauaagcucaaaggagaggcugauuccaaugucaacccagggaagacagacacugaaauuccaaacugaguuaccaaaaacaauagauggaugagacaugcagacaugccacaauccggcacaucagaguucgauguaguccugcugcaaacacauggaauccgagaaguccaaugcaaacggaauagauuucuugggaucuaauauuuuucaaauugccugaccagcuuaccuucuaggaaaacuuauuuaagggaggcaaauaauuuggggagaugaguauaagagguaguaggaggaagcuaagggaaaucaccacuacauauugcaggaauguauuagaaggcaaauauggcccaaagaaaaagcuccacugaaaaaaacauugaauacugaccacagaauuagcaccuugcucccaggucaauaaagugaaccaaaaaaauuacaaagaccuugcucaauccugagguucgugaggaauauaggagaguuguguguucacgugacuccugaaaacaaagagcaguacuauucgaagggcaugaugucuugaucuuaggaucaaauauucuagaccuugagccggagaaucugcauuacaguaggaaaaauggggagugcuuuaugccuguggauucaggacacaccagcaaccuacacguguagcauucucuaagucauaaugaccauucucaucucccacugagggcagguguaagacucuucucuugcagugcucugauagaaagcuggguuucuucuucuucucuauaaaucauagggaaaccaaauauuuguaccuguuacagccccaaagcugaaagcaauaaagaauaaacacauacagcaagcuacgaggugcgucuguuuaggaauugccucaacguuggguuucuauugauagaacaggggaggagguugccucugaccuuccugaggcucccacuguacccuggcugaguagcccacaguuaauuuuaaguggcaaaagaaaugagaacaaauuccuccaggaagagaaauuagauuucugcuaaaacagugcucuccauaggguauaugagcacauucgacuaccacuggaaaauaaccugagggcaggcacauggugcccacuguuagaaaucgugcaguuagauuagaauggaagagugucugaguuuuuagauaauuuuacacgucaggauauggcuaacaggucacguucagggccuaugcuugauacugucgaaauacaaacaaaaauaacugccuagagagaauauucacguccuaaaagagaaaauguuguaucuggguggaagaaugauuuaacuccugaaacucgagaacacagaacaacaacaaaaauaauuuccuugaacauauucaacuagaauggcaaggcauuuuccuacauaaaacauuagaauguucccauuacuccaaaggaauccaauaaauaauuuuacagugaaagagccuggaucaaaacuggaagugacaccggcccccgaugaacacaagucacaggucccugugcaggucccagggcugagucauccaagaacuccaccaccaccgugagcccggccuccgguuucaucuuucccgaaugggacuggcuggaggggccaagcugcuuuacagaagaguuccaucugguaagcccggguggugagcgaagccaaagaugacaacacgagaaggggucaaagccaagguuuccucacgcugccuuugucuucuuccugcagccuggcccgauggcugaagcugggucccaggaggcgaguucuucagcggggccuccucacccaggcuggagcaaguccgcugcacccgucaagcggggaagagcucgggcgggcuuucuccauagcaauacuuugcuauggggucccgguagguguucucaugcugcacgcucuguuggcaaaaggaaaauaagagcgcagugagagcgagcacagcuucacacaccucccucucggaagagugagaguggaucgggacugucagacucucccugcagggggcuggccgaguccaucuccaaaugucacuaaaggcuccagggcacuuucuggaacaaagaagaaugcucaacccagaaugccaaugaagagcaugaacacagacauaacaucgcugugggacuguuucuuuuuauguacaccagugaguuuuuaaauaacuuugcugugaccuggugacucaagacaacuacuuuuccucaaauuacuugaaacagucuaagauccaauggguguuuugcaccugauccugagcuucacucaguucccguaaggaacccugcagagacacuaaggagaugcacuuuaaauugcuuucauaaaguuuauguaccuaaaaauuuggggcaugagccaaauccuacaauaccaugcaagccucauuuggcuaagcaaauuggaagugugauuuaaagcagacaaucauuccugauggcuaauuuuucagcaauuuguuuucauacaagcaacuuggguuuuuggcuagucuagaauucauuaauuaguccaagaccaaugcuaagcaacaaacuuguaaauauucauccaauuuaacagacauauagccaagucuucucuuucuugggauacuuuuaucaaaacaaaucaaauggcaauugggaaaucuuuuuaugguaaaaaagaccaaguccuaaaguauaguagcuucacugaagacuggaaauaauuccuggguuuuaucagugaaggaaagaaaauacuucgccuuuucuagcguuucucagaaugagagagaaucugaaucaaaaugagucauguguucagccuuccuccucauuuccuuuaaagcucauucaaguggaaagcucuucaagcaaaacaagaccaucaggaauuucuuaauguuuucaaaugcucauuauaaucccugaaacauuuacccaaugauacugaaugcucgcagaacaaaccagagacaugagaaggggcauaaaauccaaagguggacuacagaaaucuggcaaaggguacaagagcuuuggagaaugacaaaugaguccguuaucucagacgaagccaguaaaaucuuagagacaccaugaauaggagccagaagaagugugcuuguauaauaaacacgucuggugauuuuacaaagagagcuaugacaacugcccaaccacaauagcugagagccgaggagacagugaugaaaaggcaaaagacuuucagaugcuuucagcagcaggugcaauaauauuuaaugccaaaagagugaagcauuuaaugacagcacgcuaauauguauugagagccugacagccuacagauuuauucguguauuuuuaaacauucaccugccucauccccuugaauccuaaaauaaacagcgacuccaucccagaacaaauugcuacuuacucuaaacaagugguuacuggaaagccuuagucaaauuucaaagacagggaggagggccuucucuuagaagcugacuauuaggacucuaccagacuuaaaaauaauuuuaagcuuccacuuaaggaacaaauguaccaaccacauagaagagaugccaguugauuagaccuugauuuaauauaaaugcuucaccuccccuaacuuguauaaaucucacguugacauuuuaaauacuaucaucacaccaaacaaagcgugacacggcuucgagucucuucucccuuaccaccccaccaaaaggaucgacaguguguauuuucuaguuuccuucuaacccgucagcugccaucccacagcuagagacaucacagcuucugaccugagaugagguccugcauuuggccaggcacaacucaaagugaucuucgacugccaugaagagguucuggaaugccacggcugcccgguugaggaagcgcuccaggagaaguugcuauggaaacaaaaguuagugccuguaauaaauuaccuaagccagcacaaggugaccuuggcuaucucuccuaaacuaagagaaugcugauacagggaaggggggaagaggaggagaaaaggagggaggggaaaggacacacgcgugcacacacgugcaugccaaaacacccuggguaucuuauucauuagauaugugauuagcaauacaaugauccauucugcaaaagaaccauucaagcaacugggaaccaccuccuuuccuuagauaaaagcuauugugcagcaauuucugacaccuacaaagcuccuuucuaaguuuuauuuucagaggaaucucacaugaagagccuaaugcucaucauaaaacagaggccgaaagaaaaaaggagccgcagaaccaggaucaacuccccauaccuuguugggcugcaggcagcaggagacacaguacucauaggcgcugcagcagccguugggccagcagccaucacagcaguacugcuucgugcuagggacguugacauuacagcagccauuuaccagcaaauccuuccucucgcaaacguagccugaaagucagagaccaaccuuagcauaaaaccagcagccuugccaccucccuaccagggaugaccaugaagcagcagugaaaguacacagacagaagcuggagucuggggcaucauccuaagcaccggagagcuggaaacuggacauaaugugaguggggcuuacuuuccccaggcagucguuuccaggaagcaggcacuccccuguuaucgccaggcuacacgucggaaccuaccuacaccuacuguuuagucggcuggcacaugucugauuucaucaucaggucaagcuacggcuacguucuccuauucuaaccuaugcaagccaacgucucaucugugcuugaagaaaaaugucauucuuuuuugaacaaaaaguuuaaaacagaaaaaaaccgaggcacugauucacaaaagugagguccuucuagauuuaacaaacaaaccacucuuuacaaauaucuuucagaugcucgcugcauacugacuaauuuggagauuacaaaaauagaaauauucacaucuaacccuuauaaacugauuuauacguguacgugccacggacucaaucacccuuuggccuuugggaaugcaguucucuaauacucaagaaagaaaaaaaccucuuaaucccccccucaacuucuuauaaaucucaucaucuauauacacaugccccuuccaacccagcccauucauggccaacuuuagagaaaaaaucuucuuacaaaagcuaauguauuguucagagcugcuaagcagacauuucucuacauccuucugggaaugggacagaaaaauguaaggauagguccacaagggccaccacuggccccgaggaaagucccaggugcacacaugagcucccaggugcacguucaggcccacaggugcagagcagcugcuccccacaucacugcauuccaaacaccccagcuucuucauccucagagaaggagacuugcugaaguauaagguuguuuucagaaacuacuuuagaaaacaaagucuguucaaaagcaggaggcaccaguagaacaacaguaacaaagaaacuaaaagggcccucacuuaagacuugggcaaaugaggucuauagagaacuggguuccagauacuugggaaucggugccuuuugugguaguuguuguuuauguuauucugucuucuaaauuaagagaggaugauucuaaugcuauaguaaauguuucuugggauucuuccuauuucuacucauuuucuuuucagggacuagaaacaaacacaaaauguaauuaaguuaguuagcauuuuccucaaaauucugcucaaaauaauaaacacauagcaacuguauauaaugugaccuaaacucugccaguugaaauucucuuucugccuuuuacuuuucaucuuguaagugucagcaucucaggcauccuuuuuuuuccccacugccaacuuacaguauucagccuugaaaugcagcucuuucuagcuuggugaaagcaagcucaucaagaacucucaucuuguaucagacaucuacuaacucaaacguuaucuccaacaaggaguccuguaagaucacaaccucauacuguguugcuauugccuugaaaauuaacuuccagccuuugaaaaguuuguaaaugcaaaugaucuuauuuaauaauguguuaccccggcaauauucacaguggcaucugcuugcuaagaagcguaaguucuuacaugcuuucuuuacuaaacuacuuacuucacccauacucauggagaaaaauaaaaccuauagcucuuggauuuuuauuaauugauugauuccuucacuccuggaauuuuuuacucaaagaguccaagagucucugucuuacccaaauuaaucaaaagaauauucuuucacuagcuaugauaaaagaugacaaacugugcucacaacccagcacuaaaacauuaaagugagaguguaagauuucauguuuucucacugaaugucacacauccuguaagaagcccugaacuccaagucaaugucugcccacugacuaugucaucuuauggaaguaacuuccuuuugcuaaacuucacucugcuuauuaaaaaacaaaacccacauuauuuucaauaugauuugcuuuuucaaugugaucugaaaaauauagcuugucacuggcaucacugcugaguugggaaugcauucuggucagucaacaaguacauuucuugagugucaacacaaugugaauuuuacucagguuaccaagaaggaaaacugagcucuuauccuauagaguucacccucgagaugagaaaaaaagauuggcaagauggggaaauagugaggcuggggagagauugucagaaggggccuggggacugaugcgugacacagugcucauguuguaaguuguaggcagaaagaacuuuuaagaguuagaguuaucaaaacaagcuucucugauguugaagggaaccuugaaugaugaguaggguauagaagacaaaaaccuggggaauguuggagaugagcgaggagagaaaauguguugcagaggaaucccuauucaaacaaaaacccuaugaauggcccaaccagccuacgcuccugaccgccuggagaggaagggaagccagccucaccgaguucauccgugaugaggugcuucccuugaauggaguugcggcacugauugcucggacgacugcuauugcccaaguuaaacugcacuuuccacgggaugggcugauuauggucaugaaccuggaggagauuccuaucucucacugcccucuccuccugcaaagaaaccauaagugagaagguuaaguauccaguauccuuucuuacaauuucaccaguuuuucacagaaacuacaguaagaggacagaaauacuauaaaaggcuuacacuaccagaaucugcccucuccugguacaagcaaagccugagccaaagucauaaaauaaaccuguaggaaaaaguaauaagcuagugcuaugcuugaaaacuggcauacuuacaugcguggcuccuggauggcaugcacaucauaaauguguauaaaaguguuaauuuuaugaaaaaauuggagaggaaaaguuuuggacuuuuucuuucugauggcaaguaauuuaaaauauuuuucacauuaaaacaaauacauuguggaacagaacuuaaaaugugaauacacuuuuuaaagagcagaagaaacuuucgugacucucaucucagacaucuagagcacaaaaucccuuucauuugcaguuacagguacuuuggguggaagacguuugggaaaacgugaauuaggacauugauuuuaggagcaaaaugaagcaugucaacuugugaauuucuucugugaaggaccacugaguauguaacccgcuacggaacacacccaggccggccagcccucuacccggacaagcaauuggaagaguugcccuggagucaagaguugaagaucaucucuucuggucuugaagcuauguccgcuaggagccagcuuacaaaacugccuuuucuauacuguuuucuauacuguuauaaucuuuucuauacuguuaaaaaaaaaacuaaagaggaagcugccuaagugcuagaaaacaagccgagcuugagacggccucuucugaacgcuucaguaagcuacuggauaauaaaacaaugauggacuugaaacauucacuguucuaacggaguucuguggcuuuuaccuuucaaaauaaccugucauguguugcuuuuuaagcaaaagggacuaaucuugaaaauuugaugaagaagcuuauauacuuaaaaaaugguaaagaucuuuaucguuacuaaaauuuaucuaggaaaguaaucuaggaaguucuguucguauuuuaaaaauauaugucuacauacacuuuggcccaggaaacucaggucuguccuauggaaaacaccaauguauagggaaauacaaggauguuuacuacaugaucguuucgaugguauaaaaaaccugaaaccugccgggugugguggcucaugccuguaaucccagcacuuuggggaggccgaggcugguggaucaccuaaggucaggaguucaaggucagccuggccaacauggugaaaccccaucuccacuaaaaauacaaaaauuagccgggcguggugguagaauugcaugaacccagaagguaaagguugcagugagccgagaucacaccacugcacuccagccugggugacaagagcaaaacuccaucucaaaaacaaacaaacaaaaccccugaaaccccaauaacagagaaaugacugaaugaacacugguauaacaauacuguuacaaccaaacugagauacgacugauagcuauuuaacuagaguagcagcucuacaaacugacuuuugcacauuagauuaauguagggagcauaaaaacaaauucugauuccuaagcccaccuaugggcaggaaaaucuguggagaccugggaaucaguauuuuuaaaguaccuagaugauuuuaauacauagacaggguugcagaccacugcaugccuauaguguauuaucaagggaaaaagcaaguugcagaauaaugugccuaucacacauauuaugauaauaauuaugauaauaugcacauauaaguuuguaagagcuaagauaaugguauggaaagauauacaguagucucucuuacccaugguuuuacuuucugaaguuuaacaguuacucgcaguuaacugugguccaaaaauauuaaauaaaaaacugcagaaguaaacaguuccuaaguuuuaaauugagcacuguucuaaguagcauggugcaaccucacgccaucccauuccgucccgcccgggcugugcaucauuccuuuauccagcauauccauguuagucacuuaguagucacucaguuaccagguggaaaaacaguauggauaggguuugguacuagccgcaguuucaggcauccacugagggucucagaacagauaagggggaacuacuauacuacagacuacuaacaugggagggacguaugugguuauuaaaauuaucuuuaaucauuuugggaauauuuuuaauuuaaaauaaagugauaacauuaaaaacaggauuauuaauaacagaaggaaauuaaguaaagauucuguagaacuuucuauuauacuuaguacuuuucuggccgggcgccauggcucacaccuguaaucccaacacuuugggaggccaaggcgggcggaucacgaguucagaagaucgagaccauccuggcuaacacagugaaaccccgucucuacuaaaaauacaaaaaaauuagcugggcgugguggcgggcgccuguagucccagcuacucaggaggcugaggcaggagaauggcaugaacccgggaggcggagcuugcagugagccaagauugcgccacugcacuccagccugggcgacaaagugagacuccgucucaaaaaaaaaaaaagaacuuuucuguaaauauauaauuauucaaaaaauuguuugaaaaacacgauuaccaacauuaaaggcaaaaauuguccauaaucccaucaacuuaaauaaauucuauuucuuuuugcauauuaacuucuagcuuuugaccucaacauuuacacaaauuaggauguuuugcauucagcucuucuugacacuaauuggauaguaaaacauuuccaagucccuacauuaucuugauaaucacauuuucaaggccaucuaauaauccaucauguugaugugccaucauuuaguaaacacauccucuauagaucaauauuaggcccagguuuuuguuaucauagauaauacugcaauaaaauguggagcuuuuaaaacaauucucuugaauaacuuguaguaaaaugcuauguagugccaaauaaugucccacauuacaucuaccaccuguaauaguaccagcauuuaaauaacaguguuuacaauuugaccacaaccccaccaguagcggauuuuguucuuuaauuuaccgucuuucaagguggcuuuaauuucuauucugcucccucccuuuuguuucuuugcaaagaaagaacugguacuagcaggaccgggaggggggcgguuauacaaaagcaacaucuguauuccucaguuauugcaagaagaggagcuaggugcaggagcccugggaguaugggacaaaucacuuaggugcaugcugcuuaacuaccuguaaauucauacucuucugcucuacugggacccuaucaguuaacugcauccaucaagcuaugugcaaacuaaacugagcugcaaaugcuacccuagauaaauuaauagccauaaagauuauuaagagcuuggucaaaguacaguaaacuggauuuuacgacaagguuaaaagugcucuuaacauuacucccacgcuauccuguuguucuuccaaaagaaaacaagaguucacagucaagugcaucccagaaggaccccugccacaucaugacauuccugguaaacaggaaagcaauucucccagcacuucaaugcguuuccaaacacgaauauucaagaccuugccaaaaggacagugaaagcauguggcagaaauaacuuagcaauguuugcuuuuuugaaggcccagucuugcaaagggugcugaggacauuccuucacaggauagggagcuuucuaccuuuccugaacuguuucaccuacccuauuagguugucucaauuuuaagcuuuucuucauauuuauauuuuuucacucgaaauucauucaaagauaucuaguucuuacagaaugcuaaggaugcagagaugaacggcagucugguucuguauucgaagagccucagagcuguugagaaagggguaccuccauauaucagugcgaucaggcacugcagaugcugugacacauguccacauggggugcacuagguacaaagagaagagcaggagccaaaaguacaugagggcuuucuuccuaauuguaaagagcuacagaaacacacugugauuacuaaugcguugcuuugugucucacuucagaagggcuguauucauaacugugcuguguacuuuucaggaguuaucacaggucaagugagauaaaugucccauguaagcaguaaagcacggaaacauaaggcacucuuaugaaccucagaaaaagaggggagggggagaaaggccagaggguacuccaaaugucuaguauuugggaaauggcuaaaugcagccugauaauggaaauuuuuaguuauaaaaauccuauuuccaaagagcuuuuaaagauagggaaaugcuuauauguuaaaugaagaaacaguaugccucaacuauacaaacaagaaggaugaaaaauggcaggaagaaaauaugcccaaauaugaacaguggaugccucugguuagugagauuauggguaacuguuccucuccucuacccugugcaauacgagacaaacauucugcaauauauauauaucucucucucuuaauaaucagugcaaaacaaaaaaauccccaccaaauuagcaagucucauauuauaugauauauacuucacucuagacaguaucuaacuuggcaccaauuuacacacuuagcuccuuuaaggcugaacacguucguagauuuucaaggaguuaugcaaacagcccugagacuuucaggagcugcaccacuugaacacguaugagaacaucugguuacacgagaggaacucuaaggacccuucugacucccaagaugggaacuuguuuaaucucaggucaaaugccucgcauaguuaggcccgcccugccacuagaucaugucauccuguuuuguuuucuucauaacauacaucauuaucugaaaucauuuugcuuauuuacuaucucuccuccuuacccgcuaguggaauauaggcucuuggaggggagagacgucaucugcuuugcccacucugucucugccauccagcagaacagugccuggcacacaguugguguuauuuguuaaauaaaugcacccaagaaaccugguaccauucaccauucccaacccuccccucaauggcauccccaccaucaucacugauuucuucugccucccaucucuacaauuuaaguuaucccccauagcauuaauuaacaugaaaaccaaagaaaagaggaauucaaagcagcagagaggauaaucaacuauucuccaggcaaaagcugccgcaucugcgccaugaguuuccagucucaccgcagcggagcuaaggugcacggggagcuucacaguguucauagcgucuucuccaucaacgguacacacccuggacccguacacuccaucucaccaucuccauuuuacagaggaagaaccccaacucccucaaggcccacagcuagggaguggaagaccacccaaacugaggccagcugagcagggacggccaagucagacgcaugcaggagcgccucugccagagcacccaggacagcggggcucaaaagccuuugguccuggaacccuuucuaaucuuaaaaauuacugaggaccucaauauguggguuuaugugaguuauggcuauugaugcuuaccauauugaaaauuaaaacauaaauccuuaaaauguuuauuuuagaucguuuuuauucauuuaaaaauaacaacaaugaauucgguacaugaguuuuuugugaaaaaacacuuaaaaaaauaguaaggagaggggcaauguuuuuauauuucugcaaaccuuuuuaaugucucccucgauggaagacagcugaaucuccgaagcgaccucuauauucaauaucugucacaauauauugucuggguuggaauacaccaagaaaaucuauuccacacaaauguguaauuggaaaagggaggacuacuuuaacaacuuuugcagaaaauuauggauaauacuaaagcauacuugacacuaaauacuacaccagaauuugacagcugcagguuccuaaaaguucacugcacacagugcagccaguuuggaaaacaguugugcaguuccucaaaaaguuuaacacagauuuaccaucugacccaguaaugccacuccuaggaauauaccaagagaaauuaaaacauguccacaugaaaacuuguaaaugaaugucugcaacagcguuauucauaauaacuaaaagguggaaacaacccaaaugucucucaauaaagaaugaauaaacaaaaugugacagaugcacacgauggaauauuauucggacauaaaaaugaagugcuaauacaugcuaggacauggaugaacuuugaaaacauuaugcuaaaugcaaacgccaaucaaaaaagaccacauauuauagaaugccaauuauaugaaauaucuaaaauaggcaaaacuauagaaacaaaguagauuacugauugcuuaggacugaggggcagggggaagaugaugaugaaaauguuuuaaaacuacugguuugugaauauacuacuuuuuuauuuuuguuuuuauuuuuauuuauuuauuuauuuauuuuuugagacggagucucgcucugucgcccaggcuggagugcaguggcgcaaaucucggcucacugcaagcuccgccuccaagguucaugccauucuccugccucagccucccgaguagcuggaacuacaggcacccaccaccacgcccggcuaauuuuuuguauuuuuaguagagacaggguuucacuguguuagccaggauggucucaaucuccugaucucaugauccacccgccucggccucccaaagugcugggauuacaggcgugagccaccacgcccagccuuauuuuuacuuuuuaauuuuuuuuuugagacagucuugcucugucacccaggcugaaguacggugguggauccuggcucaaugcaacuuccaccucagguucaagugauucuccugacucagacucccgaguagcugggauuacaggcaccugccaccacacccagcuaauuuuuguauuuuuaguagaaacaggguuucaccauguuggccagacuggucugaaacuccugaccucaggugauccacccaucucagccucccaaagugcugggauuacaggcugagccaucaugcccagccugugaauauacuacaaacaagcguuacauacuuuaaaugggugaacuguaugauaugugaauuauaucucaauaaaacuuaccaaaaaacccaguuccuucagcacaauguggcaucugaaaccauaucaaugaauuuuucauaaacuguucagauccaugagucuguguugcacauugaacagaucuuacgcagaucuucuaauugacacauuuucauuauacaauacuaaaaaaaaucacacuuguuaauaucaccagggauuuaaucuuuagguguuagaaaguuacaagcuaagcguagcagauacgcauuuuccaaaauucuaauuuucacuugaaagcuuaaauauuaucauuggcaaauaaugucagauguuuucuguaaaguaacaagcucacuucauuuucaagaaaaugucuaccaaauacccaaaucugaauaacuaguguaucaguuguucuuucaagaaaaaauaguguuccaugaaaaaaaguggcuacuuaagcuugcagcucaauugccaaagcucuuccucaagacacccaucauauuucuguaggcagaacguacuguuaggcauauuucccauuucauucuacaggaaagauauguacuuggggaucaaaauuuagcaaaaguaauaauuuugacugcuuuauucuuaagugaaauuaguacuuuuuaaaaaaacuacaaguauggccgugaagaauacgacaacuaguagcacagucugcugccgcugcuuugacccuugcuaagguacuggcuugaccccccaugacuucugcaccaucaguggaagugucaacaaggugaaaaaagcaaauaacauuuugucguuauucugaaaagaauucuggccuugcagauccccugacagagucucaggggcccucugggguccacagaccacauuuuggaacccaguggguuagguuauuauaaaaaacuaaaggcugggugcaguagcucaugccuaugauuccagcacucugggaggcugagccaggccauugcuuaaacccaggaguuggacaccagccuggaaaaaauaaugagggcccauaucuaccaaaaaaauaaauuaauuaauuagcugggugugguugcccacgccuguagucccaacuacuugagaggcugaaguggaaggaucccuugagccuaggaauucgaggcugcaaagagcuaugacggugccacuuuaccccagccuggaugacagagcaagacccuguaccaaaaacaaacaaauaaacaaaaccaaguuaaaaaaaaacccuaagccucaguggcuucacagaagauuguuucuugcucaugcuacaagucuaacauggguaagccgagggguucugcucauccuagucccucaggcugaaugaggcccccucucagcacauguccuccacggucaccacggcuucugccugcaagugacaguucacauuguauaagccaaugcaggccacacagccacccuccuuccaaaagggugggagccaaucccaccaugcacccagaggaggaugaccaacuccuugugaacaacccugcuaacuacuaccccaggagaucaggcaaggacauaaugagucacugagugguccaguggagggcagaucccaagaucuaaaggacugcagcuuggcucaguuaguuccccaacugcugcuggagcagacauagacccagugcugacaaguauccugguauuucaagagaagccagaagaaaggauuuauauaaaaucucauacauuuuuaaucccuuuuuaaaaauaccggccaggcacaguggcucacaccuguaaucccagcacuuugggaggccgaggcggguggauuguuuaagcucagggguucaauaccagccugagcaaccuaguaaaaccccaucucuacuaaaaauacaaaaggcuggacgcacuggcucaugccuguaaucccagcacuuugggaggccgaggcgggcagaucaucugaggucaggaguucgagaccagccuggccaacauggcgaaaccccgucucuacuaaaaauacaaaauuagcgaggcaugguggugcacgccuguaaucccagcuacucaggaggcugaagcaggagaaucacuugaaccugggaugaggcgguugcagugaccugagauugcaucacugcacuccagccugggugacagagugagaccccaucucaaaaaacaaacaaaacaaaacaagaaaacaauaaaaaccaugcaagcaaaaccaagguuguauguuacccauuucaucucuaucaugaugguuacaaauugagaaugugggcuuuaaaaucagguggcccugaaucagagucccagccugagccaucacaaagaaacaguagcccuaagcacaaggaauuccuacaaagugacagagacauccaauaguaaaauggucaaaggacaugauaaggccacuucagaugcacaacagucaaauuaccaaaaccaguaagauguucaucuucaaccacuagucagggaaauauacagcacaguaauaaagauggggaauaaaucuguaagguuaucugaaaaaagcguuuuaaguguuacugaaggacacagaagaaggcaggauguggagggggagacagggauacuggugauccugacccugugaaggccuaggcuaacgugugugcucgucuuaguuuuuuucuuuucugagacggagucucugucgcccacgcuggagugcacuggugcgaucucggcucacugcaaccuccgccuccuggguucaagcgauucuccugccucagccuccugaguagcugggacuacaggcgcgugccaccaagccugguuaauuuuuuguauuuucaguagagacaggguuucaccguguuagccaggaugaucucaaucuccugaccucaugaucugcccaccucggcccucccaaagugcugggaauuacaggcgugagccacugcgcccggccucaucuuacuuuuuaacaaagaaguuuaaaaaguaauaaaacaaaauagaaaaacaggaaaaaaagcauauagaauaaggauauaaauaagaaaaauauuuuuguacagcuuuacaauguguuuguguuuucagcuaaguguuaaacacagccaaaaaguuaaaaaaauuaguuuauaaaguaaaaacauuacaguaagccaauguuaauuuauuauuaaagaaaaaucuucaaaucaauguaguguggcccuguguggacagcugacaguaguacacaguaaugugcuaggccuucacgaguucacucaccacucacucagugacucauccgcaacaacuuccaguccugcaagcuccacucacgguaaguguucuuuaugggcguaccauuuuuacucuuauauuuuuugaaacacagucucacucuguugcccaggcuggagugcaguggcgugaucucggcucacugcaaccuccaccucccagguucaagcgacucuccugccucagccuccugcauagcugggauuacaggcgugugccaccacaccuggcuaauuuuuauauuuuuaguagagaugggguuuugccauguuggccaggcuggucucgaacuccugacgucaagugaucugccugccucagacucccaaacugcuaggauuacaggcgugagccaucgcacccagcccauuuuauaucuuuuauacaguauuuuuacuguaccuuuucuauguuuagaucuauuuagauccacaaauaccuuccaucguguugcaaucaccuacaguauucaguacagucacaugcuguacaggcuuagagccuaggaggaauaggcuaugccacauagcccagggguguagcaaaaucaccuaaagaugcauuuuucagaaucuugagcgacgcaugacuauaaucuuaaaaugaagaugauguaucaggguagugaaaaggugguuguagggaaggugacagaguggacagcaccugagccaagaggugaaagguuagcagaaguaugccagacugaaaagaaacauucaucccaguuaaaaagacucacuuguuuguucaaucaauauuuggauucccaugaaguggcuggcaguauccuaggggcuggagagucuaugaacaagacagacaaggucucuguucucaagaauauuauagucuagaagagagagugaggcaagacagauaagcaaguaaaugaacaagaaauguucaguuugugaugccuaccacaaagaaaauaaagcagguuuaugagcaaggaauugaaguaauuuacaccgugucaccagguauggucugaagcaguaacagucugaccugaaaugacaaaaaagauucaaccaugcagagauccuggaagacaauccagaguuuuaucugagaauuuuaccuggggaaaugccaugaugaucccaucuuuuuaaagauuaucaccccuacugcggggaagagaagaagacaagaauggaagcagagacuugcagcugggcuacugcagugguccagacgagagaugccaguggcuuggccuagagugacagcagugacacucugaagaaaugagcagauucaggauacacucuggaggcagagccaauauuguggauauagggagugagaggagaaaaaaagaaugaaguggcuuuaauaccuggugaacaguaaugccacugagcgagacugggaagacucggggaggaacaagugcuggcagagaaucaagaguucuguugguccaaacacgaacacauucaacgucaacuagaaaguaggagggugguugccgggggcuggggaaagggagaaauggagaguuauuguuaaaugaauauuaaguuucaguuucuacaagcguuauggggauggaugguggugauggucgcacagcguuaaggauguauuuaauaccacugaacugcacacuuuaaaaaugguuaagauggggccgggcgugguggcugacaccuguaaucccagcacuuugggaggccgaggcagguggaucacuugaggucaggaguucgagaccagccuggccaacauggcgaaacccugucucuauuaaaaauacaaaaauuagucgggugugguggugcaugccuguaaucccagcuacucaggaggcuaaggcagggagaacugcuugaacccgagagguagagguugcagugagcugagaucaugccacuacacuccagccuggguaacagagugagacuccauguuaaaaaagguuaagaugggaaauucuggccaggcgugguggcucacaccuguaaucccagcacuuugggaggcugagguggguggaucaccugaggucgggaguucaagaccagccaugaccaacauggagaaaccccguuucuacuaaaaauacaaaauuagcugggcaugguggcgcaugccuguaaucccagcuacucaagaaggcugaggcaggagaaucauuugaacccgggagguggaggcuguggugaguugaggucgucccacugcacuccagccugggcaagagcaaaacucagucuuuaaaaaaaaaaaaaaaaaaaaaaaaaaaagaugggaaauuuuaugucguauuuuaccacaauaaaaaaaaauugaaaaaaaaaaaagauaucaacuaggcaauuggauauaagaauuuggggauuucuggacagaucuaggcuguuguuaucaacuacuggcaucaacagcauaccuccagagaucaccugaguauuuaaacaauggcccagagauuaccugagucagauagagaggaaggcagaggacggaguccuggcgcaccccaccacucaggggucacaagacagagaagggacaacacgcgacugugaggaggugucugagguggcagaaaacacaagucacagaagucugguagucacaugauugcccagacaucccggccaauaaaagggacuuacaacacucagccucucuguuugccuaagguggcaggucacguacaauucccuauucuucccuuuucacagcuccccugccaauccacuaaauguagagugaccacauaguuuuaucaauguucuauucacuuauauauuuuauuuacacacuugagcuuugagaguaaaaaggagagcuuuuuauaaccaugucaggacaacagcauaacccauuauccugggugcacccugggguguaaccacccuuucuacacaacuaagcacucaaccuggacuucuagacaaacuuauuaaugcuuuggguaagauuuccccacccgugcuccuugcuguuucucccagaaauucucacauggaagaaaaaugaaagggugcaguguguuggagggguggaauucuaccaaucaaguuaugcacaaaaagcauaaaaggaacuguggguccuuuugagucacccaggaggacacagagcccccaaauuaaacgaagggcacccaugcgagggcuggccgacccucgccaccuaugucuugguuucccccacuguaauacugggaaccccacuucucccaggccugcugcgaagaugaagccagcaaaugcacgcccucucuuagcucuggaccgggcaggugaaaagcagggagguguucauaaaagcaguccccaccgcugaaggguccucaacucgggguucuagucccagcucugcccuggccuagcaaccccuucccgcugcagggaccaaggcggugggcaggucccucacccgugcugagaccgggacaggaaugcgcaccucuccccacccucggacgccccggcggcgccgcugcagaagucgggaggucggacaaacgcgaggaguaaggaaaaagaggaggaagggaaggaaggaggaagaacgaagugaggaaagaggaugucagggaagaaagggaguaaaggaagaaggaagggagagggggacagaaaggaggaggacggaaggaggaagggaaggaagaaagacggaagggaagggagaggaaaaaggggaggaaagaagaaagggaagggggaggaaggaaagggggaggaaggaaggaggaggaaggugaggaagguaaggaaggaagggaggcagggagaggggaaggaaggaggaagauaaggaaggaggggagguaggaagaagggaaggaaggaggaaggaagggaaggggagaaagaaaggaagggaagggguaggaagacagggaggaaggaaaaaaggaggaagguaacgaaggaaggaaggagaaaguaaaguaagggggaggaaggaaggaagaagggaaggggaggaggggaagggcggccacugaccugcuugaaggugcugcugaggaaguagacgagcgacagcccgaagaccagggcgagcacccaccucuuccgcagaagccggcgccacaccauggccgccagguucaccaucccggcgcggacguggggcgcggcggccggggcgcggaacgcggcaggcccgggucccgggcggcauggccccuacgcgcccggcagccccaucccuccaggcaggcgccggccccgccgcccgcagcccagucugcucccggcagccuugggcgcagccccacgugaccccgcccuacgccccgccuccg

SEQ ID NO: 14448 - RNA, 1411 nt, Homo sapiens
uaaaaauguauagggcuccagcaacucuuuuccuggcggugucagugacauuuggugguaaaugccaucuuugcuuuuuauugggucguauuaccuaccucugaaaacauucacguuguuaaaccuggcguuuaggcuaauaauugcagugcguggucuuuaaauaugugcuuugugcaugaguuacuguauguauagcuaugugcccaggagaguacgaauuuguuuaaauauugagcaaagauuuguaaacagauguaaggcaauuacguuucaagcguagaauauaauuggaaaauuggcugaacgguuuauuuaauuuagccuuaaaaacacccaacuuguuuuaaguuguguacccuguuuuuuuugggggggaggugagucccuuuuggagagcaugcauuuuggaaauuauuuucuguaacccccgcuguagauagaagcauuauuucccucuuaauccuuguuuacacuggauaaauaauuuaguguucaaauuguaauuaguuacauuuaauuauggguggcauagaugccuuuuugcuaugagacuaauggagaaaugcaaauucucgccaacuuuucaaaugaaaguguuacuuuauuaaauguguuacaaugcagaccaaaaaaucaacacgugauuuuuaccuacaaagacauaguaucauugcucccacucuaguaaaaucagguaaauuuuuuuaaaugaaauauuuuaauccagauauuuaaucuuaaaauucauuuauaaguuggaauucuuucucuuaguauugugauaauuuucccuugauuuuuugguaugugggaguaaaacccccuuuugccucaacuuuuucccuccucagucuuaucauuuaguaucagucagguucagggacuuccauagauuagcaaacauauugaucaagggguauuuaaaaugguuuuugugugguuacuggugaccacauugacacuuacagguaauuaaaauaaccaaguagagcgaucucccaaauuaucauauauuaugcugacugguaauggcuguguauauacggauucuguagacaaaugaaaguauauguauagccagucuuuaggguauaucauuucuuuuaucuuuuuuuuuuuuuuuuaaagcuuaaguaaggaugauaacguuacagagauaaaaugcuugagauucuuuuggagaagcaauuuuguaggagaggauucuguacuuugauuuugaaugacuaaagguuuguguuugagauauuucuccccuaaaccucuuuaaaccaagggauugauuuuugaauaugcuuuuuuaaaaagaauuauuuuuuaaguagcaacuuugaacuagagaaccauagaaaugcuuaguugauuuuuuuuuuuaaaggaacguagaaugucuucauucucuuguacg

SEQ ID NO: 14449 - RNA, 6021 nt, Homo sapiens
ucuuugagccauucauuuaaguuuccuguuguguuuuuucuguagguacaguauaauucauaagacaguuuaaaaaaaaaaaaucagaaggccugccuuguacccgccuuguaccacccacuucaaugggccacaaccucccuguagccaaagccccaagcgcuguuuaccuuaggauuggaaggauauguacucgaggcuccaucaccagaccucccuccuugggcucagcaagucugcuacauccaguuggccucaggccagcuuccuccacuccuggggucuuuugugcuccucagguggaggugaucucccagcaugcucugcacggcucagucggaggccggggggccuggguuuuguuuccucagugucacccgucccugugggcuucuucaaaugaaucccuggaggacagagaaaugagagaguauuaaaaaugucagagacagauccugagauacacagcuggguaaauagagcugguggagauguuguuauuaguggcuuucuggucaugcucacuuaaguuauggauguaagguggggguggaggagaagaggcaugagggucuucuacccauuuccagaccugcucagucccaaucauccagcacccucagaugugggggcacucucucaguucugaggggacucaccauguuaggaaauuguauaccuguucauuaugccucugcagagaauuuucccuccuggugacagaaacauagagggccuuuucucuuggauuucucuaggaagccucaccccaccuggggaagaacugaugccacaucguuucucuggcaaaaccuggucaguuucauaugagaaguaggaaagggggugguauuuuugagaaguagaggauggaaacuucucugaucuauugucucauggucaauguucuaccaagucaccagaaaugaaagccaucccuaccacuguaaugcccaaagcaaucauuuugugaauacucauuaugugccucagagaccagaguugaaauucaggcuuaccaacuuguuguuacuugcccuugggaaaauuauuuaggcuucuguuuccacaucucuaaaauauaaauaaaauaguacccacuucauaaugcuauggugagggauaaaugaacacaucccuggaaagcaguuggcacaguaccaggcacacaguaagcccucaauaaauguuaguuacuaucaaugguagaacaccucuucccagaaagcauaauaucuguguuguaccaaaagacaggagugauaugaauaguauaguguggucuuauuuuuauuacugcauaauaaucuacucccaaauguaguagugucugggcucagugguucacaccuguaaucuccagcaguuucugaggggaagguggaaggauugcuugagcccaggcauuugagaucagccugggcaauaaguggacuccaucucuaaaaaauuucuuuuaaaaauagucaggugugguaccggcuacucuggaggcugggguagggauuaucgcuuuagccugggaagucaaggcuacagugagcugugaucgcaccacugcauuccagccugggugacacagagugagacccugucaaaaaaaaaaaaacaauguaguagcauaaaacaauggucaucucauguauucugugagucaaaaauuuggacaaggcacagaggaacugggugagcucuacuccacuaugucuagagucaagcgggaaaacuuuaaaacagcugggacuagaaaaccuacuuucaagugucuggugccuugacagggauggcuggaaggcuggaugcaggagggauugucagcugacauagcucccaguagccuacccacuguggcagccuagggguaguuagaugucucaccugguggcucaguggugccccagcaaguaaggcacaaguggcauugccuuuuaugaccuaacccuggaagguugcauugccuuuuacgaccuaacccuggaagucacauaguaucacuucugccauacuucauugaugaaagcaaucaaaagcccaccuagauucaaucggaagggucauagacucuauuuucuauuuucccaugagaagagugucaaaagauuuaugacuuuuuuuuuuuuuuuuuguaaaugaccacaggauuuacucugugccagguccugagcuauauucuuacuauauaugauugcauguguucuucacaaggagcuaaugaagucagaauuauuacuuucauuuucuaacauguacauaaggaaacugaggugccaagugguuucuugcccaaagucaaacagcuaguuauuugaccccccauguguugguaccauguugucugacuucagagucaauguucucauuagcccuauaguauugaaucccucccaaaauaaacagauagauagauaaaagaagacaguuagcuagacagacagagagauagauauagauauauagguagaugauacauuauagguauguagauagaugauagauagauagauagauagauagauagauagauagauagacagacagacauagaugccaagccuaaguuaaguugaaacccaaauucuuaagguauugcaggaucuuugcaaaucugaaucuauaccagcucucugagcaaggagaauucuuaggaaacuaaaauaacacaaauauaccugagaacacugacaaaggccuccuagguggugucuacaagaugcugaacaucugguuacuuccaaauauuuggaugauggacuagcagauuucauccaacuuuccuugcauuuguuugauaaacacagcuggcuugaaaauuagucguggaaucuuaauagugguagaauccuuagauauuuucucaucuaaaccccucuuuauacaaaugcaaguaaauguacacucauagagaggaaggguuccgagaaaguuaccuaccaaguggcuuugacauccuuauuucaacaugacuugaauaaaaucuauucugauuuaaauaagauauaucucaggauccaaaagucuacuuccugggaaaaucuuacacagaucuguauggugguagugguggaaaggagcuggaaacaacguagguauccaccugugauggcuaauaugacgugucaacuucauuagauugaaggaugcaaaguauuguuccugagugugucagugagaguguugccaaaggagauuaacauuuaacucagugcacugggagaggcagacccacccucaaucugggugggcaccaucuaaucagcugccaaagaggccagaauaaaagcaggcagaggaagauggaagaacuagacuugcugugucuucuggccuccaucuuucucccaugcuggaugcuuccugcccuugaacaucggacuccaaguuccucagcuuuuggacccuugaacuuaaaccagugguuugccaggggcucucaggccuucagccacagacugaagcugcacugucggcuucucuacuuuggggguuuugggacucagacuggcuuccuucuccucagcuugcagauggccuauuaugggacuucaccuugugaucgugugagucaauacuccuuaauaaacuccccuuuuuauauacaucuauccuauuaguccugucccuuuagagaacccugacuaauacaccagcucuauaggaaugaugcagaagcuguaaagaauguguagcaugaaacucuaugcauuaguuggaaauaaauacacacacacaugcacaaaagauaaacacauauauuuuaauauaugcauucagcaacaaggagaggucuuaaaaacaugauguugaauaaaaaaauucaaguggaaaguaagguguauagcucgauaacuuuuauguaaaucaagcacaugcacaaaaccauacuguauguuuuagaaggaaaaguacuuaagggcauauuucagacauguaaaggagaaugcauucagaugcuuucagugagugaaggagagagaugggagugggacugggaugaaagagggaacuacaacagauacaaugcaaugcaauaccauauaaaacaacagaacacaacguaauaaaaugagguaagggcgguacuuugcauguuaagaugauaagaugauaacauguuaucaaaugagaagcaccucuacucugcagauuagauuaaaaaaaucuauccuauaucucaguccaaugacaucgugggaaauagcaggaauuuuuuggcugcacacaacacuccugcuuuuggucaaaaguucauugaaugaagcugaagagugaaagaagcauguccuuuaaaaaucuuguuuucaucagcgauaaugggcuuaagccacaugugaaauauggcgcagguuucaccuuucagggccuccaggaacccgguuucccuuugccugucuccaggauuuacaucucagcgggugaucacacuguggucagcuagggagaucacuuuucggaaaugacaaaugaauuuccaucuuccgaaaggaaaggccuuuuuuccagccaucagacaugcuuucuggucggugccauccaccaccaauaucacagagaaaaauaagucauuuucauuuuuagcacuguuuaugcuuuguaaaaucucucacaauuaucacauaaauuguagguggauuagcaauuauugucccugcagaaagcgaguuaaaaaauaaaggcacauccagugaugugcccaaagucauacaugugucuuucaaaucccaucugagagcucucugauguauuauuucucauguaauaucuguacuucuacuauuacuaugaauaauaauuucaaugauugauuuaugccuaugugucaaauacuuuacaugaaaggugucauugaacccuccuauguuugacaugcuauucuaugcauuugacagacaagaaaacugccguauggaggucaaguaacuugcccaggauaacagcuaauacguggcaaggcugguauucaaacugugcuguucacuuccaaagccuugcccucuaaccacuguacuuugcuaccuagaucgauaaauccaauuauuuguguaauuucuuacagauauaagcaucuuguuaauuuauucaugcauucauuaaguauuuauuuauuaccuguuaugugccagacacugcgcuagucucucuagugagggauagaugcaugggugacaggaggaauagucaaagauccaaauucuagagucaacauuauuuaagccuggguuccccagaaaacaggcugaaacagagauauauguguuuuuacuuuguuagcagaugugaucccagggaacaaaugagagcuggaggagcagaguugcuggggagggguugcagggggaagagagcuaauacaagaauguguuguuauugaguaugccaccaugaaaggacagaacuauccaagaagccacugggaaugugccucagcucgucugccuugggagaaggaaaagcaaguuuucaucuccugcucacaucccuuauucaucaaaggcucauccaaacaggcauuaaauucccgccauuuccagguuacacacaggugggugaagacuugguucucugcugaguuccagacugugacaacaaaagcaaaaaccuggggccaggagcaagagguauacagagugaaccugagguggaacucuguguauugccccugcgugaaaucuggucagacccugcauagaaccagacaccaaacagcagcuggaaucaaagacagccaaggcaaggggaugggcagagugcaucagaggucucugaaucaaccacuuacccagcugaguucaagagccaaauauuaaauaauaauuuuuauuauagaaauaacuauauucguaugagcaugguacuugccacaaaggacaaauagauugcagacucuauauguguacacauuauacaaaauguuuuaauacaucuaggcaaccucaccaauccucaccgggaucacaugaaccaaguacggagaugaguauguuuccauagacagaugaggagcagagcugaguggugacguug

SEQ ID NO: 14450 - RNA, 4806 nt, Homo sapiens
augaaaguauauaaugaccagaauagucugguaauccagugaguaucuaugaugugcuaggcacugcacagaaaaguuuacaggcauuacugcauuuaauccuuucugcagauuuuauggggagaggguuaugaaugcacccauuucacaaauuauaaaaccaugacucagaaaacaagagcugccggaggucacacagcuagugaggaacagagcugugauuugggcccagguuaauuuuauuuccauuugauuccuucuuugaugaaaacugggagaaaucaguguuuuguuuuuccugaaaaggaaauugaaauaggagagaguuuggggaucuguauuaguuuucuguggcugcuguaccaauuuacuacaagcuugguggcuuaaaacaacaaaaaugauguguuuucucacaguucuagaggcaagaagucuggaauaaguaucacugggccaaaaucaaggugucagaagaacuucacaucccccaaaaccuccaggagagaagccauuccuugccacuuccaacuucugagccuccagauauucuuugacuuguaucugugucacgccaaucucugccacugucuucacauggccuucucuucugugucucuccaauuugccuuuguauuucuccuauaaagacacuaucauuggauguagggccuaccuggaugauugagaaugaucuccugucgagaucuguaauuauaucuaaaaagggccuuuuuccaaauguuacauggugaacauguuucgggggaacuagcauucaaccugcuacagcguccucuagcuaggaagugguagaagcaggaccuaauguagaucuagccacaaucccacauggauugcuuagacugcaucaauugugaaugacagacacccagugcaacuuaagcuuucugcauugcuguugaauagggggaggaggaaaugguggauacagagucacuguagcugaagaugccaaagguagacauuucuaguugcagacaucaucuacauuuuguggucagggcucaagccaucucuugggcaggcuuucuucacccaguaggugaaaugucuucuguuagcucaacacccacaguccucuaguguggccaguggaaagugacuucucuuuccauuaacucaagagaaaaagcccgaaaagcuuuggcccugccaaaaucacaucacccuggugaaaucacaugaucagcccuaaaccaaucacucuagccagggagaucauuuauucaauagcaauaauaaauauauauugaguacauucuaugugucaggaauucuucaagauguauaaaaauaccccagcaaacagaagacaaauuccuacccucauggagcuuauauucuagaggaaaauacagacaauuaacauauaaacaaauuuuaaaaacugucauucaaauucagacagagaguagagcuauguaauaaauuaauuagggcaaugugcuuaaaaauggccagaggugguguggacuccuuuagccgguaugaucaguuaagaccucucuguagaggugguagaugaggugcaacucaagucacgggaggcaaccguuuaaagauuuguggaagaucauucuaaauggaaggaauagcaggugcaaagacaguggggugggaacaaccuuagaggaacagaaacauggacaguacagcuugacuauaguccaugagcaggagagaguaugagauggaguacuucaguggugaaacugggaucucaaaaccaaaaugugauuuccaacccaucugcucuuuaacucuuuucuacacaaccuugcucaggagagguaugucuguccaccaagcauaggucuccugugcauugugucaccccucucacugcauggcuagaagauguucuuugagcagcuggaagauuguaaauaugacaccaucuauuuggugggugauuuuugcuccuucugguauaagaggauauaaguggggaaauagaacaagaguuaacaaacucuguaaggucucauuggaucuucacccuaacucaaacuugguccaaacaaaacucuuugacaauauuuaggugugaguaggggaguugauaaaugauguuuucucucuucucuucuuuuucacuuuuauacgccucuggguugaugguuucuggccaaggccagagguacuaaaauaccacaagaaaggagaacuuugaagugaucaucuguucagccaagaaggagguggugcugccugaagguucaccaggaaugcggucuucuggagcuuuagacagaguuccuaggaggcccccagagacagacagaugccuuggaguugauuuggagaaacaucugaacuucuggauggaguucugagccgagccugaaacccucugggagccuucauuugcucccagacaauccauggaaacaccuguuccaagucugagcugacuggaccaccgccuuugauuuuggaaaacucagagaccagaucuugaaucguccuuucagaauguacucuggaauuccuuguucuucagugcaaagauuuagauaaaguuaucugaccaugugaaugacagaucugagaaugugaugacuuuauugauagguccuacuggacaguuccuuggcccagcagcaucagcaccuccugggaucuugcuagaaauacuaaaucucaggcccuaccccagaccugcuauuuuagaaucuguaauuuaacaagaucccaguuaauuagcaugcacauuccaguuugagaaaagcggcacuaaaaagcuuugucaaauaggcagugugcucccauuucucgguauugugccugugacaggcaucaauaaucaaccagagaaucacuuccuucugagagcagaauauucucaagucaugguuucaggucgcagugaccaaucaaugggaguuggaucaaaauuaaaccuaucuuccauacuggugucaacacuugaagaaagcucuuuuauuuccacccauauacacaucauacaugccugauaaauguuuguggaaugaauguguuuuccccuagccuuguuuccugugauauucacacuauuccaguccauacccacagaaaaucagaacuucacugggcaucugggaaguucagcagcuguucuagguguuggauuuugcuauuggccaugacccauuagaagguugaggugagguuggaaagauguuagggauggaaugaagacacuugggaacccaucucgcuguggcacauggaccucaaaccaugcaaguuuucuuuuuucuuucuuucuuuuuuucuuuuucuugagauggagucuugcucugucucccaggcuggagugcaagggcgcgaucucggcuuacugcacccucugccucccagguucaagcuacucuccugccucagccuccugaguagcugggauuacaggggcaugccaccaugcccagcuaacuuuuguauuuuuaguagagacggggucucaccaugucagccaggcuugucucaaacuccugaccucaggugauccgcccaccucugccucccaaaguacugggauuacaggcgugagucaccaugcuuggccgcaaguuuucuucaggacauggccccauguaguccagcucuacaagguggcugcugugugaacuaggcuacaugccgaaacgggacugucgggggaaucagcagggggggcagaccaacagcccuguaagacauagcaauaaugauuauaaauagcauccuucugaccgccuuuugauguacuguccaaggccagguggaaaaucuuuccuccccugccuuuccccacuaaucaccuuccccucauuuuucaauaaagauucugagcccaguccguugcuugucaggagcauuuguuucccauuagaauaccuuuugcgauuucgguuuguuaugcuagauaauugcuuuaauaacaaacugaggaaagacuuuugaacauuuuaggaaguagcuuuuuuuuucuucagugaaaauuaacagagacugacagagaauuugggaauagugaaagagaagaaaagagggcuuggggagguggggguuuggggaaguucaaccagugggcgcaggugaagaucaucagcaggcagagaauugucaggggcauggaugcuugugaauggaaggggaagcuuaaauauuuggcaggcuugucgggggguaagcgugaagcaacguuaccugucgucggggauaagcgugaagcaacguuacuuguugaggguaagcgugaagcaacauuaccauuuugucuuuccugugauuaaaagggauagcguuccaggguauguguugucuuccccccguggugggaaaugcauuugggagucauguccucauagaauuugcccaucauaccuaggaguacccaacauauucugugugugagugauuaaucaaaacaugcgaaauggcugaacaaauuuauuuguuacuuaacaaacagaaacaagagugcuaaguauccuaccuaaucgcucuucuacauuuugccauguuaaaaaaaaaaucaagaauggauaacacuuauagaguguuuacuaugugccucaaacuggucuagccccuuuacauauauuaaugugcauacacuuugcagccagcucauuuuuaucucuauuuuguggaugaagaaacugagacgcagagagguuaagguuaaaaaugcauaaugaguaaauggcaaagauauauuugggugcuggaagucuaacuccagagucuauguguuucagccucuccauguacuuugucucagugauaauugcagaaacuguaguauugggcuac

SEQ ID NO: 14451 - RNA, 1070 nt, Homo sapiens
gaagagagggaggaggaauucccugccuuuuugauuaaacgucccgggucgggccugcccaguuaacgagaccguuaauuaagccgagcacgauucaacugacaggaaggcccugcgccccgcagagauguucuggaaaccaagcaauccacggccuagcgccaguggggcacaccagccacgacgcccccgccucccaggguuccacccaggccaggacacucuccccgccugggcuccgggccgcucucagacggccacccccaaggguuccccagaaaauucaccaccaccccccacccaccccacucccacccccgccaucccucucgcaucccugcccggaugucuaggccugagcacccauugcaccccgccggcguccucucuggcccgccugggagcgcgcggucccgagguucucgggcaaacccgaacugcggagggcagaggcugggcucgcugggucucgccggagcgccacaccagccgcucuccuccggccuccagacagcggggcucagccuucacgcccgcuccuacucgggggcccgauuccuuccggcggcgggcggugcucugcggcgcugcgggacgcugagugugugugcgaggcgcggccuauauuuacaccccaaacaaaauaauuacacuuuugucggagggagaaagccagugauuaggcguaggcucuuugcggcaaaacaguuucucagugguacaccaguauaauuuuucacggcuggcugaaaucaaagaggggagguaaugaauccggcgagcaauuuaaauuuacaauuuguaacgccgccgccgccgcgcagacccggccgagagcgcagcucggaggcgcucgcugcguuuguuuaauguuaaagccgcgcuggcucuuggggguggggugggggaaguaugcguguuggggugggagcgguaaugaucgaagucgggagaggacgggcugggucgcacaagaugccaccaagagaagugggcaaagcgcgcgccucuccgguccccccagccaccugggcccccagagcgcgcguuucccaauaaagcugccacuc

SEQ ID NO: 14452 - RNA, 10977 nt, Homo sapiens
uccagccccuccaggggucucuugggcuaggagagcacagaucgguaagggguccguccucacuugggcaaccuauuugucaugcccagcuguuccuugagcgcccgcagcugggccaggcugauguugcugcccccgcagacgaugaccacgagggauggcagcgggguucggagauuccccuccaguuggagcuucuggaucacguggcuauagacagcggccagggcugccccgcaggcgggcuccaccaggaucuucucaucaucugccagagaaggggcgugacaggggcguggccugaguuucccagggugcacaggagcugacaggccauuggcaggaccugggaauacugagccaaucagcucucagcccuggcugcagccgcagguccugaaccaaacgucccgucaucggccugaauuggcccuuccaagccugagccagggccuggguuucaucaugagugcuaacacugauagaaugagugugguugcgugagcacuguguugagaaggauucugaggcaucaucugagcaagaguuccaugguugauuagccaagugugcagcagguacagaagcauaaaugguacuauuuuuuucucucuuuuuugccaucccugcccuagacggaacccagaaagaguccagccuaguuacagacucaccucugaaugaaucaaacucugagccccauguuuuccuuuuuuuacccuggcugccaggaaacucagaagcaacauuuuaaauauucacuuauuguuuucugcugcuaugguuaucaggcuuacuuuucuauuuacuuuuccauuauguguggcuuuugcuuuucuauuucuacacggcauuguauuaucuucuauuaauggaaaauucuaggcagagguggaagacagaacugugaaggaaacuuggggugagugggauccccaguggcauaccaaguggacagccacuuagcgccugagucagcaggucaggucaugggaggaccuggcacauacccacgaacuucucaauggcggccacagccuccugguccgagauaacuucagagaaaaugggguguuccugaaacagcuucagggccugagcccccacagucuucacgcccagggccuuggcaacacugagagaagugggaacccagaagaggaugggagugggggaaacaggagagagaugggggcagggagggagagaaggagauggaugugagacagagaaggcaaugcaucugggggcagggggacagguaucaccucugcagcuguaaaacccugaaaagccucagggauccccaaaccaaguggggucuucuaauaaggugcagaguguuugaauugacaucauauaguauauucuuuaguaucauuuuuuuaauuuuuuugagacugagugucacuauguugcccaggcggguuuuuguuuuguuuguuuuuuuguuguuuuuuuguuuuuuuuuuuuuuuagacggagucuugcucuguugcccaggcuggagugcaguggugcgaucucagcucacugcaaucucugccucccggguucaagcaauucuccagccucagccuaccgaguagcugggacuacaggugcccaccaccacacccggcuaauuuuuguauuuuuaguagagaugggguuucacuauguugaccaggcuggccucgaauuccugaccuuaggugauccaccccccucggccuuccaaagugcugggauuacaggcaugagccaccaugcccgaccccaggcuggucuugaacuccugggcucaagugauccuccugccucggcacagcgucauauucugaucaacacuaagucaggagcaaaugccuaagaggacccuuguuguucccugcuaggacucccugcuuuugcuccggguuacaaccgcuaccugguuaacccucaugaagcuuagcaccacucugccugcccacauccugcuguguccuucaaggcucaggauuaaggccaccuccuccaaggaguccuccugggagaguacugagucccacggcccuauguggaauucucaaauaguccucccugcuaguaacaagcgcccugaguacuucuugagaaaguguuaggugccaagcacuucacaagcauuauugaauucacacaagaauucugcuguuguuaauugguuugauuuuggaaaggggaaacugaggcagagaguguacagucacuugcccaaggucacacaccuagggagugcuggagcuggggcugcaagcaggaucuguauaacuucaagaccugcacugguaaccaauguguugacgcuguccccagcuuccuggggugaccacuagcucuauucccagcucagcugcccccucucccuuccccaggagcaucuugagggccugagccaccucagcccucagcagcacgugguuuacaguaggcgcucagccaugacgucuucagucccuacagugugggacacagcagcuccagaugccaggcucaggaaucuggaagaaguucuuaccuggcugggcucagucuucccuaucuguaggggagacuauugucugccccggugucuuuucuagcugcacuuaugggcaccugguguaaagacauuucccagccucccuugcagcuggauguggccaugugacuaaguucaggccaacgaaagguaaguggaaguguugugucugucuuugaagguuggagcauagccuucugcccuugcuuccccaucccugccaaauggaaugugggugugauagcuggcacucaggcaaccauuuuggacugaaacacuacaugcuaaggauaauggggaaacaaacucaagggaccuggcgcccugacuuuucaugguaaaguucaaucucauuuaagucacuguuauuugggccuucuguguaauggggucaaaaccuaauccuaauuaaauacuaucuaccagccgggugcgguggcucacgccuguaaucccagcacuuugggaggcugaggugggcagaucaccugaggugaggaguucgagacuagccuggcuaacacgguaaaaccccauuucuacuaaaaauacaaaauuagccaaguguuggggcagacgccuacuccugaggcugaggcaggagaaucgcuugaacuugggaggcagagguugcggugagcugagauuguaccauugcacuccagcuugggcaacaagagcgaaacucugucucaaaaaacaaagacaaaaacaaacaaacuaucaaagguuuggggcuuggauaugaacuccuuaggagcaagacuuguguuuaugcaccacucucuccccagaucagccagugucuuacacacaauaggggcucaguaaaugguuggcaaaguaaugagguauguaaaaccuugccacagaggacucaguaaaugauuccuaugagaccuuccuuccuuccuuccuuccucccucccucccuuuuuccuuuccuuuccuuuccuuucuuucucuuucucucuuuuucuuucuuucuuccuuucuuucucuuuuuucuuucuuucucucuuucuuucucuuucuuuuucuuucucucuuucucuuucuccuuuuuucuuucuuucucucucuuucuuuccucuuccuuucuccuuccuuccuucuuucccucccucccucccucucucccuuccuuccuuccuuccuuccuuccuuccuuccuuccuuccuuccuuccuuccuucccucccuuccucccucccucccucucucccuuccuuccuuuuucuuuguuucuagacagggucuugcucugucacccaggcuggagugcacuggcaugaucauggcucacuacagccucagucuccugggcuuaagcaauccuucccaccuuagccugggacuaugcgugugugcuaccacgcccaguuaauuuaaaaaaaaaacaaaaaacuuuuuuuagaggugggaaucucucuauguugcucaggcuggucuugaacuccuggccucaagugaucuuccugccucagccacccaaagugcugggauuacaggcacaagucacugugcccagccucauaugaggcuuuucacgugaggaagugugacauguuggagucacacagacuuggguuugaguccaagcuguaccacucacuggacguggcccugggcaagcgaucaaagccuccauugucucaucugugaaacaggcugacaucaggaucuaucucaaagccagcccuaagggggacuccccagugcuugcuggacacccgagggaggcaccccagcugcucaccuggugaucuugggcagggagacaaguuugccugcggugguggcagcguggaagcugugggcaccaaaagucuccauggcgaugacaggcacguccccccagcccaccuccugcagccccuggaccacuccacacagcaggcccccgccgcccacugacagcgcgauggcccccggcuuuucccacagugucuccuucagcucuuucacgauggaagcguggccuucccuggaggguggggagaggggguggcaggucagggcuaggcuuccuggagacaccagcucagguuugcaccggccuuaucccagcugauggggccuggagcuaguucccuccccacccccaaccuuggcuucuagcugccagcaucugugucucugccugaggaccuucucuggccaccugagcuaccugcaaacagagucaggagauggcagccccuuaaggcagcccucaaccaauggcuacgagucgguguacaaacuccccugcuccuucucccagggggcgggaaacugcugugcgccuucugcacuggcucccaggguccccgagggauuaagcucuagccacccacagcggccaccugccuuugaaagcccccuuccugacauuuuggacuggaugauagaaaaagaaaaaagaaacagcaaagcccccuuccuucccuggcuuacuuccccacucccccacugaaucaccucccaaauaaacuccuuucccugaaaccuuuguccccaagucugcuuccaggaggacucaacugcagacacuugggcaucugugugcuugcauguucagccuuggguguguugcaugugcagccguggauaaugggcauuuggugacaugugugcacuugcugcugcaccuggguguaacguguguuucuucuuuuuuuuuuuuuuuguuuuuuuuuuugagauggagucucacucucuugcccaggcuggagugcaguggcgugaucauggcucacugcaacuuccaccuccuggguucaagcgauucuccugccuuagucucccuaggagcugggauuacaggcgugugucaccaaguacagguaauuuuuguauuuuuaguagagaugggguuuccccauguuggccagacuggucucaaacaccugaccucaagugauccucccaccuuggccucccaaagugcugggauuacaggcgugagccacugugccccgccuaagugugcuucuacaugguggugugcgcacacaugugcagcugcugugcaugaggacgugaugaugugcaucauagcaaugccugcccagugauauagggcaguggcugccacccccaccaagugaccuugaacuccacauaccagaugagggggucaucaaaggggggaauguagacccaacccggguuguucuucgcuagggccuuggccagcucgaaggcuucauccaauaacugcaaagccacaggggagauaggagggggugaggcacagggggcacccuguccagccaccaggcgcccucucucuuccuugcccugggucggcacucaccucacccaccaccuugacuguggcaccuucauucuugaggcgcucaauggugagagcagguguggugcugggcaccacgaugguggcggggacgccgaguugccuggccgcauaugcagccgccaugccugcguugcccgcugccagggucggggguggagagcgugucagugcgggagcaucugggagcccaggcaggacugcguacccucuacugggggcucuggaguuccccccucaccuccccacccugggcgacugcuggccucccccuggaauuccaaauugguggcugcugccauuguuuucaguggcacauugcuggggaaaccagggcucagagaagcagagugucugaucccaggacacacagcagaggacaggauggggaagcagaucacuuacccgaggagcagacaaaaugugcacagccuugcuuggcccacuguggagacaacaggagaggcacucaggcccaccucccagucauugccugugcucuuccuccccaccuggaauaccugccaggauuccaguggacacggacguuuccuucacucagaauuuguucuacccuugucugagacugcaccucccaucuccaaagagacuggcucaggaaaggguggaggaaaauaggcgacugauggcucugggaucagucccaaggaacccuccuggaagggcaccccucaaacagaggaagcccuaaugguggacgcucaguccuugcggggagucaguaggcuuauccuacaacgccuuuaauuucacacagcacuggcccugcccuguugaggaaggaggaccugccaccccugcccagauaaugcugacccggucccguacccucuugcagaagugcccaaugccccggaucuugaaggagccggagggcugggcacuguccaucuugagguagacgcuggugccggccauuuuggacagggccaugcugucacggaugggggucuucacgugcagggguucuccagacaucauuccugggagaaaggaaggaaacccagaggguuaggagagcuagccccggugccagcacugccagagugaucccuuccuucgcuucccagcaagccaagcaaggccucagacgagagagcauccuggagaccugggcucuaaucgcaagugggccaccuacucaccaugugacaucagacagguaaucacgccuuggccucagcucuaucagggaucacccuccacuccugaccucucacacauuugcugggaggcugaagagagaacacucaaaccuuggagcuuucaaaaugcaugaggugaggccgggcacaguggcuuaugcauguaauaccagcacuuugggaggccaaggcugguggaucacaaggucagaaguucgagaccagccuggccaacauggugaaaccccgucucuacuaaaaauacaaaaaauuagcugggcaugguggcgcacgccuguaaccccagcuacuuaggaggcugaggcaggagaaucacuugaacccaggaggcggagguugcagugagcgagaucgcgccauugcacuccugccugggugacagagcaagacucugucuugagaaaaaaaaaaaaaagaagaagaaagagaauuagccaggcaugguggcaggcaccuguaaucucagcuacucaggaggcugagggaggagcaucacuugaaccgaggagguggagguuguaaugggccaagaucgagccacugcacuccagccugggcaacagagugagacugugucucaaaaaaaaaaaagaauagucuaucuaucuaugugaaaaauucagggacacccacacacacagauaauccauccacacacacauacuccauccacacacacacgauccacucccacacacaauccauccacacacacgcacaauccauccacacacacauauaguccacauguuucuuuuauauauuuuuuuaauuuuuuuauuugaauuuuuuuuuguuuuguuccacauguuuccaugugcacagagcauuucaggaaacaugcaugacaggcuggccaggguggggccucugaggagagcuggcccucgggaucauagcacccaccuuuugcacaguuugauguuuuaccaugugccucuauuacuuacuuaaaugcauacauuuaaaaaaaaccugggcugggcgcggugacucacaccuguaaucccagcacuuugggaggccgaagcgggcggaucacgaggucaggagaucgagaccauccuggcuaacauggugaaaccccgucucuacuaaaaauacaagcuacuugggaggcugaggcaggagaauggcgugaacccgggaggcggagcuuguagugagccgagaucgcgccacugcacuccagccucgucuacagaucgagacucugucucaaacaaacaaacaaacaaacaaaaacaaccuggcagcuggcucuucugacaugcaguuccaaguaucuuggcuuaaauggacgaucccaggacccagcaaaaugccugacucauaguagauguucaauaaauauuuauuuaaaaaaaaacaaaauaaccuaacuuuugggaagcccaauauucaguuaggaaaagcucuuucauaauuauuaauuuugucauaauuauuauagcagugacuaaucacagcuuuuaaauuuuauucauucauucauucauucauucauucauucauuccaguagagaugggguuuugcuauguuggccaggcuggucuccaacuccuggccucaagcguucugcccaccucagccucccaaacugcugggauuacaggcaugagccacagcaccuggcuugcuguuguuuuaagucacauuuugggguaguuugguacacagcaacaggaaggggaauauuaacauaauuugcccaaagucacgcugugagugaggcagggaggcaggauuugaacucgggcagcuggcuccagggcucaggcucucucugcgacccauggguguggcucaggcuccugcuucuggaugggcucugggggaugaagcagcugggguggcccggggucuagccacagccacguccacccacccagccuucccaucuccccugccuucugcugagagucucagggaggauuugauucuccucaacuugggccgggccagaagagaucagcugacgauggccaaggggcucucugguucccccucccuccaccaucccagaaggccaggcaaggguggcuagccagagacccaucuccaaugccaccuuguccagcccccuguccugggcacuccuagcuuggacauccaucccccgcucccagaaugagccagacaucccuuggucagagggagaaugagggguggggauuccaacugccccgccagacuuagcauccccuaaauaggucaccccuugucuaucugaauuaacugacauucggggccugggaggggaacuugaacagacacccucucuccgcuggaucucucgaauaaaaaucagagacuggggcaaacuucaaaacaggacauccccaaaucggcaugaacuuucagcuccuggagguuaauccccaaacaaugggaucccgguuuuuauuuaguuauuuuuagagaaccucccucugucacccaggcuggagugcagcggcaugaucucggcucacugcaaccuccgccuucuggguucaagcgauuuuccugccucagccucccaaguagcugggaucacagacgugcaccaccacgcccgaauaauuuuugcauuuuuaguggagacaagguuucaccauauugggcaggcuggucucgaacuccugaccucaagucaucugccugccuuggccucccaaagugcugggauuacaggcgugagccaccacaccgacugacuugacauuaaaggccgguguaggucaccaaggccuggccucagggacaaucggggugggagucagaggagccggccacgaagacccuuuucagguggguuuggggcgccucucucgccguuugucccaggcggugccaugggaugccuucagguaaaaggacagggcucccucugccgcggcuuuccgugaagugagcauccauuaacugcauccagccugccccaaggaucccugccccaaggaucgcaagacuucagaagagguugugcccggggaggaggagggagggagcccugaagccgcugucugcccacuccggcagucggaagccaccuucccuuucacuugguucacaguaagugcucagucgauaugaacuauuaugaaaucugggcuggacaccuuaagugcaggucauccuuucaccgucacaaccaccugaggaggaaggcgcuaugcucauccccauucuacagauguggaagcugaggcacagaacuggacacaaacucaguguuuaggcccaaauggcuguuuuuuaaaaauuugagacaaggucuugcugugucacccaggcuggagugcaggggcgcaauaauugcucacugcagacucgaccucuugggcuccagcgauccucccaacucagccuucccaguagcugggacuacaggugugcaccaccacacuauacuaauuaaauucuuuuuuuaggucaggaguucgagaccagccuggccaacauggugaaaccccaucucuacuaaaaauacaaaaauuagccgggcgugguggcacacgccuguaguccaagcuacucgggaggcugaggcaggagaaucgcuugaacccaggagguggagguugcagugagcccagauugugccauugcacuucagccugggugacagagugagaccucugucuuaaaaaaaaaaaauuuuuuuuguagagauuggggggggucucacucuguugcccagcucagucuugaacuuguggccucaagcaacccucccaccucagccuuccaaaguguugggauuacaggcaucagccaccaugcccagccuugacagacucuuucuaugucucccucuuccccugggaaaccacaggcuagcccgggacacuccaguccugaggugggacugaggauggggccacuuacccggcaaaggugaugggucugagcaggagucagagccaagccagcgagggagggaucaacugaguagauagcccacgaagagagggggcug

SEQ ID NO: 14453 - RNA, 911 nt, Homo sapiens
augagggggucaucaaaggggggaauguagacccaacccggguuguucuucgcuagggccuuggccagcucgaaggcuucauccaauaacugcaaagccacaggggagauaggagggggugaggcacagggggcacccuguccagccaccaggcgcccucucucuuccuugcccugggucggcacucaccucacccaccaccuugacuguggcaccuucauucuugaggcgcucaauggugagagcagguguggugcugggcaccacgaugguggcggggacgccgaguugccuggccgcauaugcagccgccaugccugcguugcccgcugccagggucggggguggagagcgugucagugcgggagcaucugggagcccaggcaggacugcguacccucuacugggggcucuggaguuccccccucaccuccccacccugggcgacugcuggccucccccuggaauuccaaauugguggcugcugccauuguuuucaguggcacauugcuggggaaaccagggcucagagaagcagagugucugaucccaggacacacagcagaggacaggauggggaagcagaucacuuacccgaggagcagacaaaaugugcacagccuugcuuggcccacuguggagacaacaggagaggcacucaggcccaccucccagucauugccugugcucuuccuccccaccuggaauaccugccaggauuccaguggacacggacguuuccuucacucagaauuuguucuacccuugucugagacugcaccucccaucuccaaagagacuggcucaggaaaggguggaggaaaauaggcgacugauggcucugggaucagucccaaggaacccuccuggaagggcaccccucaaacagaggaagcccuaaugguggacgc

SEQ ID NO: 14454 - RNA, 3638 nt, Homo sapiens
auggcugcacugcuuuccuuuaaugcuccaacaaccugacaagagggucgggugaggagacaggccccaagcggcagccggcacuccaaggguuucccuccacggcagccgucccaacucccucuccugcagggaccguaagaagaagcgguuugugggacagucaggacaggaagacaagaagaagauuaagacagagagcggccgcuacaucagcagcuccuacaagcgagaccuguauccugaggggcguggcuggggaggggcggggccgaggagcuucagcaggagcagcuucaauuaaguggaaccugggggcgggggcgggggcggggaggagggggcggggcugagcggcuuaagcagccgcaucuccaauagaugggaccuggugcugggggcggggccgagcagcuucagcagcagcaucucgaacuagugggaccugugcugggggcggggcccagcagcuucagcagcagcaucuccaguaaguggggccugugcugggggcgggcccagcagcuucagcagcggcaucuccaauaagugggaccuggugcugggggcggggccgagcagcuucagcaacagcaucuccaauaagugggaccugugugcugggggcggggccgagcagcuucagcugcggcugggauaacggaacucugucugcuggggcaguguggggaggagccuucucccaucccaggggcuucacgcagcuuccuuaacgagguuucccagcuaucagaaguggaaacagaaacagaaaauugaugaucgugacucggacgaagaaggggcaucugaccggcgaggcccagagcgaagaggugggaagcgagaccguggccaaggugagagccaggguggggagugugggugcacagguaggcagagcaguuguggucagauuaggguaacgcugaggcacaggugcaggggcuacugcagagccccagagcuggguguguugggguaugcugccaaaacccugggucccuccaugaucccccccacccaacccccacacccacaguuucccccuuccuacugucccggccucugauggucacgagcaccgccugacaggcgcugggaagugccaugccccucaggugccuuguccccgacccccuuccacuucacagaugaagcuacagggauaacuucugguagaugcccuguucaccuaauuaagccgauuguguaaaauccuagagaacccgggagguggaaccuugugcaaaugcaggccauuuucaccugcaaaaauggcauuugcaugugguucgaccugacagugagcaugaauugauucccuguggcauccuuaggagugacguucuuuuuagcaaugcuguggggaaguucaugucaccaaagacgcagucagaagcagcuuugguucugggaggaggcgaucacaggggauguugaggaagauacuuccuugaaauguggguuggcaagugguacauuuggucaucugaggacuuggaccucuuugaucuggccugggucccucagccaguaacaagcuaagguggauuugaagccggcucugucugccagagccugugcuuaagggcuguuaucagggaggggcucccgcuugcugggugcaggcaggcucuguccuggaaggccacacaugaccugggaggcaaggugacugcgaauacccauuuuacaggccaggaaacaggugccuuaugagggcuaugacugaaccugggucacccagcugcccaaggcucccaccuggagucuucccuggggagaggggaguuugggaccaugucuugggucucucucagauggccuuagccccugcuugugucccuccaccuccuggggcuggucacugccuccccugggugucucugugagccugcgugcauuugccugggccuguucucuguggcuccucccucuccagcucucccaucugugggagugucuccuugucagcauggcuggguggggaccacccacaccucacuucucagccuguuuuuaccuaggugaaacagcagcuucugcugcgagcauugccgugcagugggcgugcaggggcuggggagacgggggcgaccugugggcuuugggaaaaagcagcuguucuuccuuugcuguccucauuggaggugauagguccugcgaggcacccuggcuccauuggagacagcugggaccaccuuaauggucaucccucuaggagcccuggggaggcugcuguuaugaauggggaagaggaggaggaggacacagggcuuagugggagccagggaggguggugcuugccucccggagaacuagaagaauggacuaccugaugcccaccuguggggcuggggcagggucgcugaccucugcugcugcugcugcuuugcugugugaucucagauaagucccucucccucucuggccuucuuugauuccucucccaccuaaaggaagguucaucuacacucuuuuuucaucuaacaagccuagagcaugguguccauggagacagaggcugaggucuguaucgguuacuauggggggccucagagccuggcgugccguaggugugcuguggagacauacacuccuugguuggagaauuuuuaauaguaacagucaugcccaaaaggcucccacuaugggacaggccuugaaauucugaccacuuuacaccauggaaaugcauuuacucuucacccaugagggaggugcugugauuuauaauucauagauggggaaacugaggcacagagccguuaacuucuugcccacgguccaagaggucacagcugggauuugaaccccagcgguucuggccccguguuauugaccacuccaugaggcugccuaaaacuuuauuagccaccuacuguguacagacacugggccacagcaauaagcacagaacaggaguaggggcaggggaggagucugcaagcuucugggaggaggggaucuugggagugaucccaacagcugagcucccugaaucccugucccagcaggugcaucccggccccacgccccaggcaccccugcaggccgaguccgcccggaacucaagaccaagcagcagauccugaagcagcggcgccgggcccagaagcugcacuuccugcagcgugguggccucaagcagcucucugcccgcaaccgccgccgcguccaggagcugcagcagggcgccuucggccggggugcccgcuccaagaagggcaagaugcggaagaggaugugaggaccaggacccagccccguggcuccuugauuggccuuagggugggcaucagcagacguucccgugcaccacugugugccuggcccugugcugggcacugggggcacucccugcaggagccaucaucugugaaaaggagcacuguauggccacagaagggcagcagcugcgucagccuaagacagagacauuugaacagggccuugaagggugugcaggaguucgccagcaaagccaggcaggccaagacuugaguuggcaacucagcugcugcugcuuccauguguucuggguucagaggucauggcugcaccggucagagcccugagugccucaggguuuggcaauggaauuuuuaauguaauaaaucuuuauugagcacugc

SEQ ID NO: 14455 - RNA, 2521 nt, Homo sapiens
gcuccagcaaccacuggccugggccugugguccccaucauucccaaucccugcucucacauuccucccaaaagcagcacccgaacaguaacgaccacagccaccuccuucacacaucuuaucucguuuccugagccacugaggucaagauccugaccccauuuuauagacaaagacacaaggcuucagaaagggcaagucacuugacuguggucacagagaaacuaaguggcggagcugggauuugagcccaggcaguccaagcugucaccaccacccuacagguugucugauuugacuuucugcuuuucaagagcaccaagaaauccagauuuucaugggaaaucucuaggcuuuugaauguuaguaacuaauuuacaaguggcucuuuaauauaguguggaguccaaacuaaauagagcagagagcugccagaugcuuucuucaccccagaaaaaaacaggcagggccgggugugguggcucaugccucuaaucccagcacuuugggaggcuaaggcgggcagaucacgagaucaggaguuugagaccagccuggacaacauggugaaaccccgucucuacuaaaaauacaaaaauuauccggagugguggagugcgccuguagucccagcuaccugggaggcugaggcaggagaauugcuugaacucaggaagcagagguugcacugagucgagaucaccccacugcacuccagccugggugacagagcaagacuccaucacaaaaaaaaaaacaggcaggccaagcgcaguggugcacaccuguaaucccugcacuuggggaggccgaggugggaggaucacuugaggccaggaguuugagaccaaucugggcaacauagugagacuuggagaggcugaugugggacgauuguuggagcccaggaguucgaggcugcagugagcucugguugcacugcugcacuccagccugagcaacacagcaagacucugccucaaaaaaaaaaaaaaaaaaaaaaagaaaaagaaaaaaaagaaaaggaaagaaaagaaaagaaaaaacaaacauaaguaacuuggaaagagcuuuuacuggaaguucaggaaauacaaaugcaaaggaaauggccaagccagcaguacguaguuggugcuaauggacgaagccauaagguagccaugauguggcaggggagggagggaggcugaggcuggugggcuggaagcugccugugaccuccucccggccccacugugucccuguccccccaggugcugcggcugcucaucacggccugggagagaagacucaucuucacuaucggcacguccaacaccacgggcgagucggacaccgugguguggaacgagauccaccacaagaccgaguuuggauccaaccucacgggccacggcuacccggacgcuagcuaccuagacaacgugcuggcugagcucacagcccagggcguauccgaggcugcagccaaggcuugaggcccaaggcugcccaccuucccuccugcuuugccccugguccggcaaaugccuccuucgccagguguguccugguagcccagguucagggcuggggaggagccugcggaaggggccgcagccauucaggggaccugccugguggcagcugggaugaagagagauggcaugucaggcuggccccgaaucauagcucccugagagggccaagcagagaguacuggaaaccucccuaccaaaaagacagagacccgcccccucacacacaaacacacauguccuguugaacucaugcacgcacacccacgugccuguacuugcccccaggcuggaagagaagagacagaaagaccccaugacccccccauguggauccccaucugugucucaguugcaucuguacagccuugucugcaaacuggaggaugcggggcaagcccuuaggggccugccagggcucggggggcaaagagggacucgggaaacucaguguaccccagaugccucacccauuccgugucaucacccaugucugccacccacugauugggcaauugugggcccaugggguggaagcccccagaugacugagcaguucuacaaaagaauggccagcacgagcggggacuagaggguccugauuuugugucugugccucuucaucucucuggacucugaucuccuucucccuucccaucuccaggccuucugucugucccagauaaaggcgcuguucucccauccucccuaccccauccucuccaccaaaucgcucccaauuuugagagccaaaggcuggcgcuucugacuucaggagcgaaaggaggaggccuaguuugggccgauguauuuuaaagcagaguggacagcagagagucaauuucccuuucguugggagugggcagugggguggcuaauugucuucggccaaccaggggccuguugcccaggcaacucaccagcuccgccucugcugauuggcugccacggugggagucagccaagauuuaaagggaugccagcgauugcucuuuucaaaac

SEQ ID NO: 14456 - RNA, 9373 nt, Homo sapiens
cuguacaauggagagcugacccuggucuguccuguucuuccugcuuucaggccaggacuuaauagugauugggagguggcgggugguggagaagaggcggcaggaacaggaaggaaggguucaaggaggugggcagggcaaaaacaacagcaauuccuauuucuugagagcuuucuguugugccgugcacuuuacauaucaugauggucuuuauuuuccggaugaggaaacggaggcuuagagaagugaaaugauuucucuaagcucacacaguguucaguggccuagugcgacucgaacucaagucugccuaauuccagaacuuccucucuucaccuggagccaggggaagcuugcgaggcgcccuguccguauggaacagugcuguacgcaaauguccuggauucagcuguuuuuucugccacucacacauuuuucaggaauuagagcuauuuuucuaauuuaacugggcauuaaauuugcuaaaccuggcaacccagguuuagcaaauauuuuuauuauuuguagagaugguggucucccucugcugcccaggcuggucuugaacuacuaggcucaggcaauccuccugccucguccuggggggaguucggacuuaagccuaggacuucagcgaauggcccgcccaggacccccaaaugcuuuugcaggcuaauccacgaccugggccaguccuuaccuuuggaaucgcaaugagcuucccgggcuccaauccgcuuuucugggcuagggaacuggggagucgcgagccaggagcggacccuuuaagagugauuucgagggcgggcucacgggggcgugccgguucggggccugccaaucgggaggugggaagaacgcgggggcgggcccggcgcgagcaggcugggaaggguuaaaggggcgcgcccgugggucgcggacuguccgguugcucccgccuccuuccgucggauccgcgcucucccgcggcugcgccggcccggccgcccaggagacaaagcgcugccgccgccgucgccgccaccgggccagucccgaaccauggccgggccaccccgcaaccucgcgccucccgucccgucgccgcccuaggccugcgcugcgagguaaggcgggccuggcggggggacaugcacgaggacaugggacccgggucgggccgcccugggccucggggucccccggccaccuggagagcgcguugcggggaucuuccccgcugggacuccgcaccaguggugacuucuccagcugccgaggcgaacuuggccaaugaccacccuccccucucucagcccauagggacgucugccgcugguggggacugcggauaagccccccauucugccgcugaucacccaucuggggcucuggcuguccuuuaaggaacuuaagagagcucccacgcacaacacacaaagggacagagagcagccgggagcagggccacaccuggagcagcagccccugccguggacaagggggcugccugugucuggacggcggugcuggcgugucucuggggucccugcuggggcggugacggccaggcugcucuuuaguguucuuggcacacauguuuuucagccugugccugccacacccucuuccccacgcccgcugcugggggacacugagggcagcuggauucaaccccaggaccugcgguacuggcuucuuuucguugaugugagugccaaaaugccaugcuucagucucccaggagaccuggguuccggggccagcugugccccuggagaucuuggaugaauuauuugccuuuuugacagcucuuucccugaaagcucacuacccaccaaguauuuugcaaaaugacucuucaggagucaauucacucagcccuuagagggauggaaguuaacgucaccauuuugcagaugaggcugagaaaaaacuccgacucacagcagcuaauauuugcaauccauuucccauaguuugccaguggguuuuccuucuuuuagcucaugaacccucgccacacagcccaauuuaacagaugaggacacugagacuuggaaaggugaaacgacuuguccaagguccuccagccuggaccugcggaggcaggaacuuugccuugggagcagagcugggccaggcucccuccagcuuccugucuggccaugggcuguugaaucagcagcagugcccacaguggacucugaacuucuuggaaaacaguguggggagauaaggcaggggccaggccuucgcuccaggcaaggcuggcgccugugccccugcagcuuccugucuucccaguucugguggaggcaggggucaugggcagagcuggguccugugccugcuggugaccuugaaccaguuuggccucuaucuaggcagucgggggaggaggguugcugagcaggagggaaguugcuauuccuuuggccuugaugggguggagagaccccaagaucagccccuuuauuuggguggcuugccuggagcaugugauucugggcacaguuguaugccucuagccaacuuauugaaucucccuguguccauuuccacaucugugaauguggggugagaucccuugucuuggggcuguugaaagguuucagaagauacugcagaaugaaucaaacagcugugugaguaccuacugcaugccaggcacuagaauucagaccacaaacgccccugcaggcagaaaugacccagguauuaauuucagguggaggcacaggagagggacuggggggccucuugugcauaggguggccagggaccaccucucugaggaggugacagcuaggcugagaccaaaggauggggagcuggccuugugaagaccugcaggcagacagccgggaccaagucuuggagguggggaugugucugguguauuugaggaacagaaaggaggccaggauggcuggagcugagugaacaagggggaaagagguagggaaagggaacuuggaagccaagggaggcuuggauuuuuuuuuuuuuuuuuuugagacagaaucucacuaugucaccccccaaguucaagggguccuuccauguuagccucccagauagcuaggacuagaggcuuguaucaccaugcccagcuauuuuuuuuucuauuuuuuauagagauagggucuugcuauguuguccaggcuggucucuaacucaagcaauccuacccccucagccucccaaagugccagcauuacaggugugagccaccgcacccugccuaaggauuuaauuuuaugcugagagaaguagggagccaugggaggguuuagagcagaggaggagugugauuggacuuaauuuucacaggauccaucugugggaaguggauuucaguguggcucggagaagagcuuaggaaggaggcuuggaucuuaccuugaggaacauggacagggaggggcaaggagacuuaugaggaggcuacagcagccaucccagugaauggugauggggccuagaauggggagguggaguggacagauuaggcaacugauuuggaagacgcuggagagggggaucaacuggacuugaugugcgaucagaugcgggggugagagggaaaccaagggccauuugcugagaucggaagcacaacacagggauguuuggggaaaagccaagaaaaaugugaacugcaaccgcgcucagcaggcacugugugccuggccccaugcuccgcaaaguccauauagucacuguaucauugucacaacagcccugacuuaggcacuguuacgaucccauuuuacagaugcagaaacagaggcccagagagaugaauagccugccuggggucccccagcccagaugcugcagagcugacauuugaauccagagaagagcgagcugaggcuggagcugagcagagggcagggaggcaagugguggccugagagguaggagcggaacugggcaagcagggcgggaggguccugugagaaccggggccagcauccacaugggaguugauggguggugguguggggaaugcgugaaucccugcggcuuagagagggacagcuguagcugagaggcaggguggggauucaacaccuggagacuuugggggcucuggccuuggccucccacuaggucaggacaaacugaccucaguuucuuuuuuuauuuuaaguuccaugauacaugugcagaacaugcaggcuugucacauagguauacgugugccaugguggcuugcugcaccauugacccguucucuaaguucccuccccucacccccgaucccccaacaggccccgauauguguucugccccucccuguguccaugugucucauuguucaacucccacuuaugaguaagaacaugcgguauuugguuuucuguuccuguguuaguuugcugaggaugauggcuuccagcuccaucuauuuccccgcaaaggacaugaucucauuccuuuuuauggcuggauaguuuuccaugguguguauguaccacauuuccuuuauucagucuaucauugaugggcauuuggguugguugaucucaguuucuaagucacaacucauguuccgucuucuaggaagccuucccugacugccuauguggcugacaggagguggcaaggacaacccccuccacccuaggacagguagucuggcagggccucacugcggucaccugcucccaggagagccaccacccugaccucauuccaccaggcucugagaaagacaccacccaggcaggggaaugaacacugagugccuacugcguaccaggacuuuauauccuuugcuucuugaaaaauguagcuaccauccuaugcaggcugaggcucugcagugggagauaaggcaggcucucaaaauggccauggaaaaccccaagggaagguggccaggccagggacgcagaugccaccucccgacaaguccuuccuggccagcguugccccaucauauacuccuugggggaagguggauggggucacuguggccgauggcauggaguuagaguccucuaugcuaaauggcacgggucgacccccugccccuccuuccuguaagucagccuagcccugggccugcaucuuuccccaaauucuuucuuuuuuuuugagacggagucuggcucuguccccaggcuggaguguaguagugcaaucucggcugacugcaacuucugucuccuggguucaagcacuucuccugccucagccucccaaguaccugggauuauaggcaccccccaccaugccuggcuauuuuuuuuuuuuuuuugagauggagucuugcucugucgcccaggcuggacugcaauggcgcagucuuggcucacugcaaccuccgccucuuggguucaagcgauucuucugccucagucucccaaguagcugggauuaugggcgugcaccaccucaccuggcuguuuuuuaguagagaugggguuuugccauguuggccaggcuggucucgaacuccugaccucaggugagaaggauuggccuuggccuuccaaagugcugggauuacaggcgugagccacugugcccagccccugucuuacuauuuuccauagaacaugagacuaccuggcagacgucuuaucuguuuguuaacugucugcucccuuucacuugccaguggcauuucaacaccacgagggcagggaccguguccaucuuuuuuuuuuuuuuugagacagagugucacauuauugcccgggcuggagugcaauggcauaaucucggcucacugcaaccuccgccuccuggguuuaggugauucuccugccucagccucccgaguagcugggauuacaggcgcccgccaccacgccuggcuuauuuuuuguauuuuuaguagagaagggguuucacuguguuggccaggcuggacgacccuguccaucuuguuauugcuauaucccuaggccuggaacaaugccuggcacccaguagaugcuuaauaaacauuuuaugaaugaaaucaaucucuacaacucuccaaaguugguucugcucauccauuucauggaugaacaaaccaaagucgaaccacaaagucagggcugggaccuggcagggacugcagaaggccagcuggucuuguucuugggaugauggaaacagcagcgccugaaaugaggccuggguuuggauuucagcccugcccaaccugcuuugugacaccagggaagcaguuaaccucucugugccucuguuuccucaucuguugcacuggugccaggccagucccugugaccuaaggucuauugugagauaaagugaguucauuccucugaaaugucuggcaugcagcaggaacucacaacauuauuucagggauacaggaggguaggagguuaugaggcugucuggggaggcccgugagacccagguuccaguccugucucugcuucuuaggaguugugggcgcauaggccagcugcuuccacccuaugagcgucaguuuccucaucugugaaacggggauguagaguggcugcaagguccccuuggggcacugggugaccuagcgucaguggccuugugcauaacagcccuucuaugggguccaggccccaggcuccccuccaggccccgcgauugccaccaugaagcugaacgagcgcagccuggccuucuacgccaccugugacgccccgguggacaaugcaggcuuccuguacaagaagggugggcggcacgcggccuaccaccggcgcugguucgugcugcgcgggaacaugcucuucuacuucgaggacgcugccagccgugagcccgugggcgucaucauccuggagggcugcacuguggagcugguggaggccgccgaggaguucgccuucgcugugcgcuuugcggggacccgggcgcgcaccuacgugcuggccgcugagagucaggaugccauggagggcugggucaaggcccugucgcgugccagcuucgacuaccugcggcugguggugcgcgagcuggagcagcagcuggcggcuguacguggcggggguggcauggcccugccccagccccagccccagucccugcccuugcccccgucccugcccucugcccuggccccagucccaucccugccuucugccccagccccggucccagcccugccccugccccgccggcccagugcccucccgcccaaggagaauggcugcgcugucuggagcacugaggccaccuucaggccuggacccgagcccccuccaccaccgccucgccgccgggccucggcaccccacgggccccuggacauggcccccuucgcccggcugcacgagugcuauggccaggagauccgggcccugcguggccaguggcucagcagccggguccagcccugaggccaccagggcgccuguuuuagggggacacaagcucuaugcccucugggacaggccggguccuggagagacugggggagcagauccugagggaaaucaugggcaaggcuggcccccaggcccugaguggccugguuuugggggaugcaggcucugagaaggugcuggauucugagugggccuuuaggaccaugugacccagaaggccuacccuugaggggaacgucacgugcaacacuaaggagaauccagggccugagggggagguuuccugagaacuccggccccaggcuggccugagcugccgggcagaggccugugcuggcaacaggcauugccgggccugcagcucagagggucacugggacugagggcgaucuguggccugaaaagcaaaugcacaguuagugcagcuccugaccaggccuucaggguggacagagggaggaucggucauggcagccacaccugggccuggccuugcuccgggaccugccagaggagcuggccuggcucugugccugccugccuccaggagcaggacgguggcugggaggguagugacuggggacacaggugcagguguuagugcaggaccggaagggugagguggccugguccucggggcuccuggccugggcuggcugaggcaggacucugccaaaaguccccugccaggccucaugguggugcuccugguggcaguggcucucuggccgcgggcccugucugugucuccgugguggcucucacagggcucuccagacacuccuugacugcauccuucagucuuggccccuaggccuggggccccuugggagcuugccugaccucccuuccugggcuggguagccauggcccgaggugaccuucuagcagguucccccagggaggggaggccaccagcugacucaccgccuaggaaggcccaggugcugaccuaguggcggagaaaaagccgcacaccgaguguggcuuccagagccccucuucagcuccaggcagcccccucuaacauguccccuccugagcucagcccccacccccauacuccugguggggaccaggucuugcuuggcuucggggcugaccgccgguccccuuucuucucaccacagugcccauuuuucauccagggagaaccucggggcugggacaccuccuggcccucacccugggucauguuuacaguccucagugccccacaccgguggcccccugaggacaccuccacccugaccuugauuuucccaaacgcugccucuuggugacagacucagcccaaaaccccuuccuucugucucuggagacccuugagcuuggggaaauauggaggggugugugucugcaaucaaggccucugcagcucacggcuggcccggugggcugggacuuccgucugaauuuuaaauacuuaggguucauuuuuuuuucucuggcaacaaagcuugauguuuucacugcuuuaguuuccuguuugcuggugggaggggauacggucugugacucuggacuugcucugggggaacaguugucacugcccccggggagaggggcagcuugggcuggagaagcacagccagagacagagccccucgagagggauccuuggcugcuucauugucuuccccccagcaagcccugcucuccacaggcaccucuggggucuugguaugguccccgcucaccuccuuccagaguccugagugguguggguguggguggcacaggaucuggggcaugggagggguucagagcuucccagagccccguguccuggcagacucagcuggugggcugggguguuaaccccaguccuggcguagguuuacagacucucaagguacguuggcccuggucuccugggagagaggggugagggauguccccuaccaaagcacaaggugggaucaggcugccuccuggguugggugucgggggagcuguccggcagccuggcagggagaugcaagggcuaaaguaaaauuuugucaaguaauggcugauugugucauuuuuuuuccccauca

SEQ ID NO: 14457 - RNA, 12633 nt, Homo sapiens
aauugauaucccaucacuguaugacaguguuagccagcuuugcuguaaauaucguaccaugccuauccaagaaaugagggaaagggcaggagagaagggguaagucagguuccaaaagguacaguuagcggaaacuguaggggggggagucccugugguccccaauagaagagaugagaaggaacuaaaugaaaaugcagagauucugaagauguaacugaccacuuuaauuucccccaacugaaagauuuugaaaaucaaugguaaaacaggacuuaguaacaagagaauuugcuguacaguaacuuggcuagaauacaguauuguguaucuuaaagaguaagaaacuugggggaaggaugaggugacuaagagccuugaaaauugcaggcaauuugucuuuacuacaggcuuauuaauaagccaggucauuuugaaaguuguacuuagagcuuuauuuccaaaacagacaauuguaaauucuuauuuuuccuucaguuucuucagaugauucugaaucacacaugagugaagaaaaaaaggaagaagauuuacuaaauaauuuuaugcaaucaaugucaauugaagaacagggagaacaucugauguuaacuugacagucuugucucguguauugaauucgugccaaaggugaggguaagggguugugaguuguguccuguauguuuaggaugguauuguuauuuauuaaaucauuaaguaauuuugguuuguucagaaacuuaaaacaauguaauuggucugauguaguuccauguaccaaugauaguuauguaagaaaauuuacauguaacauauacuuguacuucuagcuagauacaauuaaaacuuuucuugcauucaauauugaauuacuuuucuuuaaaucugacaaaugcaucguauuucuucuuucuguguucauaguaaguccuaaaacagcaauauuagaauauccuacaagggccaggcgcaguggcucaugccuguaaucccagcacuuugggaggccgaggcggguggaucaugaggucacgaguucgagaccagccugaccaacauggugaaacccccgucucuacugaaaauacaaaaauuagcugggcauguuggugugugccuauagucccagcuacuugggagauugaggcaggagaauuagaauugcuugaaccugggaggcggagguugcagugaaccgagaucacaccacugcacuccagccuggcaacagagcgagacuccgucucaaaaaaaaaagaauauccuacaaguauuuuuuugauugggcuaagggaagcuuggaaauauccagauacagaauagcauuugacagagaugaugcucugacuugcaaaguaggugaucaauaaauauuugcuauuugaauacaacuuuaaaauguaaauacacauuuucccuaucuuaugaaauuaccacauaaauaacuugggacucucggacuagauuagguugggaguaguuacacuaacaagaggauucuuuacguuauauauuacucuaguaugcuuccuugcuaaauuuguuuuuuuuuuguuuuguuuuguuuuuuuuugagacggaguuaugcucuuguugaccaggcuggagugcaauggugugaucucggcucacugcaaccuccaacuccaggauucaagugauucuacugccucagccucccgaguagcugggaauacaggcauguagcaccaugcuggcuaauuuuguauuuuuaguacagacaggguuucaccauguuggccaggcuggucuugaacuccugaccucaggugauccaccugccucagccucccaaaguguugggauuagggugugagccacugugcccggccccuaaacuuguauuuuuaaaacuuuuauuaaaccuugaaaaauggaaauagcaacaguuugaagaaucacuguuaaugucggcaugguauauuauuuagcaaauaaaaucugaguccaacauuaugacacaauguaagagaagagcucugaaaggucaucucguccacuuuaauauuuauauccguaguuucacuugguuccucauuuuuauguuuuuuuuuaaauuaaauacagguuaucaaaguauaaaugaaagguaauuguuuauuacuggagaagagaaaaauguauacaagaaagucuagauucuuucuccacaugcacuacuuuuggaauaaaguuccaaauaucaacuuugaagauacuuacaaggauaaauuuuucuuaacaagugaccaauuacuguguuguggacauuuuuucauagaauccauauacuguaaacuaaauauauucuuauaguuuacaggaagcuuggagcaauuauguauuaacagagaagaugguauuauauuuuacugcaaaauauuauaaaagugauacaauuuuguggcucuuaaauguuuaauuacuugauuucaacaggacaaugaaaaaaaaccaaaaaucaucaagacaggccuggcuuuaagguuuuuuguauucgauucguucuacuuucacaucaucuccaauuagcugauacacauaggugaccacuguagaagccuggauauccaucaacacaaaugauggaauaauguuucuagaagaaaaaauaaauaaugucaguguuuuguagcacaaagcagcagcacuauaaauuucaauuuaagaugacuauuuggauucagagaaaucuguuacauaucacaugaacaguuaccaaaagauugccaaaauggcuagauuuauuuaaauggucacauguggcugggcacaguggcuuacgccuguaaucccagcacuuugggaggcugagguggguggaucaccugaggucaggaguucaauaccagccuggcuaacauggugaaaccccaucucuacuaaaaauacaagaauuagccaggcgugguggcggguaccuauaaucccggcuacuugggagacugaggcacaagaaucacuugaacccgggagacagagguugcagugagccaagauugcaacacuacacuccagccuaggugacagagcaagacucugucucaaaaaaaaaaaaagucacauuuauuuuuauuuuauuuauuuauuuauuuauuuauuuauuuauuuauuuauuuauugagucuccuucugucacccuggcuggaguacagagccucaaacguggcucacugcagucucaaccuccuaggcucaagugaucaucccaccucagccuccuguguagcugggaucacaggcaugcaccaccacacccagcuaauuuuuaaaauuuuuuuguagagacagggucucaccauauugucuaggcuggucucaaacuccugggcucaagcaaccugcccuggucucccgaagugcugguauuacaggcaugagccacugugcccagccacauuucuuuuacgaaaugucacacaugcaauuauuuuacuaaagcccccaaauucccaaauucuauacuacucacguuuccaaggcauuauaugccccaguggcagaaccuggauuaauguagaauuuauuuucaugcucaaaugcuucaaauuugugugugugucccgagauaagaauguccacaucaaauugccucugcaacagggcuaagcuggccauaucuccccauggaauaacuugauguccauggaucagaccaauuuugaacuguccaacagucacaacuuucuguucuggauaauucagauucuaacauaagaaaaagacguaagaaaauauguauuuuagagauacugauguuuaaaaaaaucaguuuccuuaaauauucaaucuccuauggauguuuugauguaguaccccacaacacacacauuuauacauuuuuuuuuuuuuuugagacagaguguugcuauguugcccaggcuggagugcagugguaccaucuuggcucacuguaaccuccgccugccagguucaagcaauucuccugucucagccucccaaguagcugggauuacaggcacccgccaccacgcccgccuaauuuuuuuguauuuuuaguagagacggagucucaccauguuggccaggcugguuucaaacuccuaaccucaaaugauccaccugccuuggccucccaaagcgcuaggauuacaggccugagccacugugcccaccccacauuuauaaauauuuuauuucuucuuggucuccaaggcugcaucuauauuuuaaaacauaacuuacucaauauaaacuggaauuuaucaugcaaccccuuuauuguguuuauuccuauagaauauggguucuuuugcgcaugcuguaaauaauuauuccccccaaacuugugauuuuccuuuaccuaaggcauguaaguuaggguguguucaaauuauagcuuaauguagccuuaauacuuuuauagauagcuuaaaauaaugagagcuaacacuuacauaguacuuaguaugagccaggcacuacuguagggguuuuacaaauaucaacuuaauuaauacaaacaauccuagaagguucuauuaugauccccacuuuauggaugaugaaacaggcaaagagguuguuuguccuuucaucuccccgucuuucaccuccaugccaccuuuaaauuuauccaaacucuuuuuaaaauacaauaaaaagacaguaugccccuucaguuugguuuaaggaaccccauuaaauaacacaaaccaagauuaauugaugaaaaucuuauauucccagaaauacuauauguauaaauuuuuuuuuuuuuuuuuuugagacagagucucacucugucgcccaggauggagugcaguggcgcgaucucggcucacugcaaacucugccucccagguucacgccauucuccugccucagcuucccgaguagcugggacuacaggcgcccaccaccaugcccagcuaauuuuuuuuguauuuuuaguggagacagggguucaccguguuagccaggauggucucgaucuccugaccucgugauccaccugccucggccucccaaagugcugggauuacaggcgugagccaccgcacccggccuaaaauaaaauuuucaaacuagaaucagguuuauuaugcuacaccauacaauguuggcacuggcagggguuuuaaaaaucauccauuccagucauauuuacuaaggaucagaaaggggaagugaucugccaaaaaucccauuauuaacuaaugggaacuccagaacuccuuacuuuuucuuuuugagauagaguuucacucugucgcccaggcuggagugcaguggcacaaucucagcucacugcuagcuccgccucccagguucacaccauucuccugccucagccucccaaguagcugggacgacaggcgcccagcaccacaccuggcuaauuuuuuuguauuuuuaguagagaugggguuucaccguaucagccaggauggucuugaucucuugaccucaugauccacccaccuaggccucccaaagugcugggauuacaggcgugagccaccguacccggcccagaacucuuuacuuuuuuucuuuaaagucagguuuauugaggcguaauuuacacaaaguaaaaucuuacuuuuucauguauaauaugauggguuuugacaaaugcacacggcuguguaagcacugccacacuaaagauacagagcagcucuaucacuccuucaaaacucccucaugcccuauaaagucagccuuugagaaaggaagccacaggaggguugccagcagagaagugaugugaucuuacuuuacuuaaaaaggaucacgcugguugcuaguuggagaauaaacuggaaggagcaaggguagaauuaggaaguuggaauacaagaaaaugauacaguggcuuggaauaaaguuaguagagguagcggcggugaaaaguucauaauaaaaacuuuauaaacuuggcugagugugguggcucaugccuguaaucccagcacuuuaggaggcugaggcgggaggaucaccugaggucacgaguucgagaccagccuugccaacacggcaaaacgccaucucuacuaaaaaaaaaaauagcuggaugugauggugugugccuguagucucagcuacuugggagguuaggcaggagaaucgguugaaccugagaggcagagguuucagggagccaagaucgugccacugcauuccagccugggcgacagagcaagacuccaucucaaaaaaaacaaaaacaaacaaaaaaaacuuuauaaauuaaacgacagcauaaaacaguaacaaagccacuuuuauucaguaucuauuuaguuagaauaaguauuuaauguuuacuaggugaucuaaaucagugauuuucaaauaguaagggaggggcaugauguauaguaauuuuacauuuggaaaagaaaaagggaaaaaaaaaaaaaccuuaccaguugagaaacccuggucuaaagauaaagcuuauguaaguaauaaucaagaaagggagauauuugagaagggaaagggaaauacaucaccucaucgaagucuccucucacaauaugaacaucaccagccagagucuugagauagucauaacucucuuuggugcaaagguuuccugugcagagaaugugcugaauuuuuccuggcaccaggaguuuuuugaauuuagcuggcaaacuguugcaccggugugggaugugcagaucuccuaauaccaacaccaacuuuaaagugucaaggugagauaaagcauaauguuaaacacaauaucaaaacaaaauagucuccucuuguaagcccccuuuuaagucucauaagagaucccgaaucccagaaauuauucauaggguuccuaucaugacuauuuauuuaaucucagaagcugaaucuguacguauuuuucuucaggucaucagcuuugggauagguuucaucauugauuguaucaugacaauuuaaacagacauacuuaugguaauguacuuuguucuaaaucaaucuuauuuugguuguaaacaguugcauauauaaaauacagguaaucauucuauuuaccaagagugaaaucaagcauucuaaagugauucauuuagagaccuguaaauacacugaauuuuaaaaauuacaaaauguaaaguauacuacugggcccuauagaauuuggcauuuuuaaagacugauaugguaauucauauuucugcaguuguaacaugaaaugauauauuaaucccagaaauauuuaaggaaauuguuaauagacaaaaaaguuaauuauguaauuuaucuguacuagacugacaacuaugugcaagcauaauagccaaaauuugauauuuuuguuacuucaaacuauuagguguacguuacagagauauacaacagccuucaguuucaucagguaaaugugugcuuuugaauuauaaucuuugauaucuucacuuuccuucauuauuagaaguccucacugucauauuuuuauggucuggauuaaauugcucauauauccucgguauaguuccccaacuuaaaaaaaagaaaacauuuucacaaucuuucauguauauuagagcauuaaaacaaaaaagagaucagcuaaauaagugauaaauuuagcauaaggugguuuagagcugcaacauagucucagaugacaaaaguaaauuuugcuuuuaaauauaaaagaauauaaaccccaauccuguaaaauuuuaauuuaaaaauuucuuucuuuuuuuuuuuuuuuuuuuuuuuuuuugagacggagucucacucugucgcccaggcuggagugcaguggugcgaucucggcucacugcaaccuccgccuccuggguucaaaugauucuccugccucagcuucccgaguagcugggacuacaggcgugugccaccaugcccagcuaauuuuuguauuuuuaguaaagauaggguuucaccauguuggccaggcuggucuggaacuccugaccucaggugauccaccugccuccgccucccaaagugcuaggauuacaggcaugagucaccacgccuggccuaauuuaaaaauuucaagauuugagaaacaacauuaauuuagccauuuaacagaauacuguuagaaagaucauuuaaaaauaguaucugucuggcugagugcgguggcucacaccuguaaucccagcacuuugggaggccgaggugggcagaauacuugaggucaggaguucgagaccagccuggccaacaugguaaaacacugucuuuacuaaaaagaaaaauacaaaaguuagcugggcacgguggcaggcgccuguaaucccagccaacuugggagguugaggcaggagaauugcuugaacucaggaggcggagguugcagugagcugagauggcacuggcacuggcacuggaugccacuggcacuccagccugggcagcagagugagacucugucucaaaacaaacaaacaaaaaaauaguaucuauccuccaaaggacaacagaaucgauuuuuuuuuuuuuuuuuugagauggaauuuugcucucgucgcccaggcuggagugcaauggugcaaucuuggcucacugcaaccucugccucccagguucaugcaguucuccugccucagccucccgaguagcugggauuacaagcgcucuccacuacacccagcuaauuuuuguauuuuuaguagagacaggguuucaccguguuggccaggcuggucuccaacaucugaccucaggugacccaccugcccuggccucccaaacugcuaggauuauaggcgugagccacugcgcccagcccaacagaaucaguuucuucauguugaucaguauaagcaccuucauucuauacaaaauguuuuccuuuacagauauugcaugcauaaauguacaugcccuuuaacugcuuuuaaaggcaugacuauucuuuaauauuaucaaagaaaccauuaaauagcuaauaggauaaaacaaaauaguuuugccacugcagacuuuguaaaugaaaauuaaucaaacaaacaaaauguaugaaauuaaaaugauuaccaaaagaagcuugauuuaucuugcaacaaaaauuaaaauuauugcaaagaaaaggaaccguuaccaggacacagaguuaucgggacauaguuuguaaucucaaaguaacacaagguuaugaaauuagcacacuuuaaaauuguuaaguaagauucuucuuuauaaagacuaguuucagcagguauuuguuguaugaccuauauuaauuguuucaaugcagaucucaguggacaaaacaucuguaaaacuaaaaaccacuaugaaguuuccacccucacugguaaucaacauaaaaguaccuggauauagaacaaucuucauuuuagagggggauuccuucugauauggauugaaguacauaguuaguaugggaaucuugcuuugagaaaaagguaaaaauaauagauuucuauauuuaaaagaagaagaagaacaacaacaacaaccaccaccccaaacucauaaaaggguauaugucuacaacagguugaaauguuugguacuaauaaugaaugagcuguucaaucugaauguaccagaaagaacauuaguaagacaugguacuuuauaaugauugaugaccuaauucuauaaaguacuguggauuaucuccaagacucaagacuauuagcagucuaaagauauaacuguaugaaugaccacacaaucauuucaaauuaguagggauccuuacuaggacagaauccucugguuuccugcugaugacaaaguuauggggaaauaguguuacauaacacgugucauacuuugaaacauguucccgcccaaauuccacacuuugacaaaucgggauagacauagaugauagaguccuuuaagaaagcaaaagauccuggaaauggcagucuuauuaaauuaaaauaaagagccaacccaaucaaagcaugggaauucgguuacuuccuuucaacagaccuuaaaaggguaagaaauccagucaguaaacagccacccaaccaccacuguuaguaggagcuaagugaagaaacuuacucugugcccagccuuaguggaaugaagaaguugauugcagacaggggggaugaaaaaaaaagggugaaacaugaccaauguuaaaagaaagcaacaaaaagaaaccaaaaaaaaaaaagagaacaaaaaacccauaccaaaugagcaaacaauuguuaaugauuucugaguguuaugaaagaaaauguuaaaaaucagcugugcucaaaacaauaccaaaauaaauauuugcuuuauuuuugaacaugacacacacacuuuuuaauaaauuugucuugucaguuucuccuacuuuuccuaaucuuguucuguacaucgacuuccaucucuguuuuccauucuguuuagauuuuuauaagauuuuauaaaauaaugaauuuggauuucuacaagacacuguggaaaauuuaucaucaguaauagcugaaaggcuaacauuuucuggauucuuaggguuuaauuauucaaguauauggauguuaauuaucuuacauucaaaauucuaguagcuggaaaauuaugcugcggcuaggugauuuuuuguagcugaugcaacacagcaccaugaauacauuaucaaguguugaacaaaucaacuaaaggugaagacaaaauaauaaaaacaaacacauuuauucagguaaaacuggaccuuucccacacuugaauuugcugcccacagacucuggacacuguacugaguguugaacgucuguauccuuugccaaauaaaaugcuuuuaaucaugaaagaacuggcuaaugcuaaauuuuucccaguucuauuucauaugaaaaaugauguuccaguacaacuacccuaaauaagagggaucacuucucaaacaacuugagaaacauuaauauuuugaaaccauggcaaguaauuaugucuucucccauggauaggugucucgaaauuacuguaaacggauuacuuuaaauuggagucuguuuagaagcaaaaauuaaaagugagauuaaagauuuuaaagaagcaugcaccauaaaucucuggcugccaugucuguaagucccccucuugaaaaggcuguuugucaugcaauaguaauaaucuuaaaaaugcauagcuucuuugguuuccuuguaaaaauaaaaaagaaugcaauaaaugccugucagagguagacgucccuuuacagccaaccuccaucaacacaaauaugaagauaaucacagcuccauuucaaacaauugauuuuuuuuuuuuuuuugagcagcagcaagauuuauugugaagagcgaaagaacaaagcuuacacaggguggaaggggacccgaguggguugccccaaacaauugacuuuuuaagagucaaaggcaccuuugaaaauaugauuacaggccgggcgcgguggcucacgccuguaaccccagcacuuugggaggccgaggcggguggaucaucugaggucgggagguagagaccagccugaccaacauggugaaaccccgucucuacuaaaaauacaaaaauuuagacgggcuugguggcgggcgccuguaaucccagcuacucgggaggcugaggcaggagcugaggcuugaacccgggcggcauugcagugagccgagaucgcggcauugcacuccagccugggcgacagagcgagacuccaucucaaaaagaaagaaagaaaauaugauuacagcucugaguccucucuaguagaggcccccaguuuuuauguaggaaggucugaggggcaccaaacuacugggggugaaggggugauugcuugaagguggcugggggagacuagguaagucuccaacaccggcacucuccccagaaaaauguguauauucacaaaaauuucccaacaguuucaaugaguucacacaucauuaaggaauccuacccuaaagaggcguagcaacccguggaaagaaacaguuccagcaauugcaagcgccaaaucccgcccucugagagcacaccugcucaucucaauggcagcuagauguuauuucaggagcgaggagggugguuuauucccuuucccuagauggcaaaguuaaacggguacgaaauucugcucgcuacuuccuguucugcauucgagaggccagcuuccaccacuacaccccaaccagcgggaggugcuuuuugcgggaaacgaguaggaaccgucuggaaacggaggaccgugccccuauccccggaacauucgagguauaggaccaaaggccuucccuggcucgggcgugcgugucucgugacaggucgggcugcuagaggggccuuuuuaccccuuggauggccucuggccccuuggggccgggauacgagaccuaggccagccgcacccagagguggccgcucccuuccuucccuagaccucuucugggccuuucccaggccagcgccugggcccugacgccgaggccuccgggauuucccaauuccucgcccucggccuccccacggcucccaacaacgcagcaccccacccgagagccaggccuuggucgccgcaacugcagcccucaccauccugucaccgggcuccgcucagucaccaccaccgucgccgcccucuuccucaggcuccucggcgacccgcccacuuaaccgcaaccaaugagagcagaggga

SEQ ID NO: 14458 - RNA, 1082 nt, Homo sapiens
acauuucuuuuacgaaaugucacacaugcaauuauuuuacuaaagcccccaaauucccaaauucuauacuacucacguuuccaaggcauuauaugccccaguggcagaaccuggauuaauguagaauuuauuuucaugcucaaaugcuucaaauuugugugugugucccgagauaagaauguccacaucaaauugccucugcaacagggcuaagcuggccauaucuccccauggaauaacuugauguccauggaucagaccaauuuugaacuguccaacagucacaacuuucuguucuggauaauucagauucuaacauaagaaaaagacguaagaaaauauguauuuuagagauacugauguuuaaaaaaaucaguuuccuuaaauauucaaucuccuauggauguuuugauguaguaccccacaacacacacauuuauacauuuuuuuuuuuuuuugagacagaguguugcuauguugcccaggcuggagugcagugguaccaucuuggcucacuguaaccuccgccugccagguucaagcaauucuccugucucagccucccaaguagcugggauuacaggcacccgccaccacgcccgccuaauuuuuuuguauuuuuaguagagacggagucucaccauguuggccaggcugguuucaaacuccuaaccucaaaugauccaccugccuuggccucccaaagcgcuaggauuacaggccugagccacugugcccaccccacauuuauaaauauuuuauuucuucuuggucuccaaggcugcaucuauauuuuaaaacauaacuuacucaauauaaacuggaauuuaucaugcaaccccuuuauuguguuuauuccuauagaauauggguucuuuugcgcaugcuguaaauaauuauuccccccaaacuugugauuuuccuuuaccuaaggcauguaaguuaggguguguucaaauuauagcuuaauguagccuuaauacuuuuauagauagcuuaaaauaaugagagcuaacacuuacauaguacuuaguaugagccaggcacuacuguagggguuuuacaaauaucaacuuaauuaa

SEQ ID NO: 14459 - RNA, 2493 nt, Homo sapiens
ccccgccccugagacccugcagcaccaucugucauggcggcugggcuguuugguuugagcgcucgccgucuuuuggcggcagcggcgacgcgagggcucccggccgcccgcguccgcugggaaucuagcuucuccaggacuguggucgccccguccgcuguggcgggaaagcggcccccagaaccgaccacaccguggcaagaggacccagaacccgaggacgaaaacuuguaugagaaggugagaggcggggggggggggggggguaguggggacggaaccccgaaggggucaguccgggaucggcagauggggcgcuguagaggacguucuuaggcaguagaggacugcgcggccggcgaaagccuagaagacuugggaauuuugccuaccuuguguuccuccuuugucucucgguaucuucguuccagggccagaggcaggauugguuuuauuuugcagacagaaaucacaccucaaguggacagcgcucaaaacacguuagaagcaguauaguacaacgauaauacuaaacaccgauauggcacuugcucguugccgucugcauucuuuuuuuuuuuuuuauagggacgagaucucgcuauguugcccaggcuggucucgaacuccuggcucaagcgauccucucgccucggccucccaaggugcugggauuacaggcaugagccaccgcuccgggccccgucuguguucuaaacacuugacaugcauuagcucaucuuauacucgaaacaaaccccauuucgaggugggcucuauuauuauacucauccuacagaugaggaaacugaggcacagagauguuaaguggauugcccuagcucacauaacugaauacaugguggagguggaacugguauuugaauuuagggcuaccaggucugcugugcuguauuaauagcagacgcugugaaaucaggcagcacugacgguuacccacccgugugaucuugguagcauaaacccuuggugccucaguuucuuugucuguaagaugggaacaguaauaggacaccuucuaaaaaauaggacaccccaccugccucauguaauuaaaugaguaaaaauggucagaacagcagcuggcacuucguaaguauguacucagcacuagaauguguuuauuauugccauguuucaccucacugagauauugugagguguuucuaugugaaaagacuggcacauaauaaguacuucaucaauacuaaccucugguuaaggggcuuggauauauaggaugcuuguucauucuguaaauauguauugagggccugcuguaugccaggcucaguucagggcccuggggauacagcaguguggaaaucagacaaagcccaugcucucauagagcuuacaugauaguggggaagacagaaaauaaacaguaaaauauuagaaaacaauaauacaaaguaguauaauagauaauauaacaugagaauguaugauauacagagaauggggaaaguaugcuacuuagguaaacauagacuagaaagagacagaaggaagagaggaugugaagacaaaguuaagcaagauaaguggauagagaaugacuuggguguagggggcuauuucauuagcuugagcuauaagaaauugccaguauucaaccauuugugaccuauaaaaauagcaguuuccuaugcuucaacuuugaaagacaagguaacuagggagugccuccugaaggaaguggugaugaaucuaaaaccuugaaugaggagacagauccagccaugacuagagcuggaagaaaggcuuuccaggcagagagagcagcaagugcaguggcccugcagugggaaggagcuugacauaucccaagaauggaaacagaggaauuuagugagaggggcacauggagaccaaguuaugcagggccagaauaaggcuuuguggagcagcaggaagcccucauugaccucuauuucuccacagaacccagacucccaugguuaugacaaggaccccguuuuggacgucuggaacaugcgacuugucuucuucuuuggcgucuccaucauccugguccuuggcagcaccuuuguggccuaucugccugacuacaggugcacaggguguccaagagcgugggauggguaagaggcagaggcagggauggagguugaaggggauucugccaggaguuuuguuccugcaccauugggaauggggagcugagaugagggauugguaucaguugaggcucccucacgucuaccccugcuauuugcacuaccaggaugaaagaguggucccgccgcgaagcugagaggcuugugaaauaccgagaggccaauggccuucccaucauggaauccaacugcuucgaccccagcaagauccagcugccagaggaugagugaccaguugcuaaguggggcucaagaagcaccgccuuccccacccccugccugccauucugaccucuucucagagcaccuaauuaaaggggcugaaagu

SEQ ID NO: 14460 - RNA, 7269 nt, Homo sapiens
cucggaggcugggccgcgcugggcccacugaggaacugggcaugcccacccaggagguagcucccuuaccugcuagagguugagggccugagucacucccccuuccagucaccaggaauuccuggagaguuugagaaagcaagaaagauucuuuaagcugguuccugacacaacagcuguuaggccacugaagccugggggagcggccggguggcauuuguggggucagcucaucgguguccacacaggggccuaugccauagugcggccaacagggaaacugagcccuggagaguugcaggggcccagccacugcuguguugucagagcaaaguccagccagccccagugaggcuggaggcaacgcuguggcacccacuucccuggaugccugagaacccugcagaggggccacccacaugaggcagaagacacucagccuucagggaugaagcuacucccugaggucccagggacgggagcuggccuggcaaauacaucuacccugccugagcaguccccaggccuuggcugcccaugagcacucggggacaggccagagacaaggccacuccuugagugcuaaaaguucccgucacaaaagccagacucagcaacagcucaaaacauuauuguccggccaggcgcgguggcucaugccuguaaucccagcacuuugggaggccgaggugggcggaucaccugaggucaguuugagaccagccugaccaacauggagaaacccugucucuacuaaaaauacaaaauuauccgggcgugguggcacaugccuguaaucccagcuacucggaggcugaggcaggagaaucgcuugaacccuggaggcggagguugcggugagcccagaucacaccauugccugggcaacaagagcgaaacucugucucaaaaaaaaaaaaaaaaaaauuauugcuggaccugcuccucccagcgcucaggggcaggagcuugcuggaagucacaugccagcuacagaugcacugggccagacgaccugagaugguggugccaccucacugcacagcccaggcagaggcugugucuccacccagaggguccgaaaggucauguuccacgcuagggcuccgggcggagaggccggaagaggcggggaugccggcgacucaguaguaaggcaaguccugccaccuccuggccggcccuuccgcuggcguggcccucucucugcaagcccuggggcccagcgccagcagcggccccgccccgcguucgcugggugaccggugggcggggcgcccucgagggaccagcaggaacagcagcaggaggacaaacugccucacccucccugccccaagaggugaugguggggggacaaagaaagaagagggaccaaagcagagagagagggguacaguccagccaggugggucccgacaccgugccgagaaccacauccagaccacagcugagcacccaacagcucacugauuggauccagggaggggagaaacuggcuggagcccuccagggugcagcugggagggagacguacaucaauuacuuaauuauccaaagcagguggggaguaaagaccccacccggagagcaacgaagacucuaaagggaggcgccacacccucgggcggcagaggguaacgugagagcaacgggguucaauggcagagccaaauuuaaaacagguuucagggaguauagaaggaggaggcuuuugggauauuaacaaugugaaccucaauuuuuaucaggugcuuucgcccucuugcuguacuugggcagcggggagucugggcaggaacacucuucccucccagcaaaggagcuggacccagcacggcucaucggggauugaagacccagcccuggcccucacaggaggagccaacagcaccacgccaguuacuuccaaccagacagucccgggcagggaugccagcagacagcuggcacgggaggaagcccaaaauaacccagacagcuggggugagggggugccaugggcacaggcgcuggcugccaagucaagccaccuggaaccccauccuggcucuauuggugguggccuugugaccuuggggagucacuucuccccggaccaugggugggugacccaaaucuugaccccaucauggaacagccccuguggauggggaaaggccugcagcuggacucaaccacuccagaggagaaccgcguuggccgccuucccagggagcgccagauuccccuuugcccugaggcagggacacgugcuucagcaggugggcuggugcggggggaagcucugaggcagcccagcccccacccccugcagccacucccagcaauaaccacgaucacaauggaggccaacuaaaagcuugggaggagggccucuuuaacgcacuuaauccucccaccacccuuuccagcaggcauccuuaucacuuuacagggagacacucacccaaggucaccagcacugagagauccuagcccauggcgaacuaucucccuuaacuuagcaccaagauaccuuuagcaagaucuccuuguuaauccgaacaggcccccagagcucgguguagcccucacagcgggaguggggcacaagucccaaauaggggagguggugugaucaggagcaccuggacccaaaugguucaucaaagcaaucacaaagcagaaaucacaaggaggggggcuccgagaccaagggccgccaucuccagcuguggagcuucuuagacacugagaugggaaacuauucaauacaugaagucggcuagcguuagaaugaaaucaauuacuaugugccaagcguggaacguggcacuucugcgucaaaaccccagguguuaccaggcuaggggcuggagucucaaaauguguucccagaccacagcaucagccucaccucaccugggaacuuguuagaaaugccaguccuaaggaccaacccacugaaucagacacuugggcaccaggcccggugguccauuuucagugagccccccuuccggugugauucugaugccgguuccagacuaagaaccacugaucuagcccuguuuucggagauggagaaauaggcuuggaggcuauaccgcuuacgcaaggccauagcuguucaauggcucgccagguuucaaauccagcuuugucugguucuagaaacaaggcuuauauacaggccugcccauucggggacuggagaagaaaacaaucccaggaagguggagaagcgucaaggaaggcccuuucauagagaaagguggccggaaccucgggucucuguucuuugccucucuagcagccagacaucagaggacggcucacacugucaccccacaugccccacgggggcggcuggagggaaggccacagcacaguugggcuuucugacagugaccugugucuuucagaaguaggcggcacccagggcccuccccccgccgaagaacacacaacugggaaauacuugcaaguggauccucucguaugcugcuauauucggcagagacuuacacgccccaaaugccugacaacagaagcugacagacggggauggauggccccggcggcccagcaggcggcccuacgcgcucgcagcugggggggggggggugggguggggcggggccgcagaaccagcccggcguguuugggguucggcccucccugggcugcaggccagagccccccaaaucucccucacggucugggcaaguacucacaccuaccuuagugggaggacugucagagucaaacuaggccugccccugccguugacagaaggaaagauuguccauucggggggugcccgaacgucgccccuucuccggcccagaaccuggaggagaggaagguggagggcggaucagggcguugggggagagagaugugaccggccgaauacacagcagacgggcuccggggcugaaagggagcaccccagacgccgccccucccccagcggcccgggcggccggggguggcugagucagaagguucaaccccggcccgggcggcggcucaucugcauuuccaaaggcccgccccgcccgcacccuccccgggaagggccggagaucugaggcuucgccgggagccccgcgccucgggggaucccggggcccccccuccgcuuucccaggcuucccccaccuccugccuggagagcugggcuggagggcugcccaacggggcgucugcggccaccccgagggccucccgcccugagugaggacaaagggggcgaccccccgccccgcgcugacucggcucucagagggcgacugggaggucggaccugggcgcccagagcugggugggcagcggggggcggccuggggucagggccaggccgguccgcggcuuccggaggagccggugggacccggggcggccucgaagccccgccgaccccguggcccucggcugcgggcgcccgcgcaggacaaagacgaaagagggaagcgguccggggcgaggccuccuggugcccgcgugggccgccgggucgcccagcccccuaccccugccgcuccucccgcccggcgcgcggcggccgccaccgccccagccacgggcagcgcgcgaaauggcgcccaucaggccgccgcgcccggcugaggcgagcgcgggaggcgcggcgcgcgacgcccccgaggcccacggcccccgaaacggcccccgacacccggucgccagcgcugcgccccgcgggcucucggggcccgaccuggccgcgggcccgccuccugcuccgggcuccccacgaccggggggacggaggaaaggaggaaggaaggaaagagagccgccgccauuagcaaagcagcccugcccggcugggcccgccugccagaccagcccggcccagccgcgacgggcucgaagccuguaaagaaaacugguguuugggaggaggagcgagcgcggccgggaggacagcagcuccgggcugcgggcggagaugcugcgucauggugccaacauggacgccggccuuuuguccuccuucgcguugccagcgcaggcgcgccccggagccccgagaagccggcuucggggugcggaauccucacgaucgaaaggaaagugggcccaaggcugggcgaugaggcucccuaguguuuuaagcccccccgucuccaaagcacuucaauuucuucuccccauccagguucagaccugggaagagcgagggggcgaaggcaggcggcuccauggacccccgagggucgcugcgaagcccgucuucucgcccuuggggcagaagaggcacagggguccgaagagcccuucgugucccaaccccccgcccacugcccgcuccggcugccaaauacaaugcuccagaauccuccuucuccucucagcucccaaacacuugcagcccuugcuuggccugcaaaaggguuuccucgaaggggcaaaaggcacuuuuuaucuuucuuacuuacccgcucagcccggugccauggagucuagaagaucaagcugggcggugguuuuggagacguuauuguaaaaacauauauauuuuuugauuuaguugggaaauuuggggguuaugguggugucuuuguucuuauuaccuuuuuguaaguuacacccucacguucugcuccuuccacuucugcaaacuuuccaggguuggguaggcaaaaaggcggcuucgcugaggacuguuuacugcucuggauauagcaauggugugaucgucauuaagagacaaaaggcgaaaauacagucaaaucaaacaaaaggcacaagacgcaccagccgcccaaccaccauagaaaauaccccccacuuaacguugguguuugcuggaaccagcuaggacuuguuuuccaguuuuaaucuaguuuccugugacggcuuuagucucucuacacaaagaaaaggucuuccuuucccucacccaccagcuccccccaacccccaacaccaaagacgagaaaaacagggcuguuuuucuucaaauagaucgauuuucaaagaaaguguacaagcuacggggaagaaagcugacuagcauuuagugcuguaaacauuuucaaaagcauaaagcuagaaccuuagcuuuauaaagcaagaucgucucaagcaucuuaacuggcuuauauuagacaagagagacaaagacauacaugcagaugaagguucggaaaauuaaggacaucucagcaacauuaacaucaaaacuguacugcgucaggacagaauggauuggguacuuacaauguaaaagguuuuuuaaaaacuaaaagaguaacaacugcucacaauuuuuuguugcugccauuucgcuaguccuaaagcuauauacauuuaaaacauuaccuuguuaaaaagagagaaggaguuaauaagauggccagguuuaaguguuuaauagaggaaacuagauauauuuaaaaauuuauuguucagucaagagaauacagauuaagacagcuccaagcuccccccacccacccauagaacaaaaagaggaaaaaaaauaugucauuuacuuagguuuuuuuggaauucaaaacuguuaacugcugacaugaauggugugcuaugaccuaguuauacaagacaaagauggauuccaagucauaaggaaaaauccagaucuuuuuaaaaagucuucuccagucuuccaacugugaguccuugggccuguugacaaauguuaaacacacugagacguccugaacuggaugguagagucaaaggaaaaacauuccccauuugcaacaaaggaaaaacccacuuggccauuuaauuccauugcagaaaaauggcuucccucaucuguuggccucuccuucgugucugaugaaggauguuuugagaucagcgucuaauaacucaagcccuauagaagccgcgcgcugauuggcugccgcgcccugccgcccugcuccagccaauuaccuacccacggccaaauuacaaaccccgaaaagagccccaauaugagcuacaccagcuccgagccccggcgaggcggcuccugcgccucggccgccagagaggagcggcagagggggcugcaaacgcguccucgcgaagcccgggagccucggaguugaacucacaaaauggaagccgcgcgcugauuggccgccgccacucccggaccuuuaauaaagaaaggggaaggaaaagauaaaugcaaaaaagggggacucucuccuccgcggguggcuggaggaagggggggaagcauguguucaggacaauuacagggcgcuccccuccaaaaauaaaaacagaagaagg

SEQ ID NO: 14461 - RNA, 17768 nt, Homo sapiens
ggccuuugacgaguggugggacaagaaggagcggauggccaaggugggugggugggugcagggcucugcaggguggcuguggaggggggcagguccccagccgggcaccuccucuuucccugagacuguuaacuggaaacgcugccguggaccccacuaugggagcuccauuucauguggccacuuucaaaguuccgcaaacugugcuccacuucagcagccacuagaugcacacggcucuuugaauuuaaaugaguggccaggcaugguggcguacaccuuuaaucccagcacuuugggaggcugaggugggaggauugcuugagccuaggaguucaagaucagccugagcaguauagcaagagcccaucucuaaaaauaaaugugcaaauuaacuuaaaugaauuaaaacagaguaaaauuaaaacuccuccuuuguacaugccacauuucaagugcucgggagccacaggugccuagugguaguacacaggauagcuggugcagacugccccccccgcccauugcagacagcucacagcugcgacucccuuugaacuugacuccccucaccuccccucaugccgccuuuuacacggagcccugucuuggaccacuuuuuuccuuuuuuuguuuuuuugagacagggucucgcuguaucguccaggcuggaguguaguggcgcaaucauagcucacugcacccucaaccucccugugcucaagggauccucucaccucagccuccaaguagcugggacuacaggcauguaccaccacacccagcuaauuuguguguuuuucuguaaagacagaguuucaccacguugcccaggcuggucuugaacuccuaggcucaagugauccucugccuuuugggcugggauuauaugcgucagccaccgcuccuggccuacuuacuauuuucuuuucuuucuuuuuuuuuuuuuuuuuuuucggagauggagucucacucugucacccuggcuggagugcaauggcgugaucucagcccucugcagccuccaccuccuggguucaagcgauucuccugccucaguguccuaaguagcugggacuauaggcacccacuaccaugccuggcugauuuuuguauuuuuaguagagaugggguuucaccuuguuggccaggcuggucucgaacuccugaccucaagugauccaccugcuucagccuaccaaagugcugggauuacagaugugagccacuaugccuggucucuuuuuuccuuuuuaacauauuauuugccuguuugcaaucuuacagguaaucuaaaauuacuuauuuucuccauaagagagaacuuuuucuugaauacuuuaaacuccccuuaaucccuccccuccaccccauuccccccugcuccccucccucgaccgugguuaugaguuugaguguccccuggagccugcuuugggaaaugcuugcuuucugccacagagguaagcagcacuugucagagccuguuugucauccguuuaacugggcaguaaaauuagaaugaaccgucugaaaucacugauacacagcucuuuaugguucagccaaauuauacugacccuacaguaacagcuaauagcuauuccauucacaauuugaauaaaaagagccaccaggccucaugugcccugcaccuugcaaagcucuucauguggcucguuuuguuaauucucacagcaucccuuugaaggcagagcauuucagaaccacaggggcaaccccuuagugagcagugaaauaaagccaguagguccuguuuuuaaugcaugggaagagaagagaaaaugggauaguguaaaucuuaccuugugaaggugguguugcacagaugugucccuaugguguaguuuuuggauugucugcaaagugcaaaggccacuguuguaaggaaggcagguacaguaguccuauucuacaggggaggacauugagaucuaugaggcagagcggugcucuagagccucguggguaacggcauaguguggccagguguguagggaaugaggaugcaguuaccugugguggcuguuacugccgaguggaaggcagguagccuggggagggcucccugcaaggguugguggugccagaagcggugacgguccccuccugucuccaccccaggccucgcugaccccggugaagucgggcgagcacaaggacgaggacaggccgaagcccaaggaccgcaucgccucgugccugcuggagucauggggcaagggcgagggccugggcuacgagggccugggccugggcauugggcugcguggggccauucgccugcccuccuucaaggucaagaggaaggagccaccagacaccaccucaucuggcgaccagaagcggcugcggcccucgaccucuguggaugaggaagaugaagguucgugcucugggugcugggguccccuucuuccgcauccccccagcccagcucugacucccucccuuccugcagaguccgagcgagagcgagaccgggauauggcagacacccccugugagcucgccaagcgggaccccaagggcgugggugugcggcggcggccggcgcggccucuggagcuggacagugguggggaggaggacgagaaggagucauugucggcguccucguccucauccgcgucaucauccucgggguccucaaccaccucacccucguccucggccuccgacaaggaggaggaacaggagagcaccgaggaggaagaggaggcggaggaggaggaggaggaggaaguccccaggagccagcucuccuccuccucaaccucauccacaucagauaaggugccuagcaggccaggaagccucagggggccgggccaggcgacgagggccagacccuucggcucaccuguccccacucuuccuucucccccaggaugacgacgaugacgacagugaugaccgggacgagucugagaacgaugacgaggacacagcccugucagaggcgagugagaaggacgaaggggacucggaugaaggugagcagggaggccguggcugccuggcccucccggagucccucuuuccccggggcagagccugagcaauugucagaaauacuucugagccaaaauguugugcuuuugagacguuaccuuguuaaaacacacacacaggguggcguacgguuccaucuucagggagugccgugaacauaauggcauguccauagaaauagaaagcaggucugugguccuuagggcuggggagcccgguguucaggggggcuugcucagccuacauggcuuccuuuucaacugauaaaaauacuuagggaccagaucgagguggugguugugcaacauuacaaauguacuaaaugcugcuggaauuaucacuuuguaacgagcaguuggccggacgcaguggcuuacaccuguaaucccagcacuuugagaggccuaggcgaguggaucaccugagguuaggaguucgagaccagccuggccaacauggugaaaccccgucucuacuaaaaaugcaaaaaauagccaggcgugguggugggcaccuguaaucccagcuacuugggaggcugaggcaggagaauugcuugaauccaggaggcagagguugcagugagcugagaucaugccacugcacuccagccugggugacagagugacacuccaccucaaaaaaaauaauaaauaaaauuuuuuuuacaaagugagcaguuuuuggcugggcgcaguggcucacgccuguaaucccagcacuuugggaggccaaggcaaguggaucacgaggucaacagaucgagaccauccuggcuaacacggugaaaccccgucucuaauaaaaauacaaaaaauuagccgggcaugguggcaggugccuguaguccuagcuacucaggaggcugaggcaggagaauggcgugaacccaggaggcggagcuugcagugagccgggaucgccccacugcacuccacccugggcgacagagcgagacuccgucucaaaaaaaaaaaaaaaaagugagcaguuuucuguuauguuaauuuuaccucaguuuuuaaaagcgacuacuagcggccgggugugguggcucacuccuuuaaucccagcacuuugggaggcugaggcaaguggaucaccugaggucaggaguuugaaaccagccuggcuaacauggugaaacccugucucuacuaaaaguacaaaauuagccgggcgugguggugcaugccuguaaucccagcuacuugggaggcugaggcaggagaaucgcuugaacccaggaaguggagguugcagugagccgagaucgugccacugcacuccagucugggcaacaagagcaaaacucaaaaaaaagaaaaaaaagacuccuagugaacacaugccccacacacauaucugagggccguguucagccugggugccaccaguuugaggccauuggugaggggucuggugggggcuggggcacagcggguccucaggcagccccucgucugugucccccauccagaggagacagugagcauuguaaccuccaaggccgaagccacgucguccagugagaguuccgagucuucugaguuugagucaagcuccgaguccucgcccucauccucggaggaugaggaggagguaguggccagggaagaggaggaagaagaggaggaggaggagaugguggccgaggaaagcauggcuucugcaggcccugaggacuuugagcaggacggggaggaagcggcucuggccccgggggcaccugcaguggacucguugggcauggaagaggagguggacaucgagacugaggcuguggccccugaggagcggcccuccaugcuggacgagccccccuugccuguggguguugaagagccagcggacuccagggagccgccugaggaaccaggccugagccaggaaggggccauguugcugucuccagagcccccugccaaggagguggaggcucgacccccauuguccccugagcgagcuccagguaacaccugcaacccccugggaggguggugggagggaggcaggaaguccucacugucagaaucagcccgggcuuccugggguagaucgcugaccguccccagccucaguuucccguguaaaacgagaucagccgguugugccucccucgagcgagaugagguguugggugccagcacugagccuggcacugcauggaucaacccaaaggggaacgacugcuauuuuucaguccucacugccagcguuucccugguggcuugguccuuggaccaucagucccaugagaugcuccccaaaaggaggauggguguccauggucacuugagugacaagucggugggguaggcccuggggugcugggccaggugagggcugcaggcauugcccccuccggcaucgugaugcugcugcacagagcauaugagaacucuaacugcauggccaguagaacuuuccacagugauggcagcguucucaggcugugcuguccagcacuguagccuucagacacaauguugcuaccaaacucuugaaacguggccaguggcacaguggaacugaauuuauaauaguguucaauuuauuuuggcuuacauagauagcugcaugugguuagcaccuaccucuuuuuuuauuuuuauuuuuauuuuuuuugagacauagucccgcucugucacccaggcuggagugcaguggcacgaucucggcucaccgcaagcuccgccucccagguucacgccauucuccugccucagccuccagaguagcugggacuacaggcacucgccaccacacccgacuaauuuuuuguauuuuuaguagagaugggguuucuccgcguuagccaggauggucucgaucuccugaccucaugauccacccaccucggccucccaaagugcugggauuacaggcgugagccaccaugcccgguccuagcaccuaccuuuaauaaguccuucaggaaaggauuacagcugccccuguacauugaacacauggcuagggcccacggacaugcaguuuucaaccaaauauggacggaaaagaccggugggaugcgaaacccacuguauauggagggcgaucgccuauacguggguucugcaaggcagacuacaagcuuugaguaugugcagauuuagguauaccagggaguguuagaaccaauucucuguguguauugagggacgacuguguuuuguuuaauguaauguauuuuguuuuguuuauuccaccauuaaccacagucuuugaacauugacucaauacuaagccucuauugugucccugcuauuauuuuaggcaguagcaaugcaacaguggaccaaacagacaaaaauaucugcucccacggagcaggggaacagaugacaacagaucaauuagaaaaugaaaaacagguggcaggcuccuguaaucccagcuacuugggaggcugaggcaggagaauugcuugaacccggguggcagagguugcagcgagccgagaucgugccacacugcacuccagccugggcgauagagugagacugucuuaaaaaaaaaaaaaaagaaagaaaaagaaaugugccgggcgcgguggcucacaccuguaaucccagcacugugggaagccgagguaggcagaucaacugaggucaggaguuugagaccagccaggccagcaugacgaaaccccaucucuacuaaaaguacaaaaaauuagcagggcgugguggcacgugccuguaaucccagcggcuugggaggcugaggaaggagaauugcuugaaccugggaggaggagguugcagugagcugagauugugccauugcacuccagccugggugacagagugagacugucucgaaaaaauaaaaauaaaauaauguaaaaauagaaaaugaaaaagauguauucuguggucgggcaugguggcucacaucuguaauuccagcacuuugggaggccaaggcuggcggaucacuugaggccaggaguucaagaccagccuaggcaacauagagcccaucucuacaaaacauuuaaagauuagcugggcgugguggcacauuccuguagucccaccuacucaggagccuuaggcaggaggaucccuugagcccuggcggucuaggcugcagugaccgugaucaugccacugcauuccacccgucucaaaaauaaaaaaauaaguaaauucauuaaaaaauuaagaaguguauccugugacaguggagauaagugcuaggaaaaaaauccuugaaggcuccgacaaguccugcagaaaagagacuuguugaauuuuauucagucauagagcagauuuucuugggccacagggacuuuguucugaagacguaguaugaaaggcuggaauacaugucuccugcaucugugauuuagccuagcaacauugauaaagcacauacugugugccugacacuggguugggcgcugaggaguccuugagggguuuagcuggagaaggacaggucccgugcucagacucagggcugugagccugccagguauggagcacaaaauaaggcacugagagacguuuggauugaauaguaaaugucucguguucgcucaccucucugcagaacaugaccuggaaguggagccggagcccccuaugaugcuccccuugccgcugcaaccaccauugccgcccccacgaccaccccggccacccagcccaccgccggagccugagaccacagaugccucacacccaucugucccuccggagccccuugccgaggaccaccccccgcauacuccaggccucuguggcagccuggccaagucgcagagcacagagacggugccagccacaccaggcggggagcccccgcuaucagggggcagcaguggccugucccugagcucuccgcaagugcccggcagccccuucuccuacccagccccguccccuagcuugagcagugggggccucccucggacaccuggccgggacuucagcuucacacccaccuucuccgagcccagcgggcccuugcuccugcccgucugcccacuccccacuggccgacgcgaugaacgcuccgggccccuggccuccccggugcuccuggagacgggccugccccucccucugccccuuccccugcccuugcccuuggcauugcccgccgucuugcgggcccaggcucgugcgcccaccccgcugccaccccugcugcccgccccccuggccucuugcccucccccaaugaagaggaagccgggccggccccggcgauccccaccaucuaugcucuccuuggaugggcccuugguccgaccaccagcaggggccgcccuuggaagggaacuccugcuccugccgggccagccacagacccccgucuuccccagcacccaugacccccggacggugacccuggacuuccggaacgcggggaucccagccccuccaccaccccuucccccccagccacccccacccccaccucccccaccuguagagcccaccaagcugcccuuuaaggagcuagacaaccaguggcccuccgaggccauuccuccgggcccccgugggcgcgaugaggucacugaggaauacauggaguuggccaagagccgggggccguggcgccggccaccuaagaagcgccaugaggaccuggugccaccugcgggcucgcccgaacucucgccaccccagccccucuuccggccccgcucggaguuugaggagaugaccauccuguaugacaucuggaacgguggcaucgaugaggaggacauccgcuuccugugugucaccuacgagcgacugcuacagcaggacaauggcauggacuggcuuaacgacacgcucugggucuaccaucccuauauccugcuggcauggggggcucugcaccuucugggaugcaggaagucccugcucaccucucugggccccaccacccagucuguagcagcccgcggugcccaugaaggugacagcaugcaccaccgucacuucccaagcaggguuugugucccggcaccaugccaggcucccgagugaaucauuggcacguuuuaaggacucccucugcgccaggcccaucucacccccagaguuagcaggucucagggucacauguaacagcagugccgugcagcuuaacagcacacacgggcgcagggccuccuuguccuguccccuucauaaccucagguaaucccgguagccuggugaagaugggggcuaugauucccauuuuacauaugaagaagcuaaggcucagagagguucagugaccuguccaaagacacagcuacagguggcagaguugagauuugaacccaggcaaaccuggcucuagaguccaggcucuucaccaccaggcuuucaugaggcuuggcuguucacauaggccagugaggcuagaccucucauuaucccugcuguauuagacugauuugugagcacucaguuugugucaagagcucugcucaagugccgggcaccauggcucacagcuguaaucccagcacuaugggaggcugaggcggacggaucacucgaggccagaaguuugagaccagccuggccaacauggcaaaaccccauuucuacuaaaaauacaaaaauuagccgggugugguagcacaugccuauaauuccagcuacucuggaggcugaggcaggagaauugcuugaacccgggaggcacagguuguagugagccaagaucgcaccacugcacuccagccugggugacagaacaagacucugucucaaaaaaaaaaaaaaacucugcuaaggaccauaagcauauuucaucacuugcagagaggcaucacugucaccccaauuuacagaugggaaacugagcagaaaguuguuaaaacacccagcacuuugggaggccgagguggauggaucacuugaucucuggagguugaagccagccugggaaacauagcaaaaccccaucucuacaaaaaaaauccagaaauuaguugggugugguggcgcacgccuguagccccagcugcucagaaggcugaggcugcaguaagcugagauugcaccacugcacucgagccugggcaacaggagacccugucucaaaaaaaaaaaaaaaaaaaaagacaccuagagccaugcaacuagguauugaccgucagcaggguuggucagcgggcagccacguggagguggcaugggagugggcaguagaacuggacaucgcugucccugaaggguggucugaggaugggcgggaccagucuaugaagggaccagaaggggcucucagaauguccauguggcccuugacccacacccacccaccagccucucuucagcuaagaagaagaaacgggacgauggcauccgcgagcacgugacgggcugugcccgcagugagggcuucuacaccaucgacaagaaggacaagcucagauaccucaacagcagccgugccagcaccgaugagccccccgcagacacccagguacugccagggcuccuggacacaucagagccugcugggcugggccacggggauccagggcacucauggaggggugccaggcagagggaggaguugugaggccagaggggcuggcacacagagggugcaaguggaaggggagaggcgggugggcggggccuaggagaaggaaggaguuugccuuagucccaugggcccuggagcaccuccaaaggguuuaauuagggaugugacggagcuguauuuccgcaaguucauucauuuuuuguuuuuugcuuggguuuuuuuuuuagggggggacaaagccuugcucugucacauaggcugaagugcaguggcacagucucagcucacugcaaccucugccuccuggguucaaaugauucuccugccucagccuccugaguagcugggauuacaggugcccaccaccaugccuggcuaauuuuuuguauuuuuaguagagaugggguuuugccauguuggccagguuggucucgaacuccugaccucaaguaauucgccugccuuggucucccaaacugcugggauuauaagcauaagccacaucgcauggccucauucauucuuuuuuuaauccaguaaauaucuguugaguacaugcuguguaccgggcacuguucugggucuauagcagugaacaaaaccaaauccuauuccucguggaauuuaauuauuuauuuuuauuuuuaaauuaaaaaaaaauugagacggggucucacucuguagcccaagcugaucuggaacuccugggcucaagcgauccucccgucucagccucccaaaguguugagauuauaggugugagccacgguacccagcuggaauuuauauuuuaauggggacucauaggaaauaaucaagugaagaaagaagcacguaauuccaggcagggaaaaugcgauggagaaaacaggagagggguuagggauuaccaagucaaaggggagucagagagggucagacccaggcgaagugugggaaggcgccauguggaugccagagagacuacagagaagugaaaaagcgacuuccauaaaaaguuaaaaccagagaggggcucacugaccccagcaggccucccuaggacagcagcagugcaaaggcccugaggcagcagggagcuccauggugugaggaagggaagggagaggccacuugugggagagacagcacaggccaccagggucggggguacuguggugguaagugaccugucuccuggggugacaggcagcagagggagguugugagaggagcuggggugguguggagcuggugcagggguccugagggcagacuguucggguugcugcgguuuccagaccggaugugccggacuuagcugggccgcgaggagccauuagcuguggaagaauaugaggaagugggauggacaggaccagggcuggccuggguacaggagacagggaugggcggggggugacagcccaggguguggcuggggucgggggugcugggaagcuggacaccaggccugagauggggaggcugauaugcuaucaccacgaggcagcuugaguucugcggguucugaaaacacccaggcagagaggucuuggugggcauguggguauggcggagcuuaggauggggaucuccggcccggggaccuaaguguaggcaucgccaggagagaaguggugacugaaggucacagcagggugaccucaccugggagggcacuuggggcagaggccugggaugcuccaaagguuaauggcuggggcagaggcccagggaggccaagagcaggacgugacacaaggguuucggaaggauccccgauuuugaacgcuuguggggugagaggggucugggugagagccaaggagggggucaggguagacaaaacuuucggcugaaauggggaaaagacagcgccaggcaagagugagucucgucguuuugaagauagaaggagcuugagacgcucagauacugaugggauggaggaggcagggaagcggugacaauuagggaccgacagguguggagaagcccagagcaaggagcccaggacacuggggaugacagagauccagagccuagggugggaccgccgaggacacggccagcuccgcugagccccgcacaccguccacugcagggcaugagcaucccagcacagccccacgccuccacccgggcaggcucggagcggcguucggagcagcgccgccugcuguccuccuucacuggcagcugugacagugaccugcucaaguucaaccagcucaaggugaggccgggcuucacccagaucgccgggguggcggcaggaccugagaccggggcucaccucucccccucuucccucccacaguuccggaagaaaaagcucaaguucugcaagagccacauucacgacuggggcuuguucgccauggagcccaucgcggcugacgagauggucaucgaguacgugggccagaauauccgucagguaggcaccgcccggcaggaugggcaccggggugggcauggggccggcccagccagacugacccccuuuuguggccaggugaucgcagacaugcgggagaagcguuaugaggacgagggcaucgggagcagcuacauguuccggguggaccaugacaccaucaucgacgccaccaagugcggcaacuucgcgcgcuucaucaaccacagcugcaacgugagugcccagcgggggguggccccugccccugcuccugccccuggcccugcuucugugccaggagggccuggaagccccggcacgggaaucagcucggccuccuucccaagcucagguuggccaaggguuauagggagaggaggacaugugaggucuuuuaccaggagcucuacuccucugagccucaguuucucaucugucaaaugggcauagugagacuucuguggcauuuagaggacucaaagaagugguugguucaguucauugguaauuucggaguuauuucucugcguuagccuuuucuccgugccuucauuggucaggcucaguccugcucgggccgagcuguccacuagaacuuucugcaagggggaggugcacugcgugcaucugugcuguggguuagccacaugugugguggugagcacuggaaaugugcccagugcaucuggggaccugaguuuuaaauuuuauuucauuuugaugaauuuaaacuuaauuagcuugugacgacuguauuggguggugcaggccuagaggggagggacacugauaacagggauuugagugcugaaggaagagcacaggaagcucugagcaggaggcaggcauguuccgggguggaugccccugacuuuggguucaagucuuggcauugcagcuuagugaguuacuuaaugucucuuaugccugaguuuccuugucuguaaaacagagacaauaacagucucuccuuuuagguuguugggagggccacauaggugggucacugcacgugggccauuugagugcuggccaggccaguccucagcgccugcuggcucucuucguugugacuugauccuugccugggugguagggacuuuccugugaauauccggggagaucugaggggugagagggaauugcccaggggaagcggugcuggggcaaggggaacugcguguucaaaggcccuggggcaguugggagaacaccuguuugagagauagcaagggaggcagugggcauggggugggguaagaggauggggugggcagggcugaggguggccaagcugaggaacuaaguuucucugagagccaaggucgcuggaagguuggagccaucgggcaacagguucugcuaucccuuuggaaacguuucccuggcugcuggggcaggaguggauuuuuucaggggugagaguggccaagggggcuguagcaggcgggugagcagugaugggggccugagcguggcugguggccccagaaguggagagcaguagacacaaccaagaggcccuuccgggacugaacucaccggcccugguuggggccagaucuggacugaaggaggcagggaggcagaugcucuggggccuggguguguggugcagcggcugcccagagcaggagcagaucaugcuuuaggugugagcuaagucaaagacaguacccagggcugccacuggcagacagcagguaguugcauuuaugggcuuggaggccuuuaccuuuucuguaaagggccagauaauaaauguuuuuggcuugguggcucagaugaucucuauggcaacuacugaacuuggcuauuguaacaaaagcagccacaaauuauaugcaaaugaaugggagaauggauauggcuaugugccaguaaaacuuuauuuacaaaaacaggcugcuaggggcuauaguuugcugacccuuuuuuuagagcucagaagugagaccugagcuaaaaauagacauacauuugggaggcacuuguacuacgaauggaaaugaaaggccugggaaauaauuuuuaucaucauuauuuaauaucagaggcaaggggucaccccugggggucgggggagccaagguccagagcagagcagugggcugggggucacguggcaugucaggccuuaagcacaggccugguuggguuuggggggucugcaguggugggggacccugggggaccaggggcucauucucccccccaccuugccugcagcccaacugcuaugccaaggugaucacgguggagucacagaagaagauagucaucuacucgaagcagcacauuaacgucaaugaggagauuaccuaugacuauaaguuccccaucgaggacgucaagauccccugccucuguggcuccgagaacugccgggggacccucaacuaggccccggcaccagacucaaaggaugucagccguagcccugggacucccgagcguggagccccuggccccggggcccggccccccgcgcccgcccccauuucaggugcuguccucuacccagcggccauucagggccuggcgccccacacuacccccuggagccccuggcuccggccccuccgcgggaaagggcuucucugucguucagcccacgucucucucauuuuaacaaacgccccuuucaggauuucuguuuaacuccagcaucagcuucucucucuccgucucuccuccccucucucucuucucugucucuucucucucccaccaucacccucggccucuuccugugaaugcugcuacguuguuuugucuucucuauuuuuuuccucguugugagaaaagacauuuaaccguugaaaugugaagguggaaucagagaggggccccgcgggggucugcagaggccucaguguggcugugcguggcccguguccuggaagccacccggaccuggacgcagggccaggugcugugggaaggauggaggcccccacggccuugaccucagaacacuacgcccugaaagcgccccucacugcccgugggcacagugaggagaccccacaccuuuccccacccgagcugcagccuguuccuuccccagaggccuggggcaccacugacccgguggacccugauggagcuaagcugucccaggcaggggucuccgcucugggcuuucccugccaccucacaccccagcacccccuaaaccuuggguucaauguuuacuuucucauucggaugccagcaacgcgggagccucucggaggccccagugcaggugaggggcgcugagaacgcgggcagccacucucuucugcccuugccuucgcccugggugggacagggcucccaagggcaggcgggucccccagucccgccauuacggguugucagaccgucugcguguggcauuuuuuggcuuauaagcuucacccacucacccccaacccacaccccacaucccccugccggcagccccucaaccuaagaaggccagagcauauuuauuuucggagggagcagauuacuucucccagagaaaggaaaaucuuggaaaagauuuaaaaacacaaaucuaagccuugacgguuuuuuuuucccuuuugacccccuucccaucucuucagaauuuauucccauggcuuuuuuuuuucuugugcguguauaaaaucaaaaggaaggggaaaaagguuuuugaaguucagaaccaacuucuguauauagaggcugccgcaaaggacuuucucuugggaacauuguuucuuguagaaacaugcgggaagacauuuuuugcucauuucuuuguacuuccaaaaaaaaaggaaaaaaaagacaaaagcaaguccccccguaccccagaaagcagaggaggcguguaaauaauuucuggaaagugacuguugugacccggaguccucaucaagaugagcgcgcuccaugagggagcugcucccacccugcggacgcaggcggccggagccucugguaucucagcuugugucaagcuuguuaucauguaaauucuguacaaagaauuguuauuuuucucuuuuuuguuguuggugguuuuguuguguguuuuuuguuguuuuuuuuuuauuccuuucccccaggcccucucuauuugagacugugcccgccgguuucaagaucaaggaaauugguggcaacaagacacagaugggguaccugggcacagcggcgaacuucucuuccguuugcgguuuucugccuaauugugcaacugaggaaauaauuuauuuuucacaugaggaaaugcguagcuuguagagacggcugauucaaguuacauguacagccuccaaagggcugucuccauucuguccccuucccauaaaagaaguggggguguucgagaagaccagggaagggacccuugccucaccccucccccuggccucaccuugcucccagccaucgugcccaguguuaaccucggcuggccuucacuaaggggacuagaccucccucuccccaggagccccagccccagagugguuugcaauaaucaagauaugugucgagucauuuuucuuucaacucccucauuuuucauugaacaaaucucugcuuuucaagaguuggggguuucugcuauuuuuugcuuucucucccucccccugcaaagaugagaaccaaugaguuuuagggauguuugugcggguagacuccaucauccauauguaacuuguuuugaagagaaguguuuccguugugugucuugauguaaauauuuguucauauuuuugugaauucaauacuauguaccauuguauuauaguaacuuuuauaaagcaaaccauaaauauacugacuuuucuuacag

SEQ ID NO: 14462 - RNA, 2071 nt, Homo sapiens
cugucuccuaucaaaauuuauugaaaugguagauuuuugguaaguacagaaacacaagcgaaggaaccaggaggaacgugcaccccucuaacuguggggcagaggcacauuucccuuuuaauguuaaaagcaaacagaggugggaaacagcuuucuauccugaagccguuuuaacugcccaacccuuagauuacuauaaacaagagaggaauggauugcauuagucgcugguugaaagcagcaaugccauuuccuuucccauaauaacacuguuuagcucagucccuucuggggcuaauccccuauuacacccaccggaaacacagauauuaaccaaagcgugugagucucuucccugaguccauuucugcuaaagcuugucugaaagaugaauugguccacggaagccaggugaccuacuggcuuguuuaaugaugccugggcucccuccaggagcaacacaauucccuccaaucucagcucuccuuaucccugcuagagcucacaagcaggcuagauaucaccccaggagcugagcccccuccagucugaggcagaugugggaagaaggccaacaagucacaaguagaucucuggcuccaacucugcucagcagaaaugccuacaauuugcccaucuucaguccugcgagcgucagagaugaagcaaaaguuucagaugccuagaagcuuuacucucuauuccuccaggauuccugcggucacaccuugcaaccagucucccacucaucugccaccguuucccuaaaucgcauucucugaaucuggaaguuccaggaaaccuuaggccgaguccagugacauuacucgaugcaacagcccaacuguuucuccagagauccugguucuuggugacaaugucccuucuuggcaugguuauuuaaggagagguugggcccagauaagaggggcuccauggcucaccggaguuggccauuaacgccucuggagcgccucugguuuuguugggguccccugugagcucgacgcucgugcugcgguuauuaucuggcucaccugucaucuuccucuggaggcagcgguugaucaaaguggagaagaaguugggaaaggaugggcuggagaaguaguacaccacgggguccagcaugcuguucauguaggugaagcugagagugauaaagaacgccagguccaccgagcgguacacuucacaauucugcgugcccgaagugugcaggagccagaagaugcggauccgcacaaccacgcugggaaggaagcagaugacaaagacgauggccaccaccaugaugaaggugauggcucucuugaucuuggcaugccgguccauuugucucugccgcaggcuccagauaauucuggcugagcagaacaggaugaugcccaggggcaggaagaacuccaggaggaacauggcuucgugccacuggaagguauggcagaugcugaagcugcugcacaaauuugcaccgccauucuggaucggcaucuucuucuucaggagguggacugucaggccaauagugaugccccacagaaggcaagagaugauggcugcuguccgauuggagaucuuguucagggcgugguggggauggaccacccggaaauaccugucuaccgccaccaccgugaggaagaugaugcugcccuggcgguucauagccaacaugaagagcaucagccggcaagggauguccccaaacuuccagucccaacgccucacauaguuguccaucaggaagggcaggcagaugaucaguagaaagucagccacugccagguugaacaggaaaauccggcuggauuuccaggacuugagguggaaacagaaaauccacagggcaaggccauugcccagaagcccgaagauaaacuccagccccaacaccggcggcaacaccuugacaaugaagucaucucggaacacacagcaguucuucuugucuauuuccagaaagugauccugcagauggugccgauucaugagugcggcuagugaguccgauggagcgccucgccuagugaaugcuccagcaaggaggugugugucuguguggugaacg

SEQ ID NO: 14463 - RNA, 5101 nt, Homo sapiens
gggaucuugcaaagcacuuuauauacgucagcgcauuugacucccaaaacagcucuaggagguaggugcuaaaugaggaaacgaaggcaccaaaaggugaaggcucaccuaaagccacacagcuggaaguggcagaagcagaaugggaacccgggcagccugguuccuggcccugccauucaccccucugccaucuagaagaugcuacugguggcccacccgaguccacuggggggugaugccugcugcugaggguucacaucugugcucucuggaggcuucccuuggcuacuggaaggcacccugcccuggagauaagugucugggaaguuauucacuccucucuggcccccucauccaggagccaguaaccgguggugugggcacacugugguacugugggcucugccuggagcucuccguggggccagcugaggcuggacguccucugaagccacuuccuugcccagcugcucccuccccuccccugcuucccugacucccucgcugaagccccauuccagacccugcuucugacaaaccugaacuaaggcagcaucuuugcccauagaaugacccagaagcuggcacaccguugagccaagaagugcaguaggcugcggggauuuuauuucugcccccagaccaaggcaacggagcccucaccugccugccacccccacacugggcccaagcaagcucaggugagcgcacauacauccaccguggcgggcuccucucgggugaagccaucaccgaagcccucaucguccaccaggucgggcucacggcagcacaugggacagaggcuguugcgcacagcagaggcucggagccagacgacaagguuccaacgcucaccagugcccaagggccgggcuccaugcagcuggccgccacgguggaggacacccuggcccaccacgugcuccaccuccaggggcuccgucagggcugugggugccugcagauggcacgacucaggccugggcacucacagcugccccaggcccugccgcaugggucacacacucaccuggaagaggcccccaaaauacagggcgcccccugugaagaccuugcccaaggccacauugagggugagcucggcauuaucauaguggcagcccagcuccagguccuggcccggugcguauuugaccacaaaggcccgguggcugucgagccggcccccgccacagucaggguacagcagggccaucagcggcugcaggaagcgcucccgcaguggugucaucagcggcucguccagcccgagcucgugcagcagcaccugggaggggauuccuggggucagcaaggaaacuagagggcugcaacccugggcuuccacuccacggugaucccacugugaccuucuuucgcagcccgggcaggcagcccaucugcagaaccucugacacugccuccugaccccagccacccccuccucugccaccggccaggccucacccaccccguaguuguucaugguguugggccuccccuuaggcauguccgauugcucgaagugcuccagcucuuccagcagggccuggcagaagggcgcugugaaaacaggcacccgguagaugcgcuucuccucuguggaaggagggauggucuguuggccugaauguggccgugggccggccaggccugggcuucagucuuccuguuucaucaccugugccauggagaugaggccuuugcuuuucagggcuauugugaugacuuaaggaaguaacaugaggagcaggggaggccgauucccaugccccccacuuaugcccggaaccuuuccccagacucuacaaguguccacagggcuggcccugggagcucacauauggguccugaggcccagagaggggaaggaaguagcccagggacacccagcaggccagugacagccaagucgggaucacagagccaacuucaggcucucucugcaccuccuuucaucugaugagccaccgaagucuguaccccaacucagaaguggcucugggagccucugucccccagcaggaaggccagaaggggcuguucuuucuugcugggcccugagggggaagaaaccaggcugagaauggaaaccuaaacauuucuuggcggacgcaccaaugcccaggggugcagggcuagugugcccacgauggggccaccucgcagccuaggcccugccccagccaacagccucagcacuaucucagcugccggggaguggaaggcaaugaggagagcacccccaggcugggaggagggggauucauuccacccaugacucccaacaaagcacaggcuccaugaggggaaacuuguaucugccucccacaggagccccuagcccaggcuaucagugccaauaagaauaggaaacacuuuccaaacacuacgugcgggcccugugacaggcacucuaugcagauuaacucacuugaucgucgcagugccuuaagagaggggguuacuguugcucccauuuuacagaugaggaaacugaaucagagguuaaacaacacgcaaaccucccuugcccagcauuuccugcuggguuuagccaauaagugagcccagcaagaaauccgaagagaaguggggcauuuuuugcccuacuuggaguuuggcauggccgcaggccuccgcccagagccacaacuccaggugguaacugcucccuccuguugccagcccuggggggccgggcuuugccauuccuuacuggucccuuuauccugcccauaccugucucaauggucccuuuaagaucuuggaucagcccuguuugagugugccagcugucccacacaugacacaaauauccacuauuugcuggaugagggcacgaaggaagggugaaggaaagaaugaagauaccaggcucauggcagguauugaaugaaugaaugcggauguccugcuccuggcagguuggucccacugacccuuccagcuccugcugguuugguuuuuggaggcagagaugguggcuggagggaccccagcaucccacacccagguuucccaggcugccauucccugguccugccaggucucagggccaggaccucacccgauacugucuccagccgcuggagaaggcccuugaggucugcgucuggggacacgcuguacucagucacggccaggaacucgggggccagagcugcauccugggagcaaaacacaccagcuguggggcaggcagcacccccagcccuggaugcuaccuccucuuuccaguaccggccuucaagcacucuggcuggcugguaccugcagugagucguagaccucaggccgugccgggugguaggaacucgcgaugagggcuuuccuagcugcugacuccugccccagccgcugccgccgcuccaccuccugcucaagcugggguggcacaggguuguuaccagguggggccucccauccuccugaggccacuguacagaugaagaaacugaagcccagaacgccagacagggcccaggcuggaagccaagucuagccuacacuccugaaucuaucugggucaacugcaaguuccagacuguuagcugaaagggacuucuagaaggggacccauccuguuucaggcugccccaaccugagccuagcugggaugagaaccccuagauguaccucaaccaucugggcccacacagggacaggagacagucauggccaaguccuguguuccagagguugcugaggacucuccugggaagcuucccaccacugacuccaggggaaggaggaggagggaguggggcagcagcccuggcagcagccugcgggguauaugguaaggugugaggagcccaggggccuggaagcuguggcugggaucacaucugcuccugcuguaaaagcuugggcaagggaucccucuuuaagccucagcuucucaauccaaaaugagaguggugcuugugcuuaucucacagagcuguuaagaacggcaugacuaggcaacuuagcaacuuagcauuuccccuucucucuccuggugccaagacucagguguggagggaugaguggggggcaggaaggaggaaagugagggccuaagugacccuucagggaucagggacugaggcuaggcucaagcuguguccucaagcugcggacacaaaucuaacgaggaggagcugugcaggggcaggggacugguaccucugcuaacagcugcuggaaguccuuggcgcuaacacagccucggcugcgcaggaucugggagcagaaagaacacugagcaugacuguaugaccugaggaaaucccuucacucucuaagccucaguuuccccugcuuaaaauggggagaggagccccgaccucaaaggaucauggagagaaugaacugcggaacccugucaagcucaggacagggcuccgggcugguguugcugugaggcggcaagcugagcccggcccuguccuaagcacccuacaugcuuguucauuccuuccucacaaucucacagggagauacuauuaccccuuuacggugagaaaaccgaggcagagagaggccgucauucuuguauuugaagauacggugcgcggcgugcgcaaagcaaacgacccuggggacgaacuucccuccuccacuaccccucucugcccacugcuccguagggacgacagcggccacucaccgggccguagucccggcgcagcugcugcucgccucggaagcgcacgugcagcccauagcgcgccacguacaaguuaucggugcagaagcaggcgcagcggcagaagugccgcggagcccccaccgucgccauagugaagcacccacagcccuaccagcuuccguagagagacuucgggcacgcccccaaccgcgggaggcgcggaaccagcggccaaggggccgcucuaaguucccaagggcggaaaaggacgaagacgcaccucgccaggaaacggucugcggagaaagaugcuccugggccggguugggaccggcggccuccucguuccgccucccaguuuucccacuacgaggcagggacuaauggcuccacuuuacagacagcugaacugggucgugccuucacaggacggggagaggaagggacucggagccc

SEQ ID NO: 14464 - RNA, 2233 nt, Homo sapiens
aagucuauccagggggccuuuaauagcugagaagugcugcucuuucagaugggggugccaagcaggccggugaccccaaccuccacccccugccccugagaagagacugggcugggccagagaccaauccacgggggaaaggccaccagcacccaucaggcuucccacuggcacccugaaaccugcccaggcugggccgccagcgucguccacaggccuuggccagcgggggcccucagggaagcaacccagcucgcaucuggaaggccaggcaguccccucggguggcuugcuggggaagaaagcacacaggaggagggguacaucacaaacagagcugggggcggauggcaggcagaggggccacacccaccuuguugaucucucugugucguucuuugguuacgauuuccucuaggaccucgccaucucccuuaauaagccugggggugggagggucuccguucagcaaggaauaggcagguccccuaaugccagaggagcagaaccacaagcagccggcagaggggucccagggcucccaccccgcagccuugaguggacagacccuggggccucacccacucucccugaugaaggcaguggagcugggcucugccuugccagccucagcccggccaacaacagcccuuucaagagccuccuccaggcccuuccagccccugcaacuacuuacuccaagugaccguauuuuugcccacauuuggccuuuuucaggcaccaggaaccccgcccggccccacuccucccgagagcacacaucuucagccaacacucccagauccugugguguaagucaggccgaaagcuccccaccuggugcgccccgucucaggguccaccaccuugcggaugaugcucugccgggcaucccacuccuccuuggucaugggcuucauggccuggauucgggacuucugcucauccgucaggacuggaagggaagacggaggugguggccaggccuugggaagcgaccuucucccucucaggugcugggcagcacaguaccugggccauccucuuccuccccagcugaucggugccacugguccagcgaggggcccggcagagccuccaccugcugugcuuccgccuucuccuugcccuucuucuucagcuucuuccucuucuucuucuucuuccuccucuuguccuuguacuucccccgcuucuuccggccaucacuggaggaagaggaggaggacgaggaggaagaagaggagcuagaagaacuggaagaagaggaggaggagcuggaucuuguucuccuccgggccuucugcuugcuucucucugugaugcagggagaaggugaggcuggaaggccaggaggggaagagguaaaccuucguccccugcucuggccuggggcaggcacagaccggcuacagggugagcgcuuccugaggggcuuuccagaacagagauggagcuucccagaggagccccuuccuggcuccugcggcgccuggcccucacaucucaggcccggcugcacagaggcaugacugagcguccccgaccacugcucgcccgacuuccccggguaguaacugcgccuccucuccccgaugccugugguccucacccuccgccccaggggccgugcuggccuugcgaccuugggauguggaggccgagcaguuccucgaggugucuuuccugcucuucuucuuucucuuuuccgacccccguccccgggaccggcugcgacuccucgagcgcuugcgggagccgacgugagccauggcgccgcgggcuggcgacgaagaagacgcgcuugagccgaagcccccaaggccggccgcgggcgggcuccaaggguggcucuagcggggccggggccuggcgacgcccaguacccgucaccgucccgggaaaaugagcgacccucacccacccccagcgcuggggaccccgguuuucuccgccgacuccaguccccgcagcggugccuguuaagggcccgccccgugcccggaggccccacgccugcgcacccggcuccaaaccccugggaacuggccgccguccgccgcgaguggcgucuggggcgcuuucccgcgcucuccuacccuccagccccgcgcccuucgcggccucgccgccucaagggggcccccggggcugcuccguucccaccucgaccgcccugcgggccggacagcccgccccgcgccuucucgagaggaagcggcggcgaggaggc

SEQ ID NO: 14465 - RNA, 873 nt, Homo sapiens
gaguugcgcucaauggagccgggccgggcgccucggggcggugcgggccugaggggcggcagagcgcggggccggagaggaagggcggcccgcggcuccuccgggaaacuuuggcggcggcggcugcgaggccgggugaucgcuuccccacagggaggccgcgcgccccgccccaaucccggccuggccaggggcgcgcccgcuuuccgccgcccgggggcgccccgggguacccccccaagcgccgacuccgcggccugcacuccgggccccccucuccagccgccggacccgcggcgccccucacccgugccccggccgccccucccccgcccggcgcugacuccucccaccacccggccgccgggagggguccaggccgccccgggagagggggccgggggcgcuggucucgcgggacgauucgcugcuccggguagcggccccggccuuggagagggauggaggggucacgaggagguccccgggcuggggcucaucccaggaagagaacggggaccccccccggcccgcagacacuccgcgcagacccggccaccaggcggacuugcagaggcgcccggagaggggccgacgugucgaggaaugcuggauccccggagccccagggcgcgccuccccgagccacauccaucacuggcuccuugugacaugaacgccacuucacaguagagcgaagcccgcuuggcauuccagcaccacgaguucucuugucccaaggcccccuguccauuugggcuggccaaauccacuuguccaucagacccccucccacucccgggagaacguuuccugaacccagaaccccauccacccuccccgccccccacgcaggaguuaaggacccccuug

SEQ ID NO: 14466 - RNA, 12151 nt, Homo sapiens
gucagcuugcaguauugaugcaacaccacaucagcgucuuucauagaguuuauuugaaaagaugcugaauuuauucccaaguauaauuuuaaaaagcuguuuaggacccaaacauauuuaaacaucucuuacacauacagaauuucaguuuacaaauauuccagaaggcauuuucuuaagcagugaaccaugcagaauacuguugcuaaacaucguuucugccuuccucguguucucuugguaguuuuuacuguuuggcuugauccugcugaggaaugugcuuaccacuggaagccagaugcagauucagcaaguguuucuugccucuuacaaggcaccgcguguaacguccugaccagcuguuggucauuuguggcagagggguguggcugcuuuucgccugcaucucgcgugcuuuaggcagaucagucuggagugcaggggaggaugaagacagguggacuugggcucaucuuucaucaguuaaguagccaauuaucuaacuuguauuucuggaaacugaaaaggaaaguuucuagaaaccguaagaacaauuuaaguugggauuuagaauagcugacacauuuuuagaugggacugaaaugaguaagaaagguucuccaagauguaugauuuuaaguccuuacuccauaaaucuucauuaaacacaucucaguuuuggccugacucacuggggugucaagcagcuacucacccugccucaacuacguaagcugcaccuuggcaggaaagggcucacagguuacagauagagcuugaugagcucaucgcugacugcugagggugucagcacgcccaggucuguaaacagcagagugauuaaggaaggggcaguguagucgacccacggaugcuccucuuugaggucuuguccagucugcgcgaccuugagagugucugccuuauacugaggagagaaguacacauuagucggcacugaauauuuagugcucugaccugguagggccuuggugugagugaucagugugcuacuuccugagacugcucucugaaaaugggagaaacuaagcuaugcaggacacuagagacgagggcagaguuguggccaugagccagaucauggcagugugcuggcugagagcuguaguguaacaaacuuaaaucccauguccccucauucucaugccggauuaacuucuccagaccucucaagggaagaucgagagucacaauagagagcuugcagcgugccagggacugugcuaagauuaucuuagaauccucaugacccugucagauacugcuaugccauuuuacagacaagaaaaccgguucagagguugaaaugaaaggacuugccucaacucgcacaguuuguaaguuguggugaugggagcugagcucaguuaagcccaaagcugggacuuacccaccagcuucgggcuuccucuccacccaucuauggugcuacuuaaagagacugaaagacugaaguucuagggacaaaugugugaguccaaucaccaauuuaucuuuguauuccaaguguuggggaaaguagcaauaggaagugaaaaaauuacuggaacauucuuaggacuacaauuuccaaagguuucuguuuagacuuuaguaccccuucaaauauguaaaacucuugccuuaaacuuaucugggacgucuugcugguuuaguggaaagagccggacaaacuugaaacuuucugcaaccacauagaaagguuuguucugugcuuuggcacacacagccaucugguugguuccaaucugggaaggcagaaaauggaauggaugagcucuagagugcaucugaaguagaagccacagaaaagcgggccgggcacaguggugcaugccuguauuccagcauuuugggaggccgagguggguggaucaccugaacccaugaguuugggaccagccuaggcaacacggugagaccucgucucaauuacaauaaaggaacaauuaaaaaacagcaauagaaaguuauguauauaauauagauauacauauaucuaauacauauauuagauauaucuaauucugacuuuggaaucaaaaaaauaaauguuucucaaaggauauagaaacagccacuagaggcuggaugugguggcucacgccuguaaucccagcacuuugggaggccgagguggguggaucaccugaggucaggaguuugagaccagcuggccaauauagggaaaccccaucucuacuaaaaauacaaaaaauuagcugggcauggugggauggggggugccuguaaucccagcuacuagggaggcugaagcaggagacucgcuugaacccgggcacuggagguugcagugagccaagacugugccauugcacuccagccuggacagcaagagugaaacuccaucucaaaaaauaaaaaaauuuaaaaaaacaaguguuggcaaggauguagagaaauuggaaccuuugugcuuugcuagugggaauguaaaguagugcagcugcuguggaaaaucauuaguuucugaaaguuaaauauauaguuaccaugugacucaacacucugccugcagaccuccgccucccagguucaagcgauucuccugcgucagccugccaaguagcugggauuacaggcacccgccaccaugcccagcuaauuuuuuguauuuuuaguagauaugggguuucaccauguuggccaggcuggucucgaacuccugaccucagaugaucuaccugccucagccucccaaagugcugggauuauaggcgugagcuacuacgcccggccuuauguuacauauauuuuaacuaaaaaaagcuuucaugaagcuuuucuaaauuaaauaauggagagagagauuguaauaaauugaggucaaaugugcucaauuaaaaugaaaacaaaugacaggccggccacaguggcucaugccuguaauccuagcacuuugggaaguggaaagauugcuucaggcuaggaguucaagacugcaguaagcuaugaucacuguacuacacuacagccugggcaacagagugaaugugucucuauuuuaaaauauauauaauauuuauauauaaauacacguauuuuauacauacauacuuuauauguaaauauauaaauaauauuuuaaaaauauuuguguauauauauuauguguguguauauauaugcauaaauaaaacauacauauacacauaaauaaagcaaaaaccagacaaaccccaauuccaauucaagccaauuuuguauaaauauaaauuacacuuuuuuuuuuuuuuuuuuuacugagacagggucucaccaucgcccaggcuggaaugcaguagugugaucauaacuuacugcaaccucaaauuccugggcucacgugauacuccugccucagcuuccugggcagcuggaacuacaggcaagcaccaccacgcccagcuaauuuuucuaauuuuuuguagagacaggguuucacuauguugcccaggcuggucuugaacucaaggccucaagugauccucccacccuggccucucaaauugcuaggauuacagguauaaggcaucacaccugaccaaauuacauugucuucauuuauguagaucaaucuaaaaaagauuugacugaaacuggacugcccauugcuaugacuuacgggaaaugggcaacaacucaauaccaugaugaaguccugaagugaagcaggauuagaaggaaccauaaucaacacugcugugguguccuaggucagcaagacaccuccaagucuugagcagggaacuggggagaacugaugcucuuaccuuguuaauaauuccuccguuuucaacaacuccuucagcaccaacuaugacaagaucugcuuucuccaugauguagcuaaggggaaaaaaagcuuuucaugcuuuauuuucuuggcucuaacgaguagcaucaucaucugcaaagaucaauauuccauuucuaucaagguaaguuccucccauaacuaccuguuuuuuuuaaagcgcacuuaacacgcgauagaccccuggcauuguuaccagggguguuuucuggucaugacccuacaaugagacauacacuucacacugccgcccggcgcaugcacacguacauauguguguaagugaagcaagaauguccugacacagcagucuuccuuccaagugugguauccucuacuuucuuuucuacuucagcacaaaccaaacaaaauuuuaaaaucugaugagaucugaaguuggacaaaaguguuaugcaguuuuaaaaaucuuucuuuuuuuuuuugagaccagaucucacucuguugcccaggcuagagugcaguggcaugaucucagcccaaaccucuaccucuuaggcucaagcgauccucccauuucagccucccagguagcugggaccacagcauaugccaccaugcccuagagaugggguuucgccauauugcccaggcuggucuccaacuccugaacucuagcgauccaccugccucagguaugagccacugugcccaaccuuaagaaucuuucugguaggaugaaggccaauuuagucuuuaaaaugagcaauuaguagaauuccucaaaauccuuacuuuugaacacauuccuaauuuccuuaaucaucuaucuuguuuucauuccaagagaucacuacucuuguuuuuucuugggaaauacacugacaaucccaggaacaugugacuuggcuuugcgacacaagcugcaucuucuaggugagacaaagcaucccaguaugccacugaggacagccaggucuucacagaaauacagagcccugauuacccucugcugaucccaacugaccuuuguacuuugcucuuaaaaugcauuugcacuggcugggcgugguggcucacgccuguaaucccagcacuuugggaggccaaggcgggcagaucaccugaguucaggaguucgagaccagccuggccaacauggugaaaccccaucucuacuaaaaauauaaaagaauuaacguggcaugguggcaugcgccgguaaucccagcuacuuaggaggcugaggcaggagaaucgcuugaaccugggagguggagauugcagugaaccaagaucaugccauugcacuccagccugggcaacagggcaagacuccaucucaaaaaaacaaaaaacaaacaaacaaaaacaacaacaacaacaaacucaacacuuacagccauaaagcuauagacacaacucccacucuccccaacauccuacagcucugucuucuuuguaugcuaucacaaccucauaacaagcuugcugguuuagggcagcuauuaauuaagaaguaggacgcuaccugguguggcuuuaugaacgggacucaaacuuucaaucugaaaacuugcuguaagccagcauggggugggggaggugauuauggcuggggaagaugggcacucacccgacagcagcaucuagcaccacagugacagggacguugagguggcagagggcuuuggccauuuucuuacugaagaugacauuuugagaacguuagagaaaguacaagacaguaccacagugauguaugucaccuaauguggacaguggauguuugcuugaaacucacauuaauacuaauggguuaaggggcagaucccaauacuuuggacuaaggaaacaagaauuugaguucuuuagaaagaaguauuuuuggaaaacuauacucuuagacucuggguaagagauguaaauucaggaaaaaaggaggaaguuuugcuuugauuaucgucuagagagagggagauauaaguuaccuauuccuugauaaaaaucuucaucaauacaaucucugcucuuccacggaguuaacuacuuaagugaaaccccuagaucauauacugcggccugcugcaaauucagugauuuuucuuccaaaggcaggaaaagguacaaugaaaggcagugcugacugcuggcaagcugggggcacauucugguucugauccuguuggacuguaauccgcaguuugcucuguaaaauuauggcugggcacauaacugaacagaaagguacuugcccugacaaaucaggcugugacucugugacguauacacuaaaucgcuucuuggccgccacggcugcuuccaggacucucaggaccacucuggaguaggcgugagucaauauugucuguggaccgagaaagcuuugucaaaggggcaggcuccuugcugcucacucacacccucugcacugcggcacguguucccgacacccuaagcaucucuguacacuuucucacaaaucaaccacaaccagaaaggagaccugaugguacaguuuccaucccaugugcaagcuaaaaaaguuucugccaggucucacauccuguagcaggugcagaaauggaacucccacacaguguuacccaaaggauacaaaagccuggauagcugaaggcuccaugagguucccuuggguugguuuuccuauuucuaagacaugguuugcacacgcaggccuacaggaaccaaguagguagcagaagucacugcagcagguuggguggggccagcagcaaagcgaaaggcuacagaaggcugggugugguggcucacgccuguaaucccagcauuuugggaggccaaggugagaggacugccugagcccaggaguucaaaaccagucugggcaacuuggcaagaccucaucucuacaaaaaauaacaacaaaaaaaauuagcuggaugcaguggcaugugccuauagucccagcuacuugggaggccgaggugggaggaucacuugagccugggagguugaggcugcagugagccauaaucaugccagugcacucuagucugggcaagagagugagacucugucucaaaaagaaaaggcuaaggagggccaggacuccucagccccagcuggcgucauguggccccaagauugccagaccaggugauguuucaaaaauccaauuuugaaaugauggcuaacuaauuuuuuugaauuuauaaacacuguuugggguaaucacaaccuaucuguggcguggaugcaauguguagacacuuagacauaaucuguuuucuuuucuuucuugagccaaggucuugcucugaugccuaggcuggagugcagugcaguguucauggcucacuguagccucgacauccugggcucaaacgauccucccaccucagccaccccaguagcugggacuacagaugugcgccacugugacuagcuaauuuauuuuauuuuuuguagagacagggccucucucccuauguugcucaggcuaguguugaauuccuggccucaagggaaccuccggcuaggauuauacacauaagccaccacaguaggcccauaaccucuuuuuuuuuuuuuuuuuuuuuuuuuggugagacaggaucucacuccaauugcccaggcugaagugcagugguaugaucucagcucacugcagccucaacuuccuggguucaggugauucucccaccugagccucccaaguagcugggaccacaggagugugccaccacgccuggcuaacuuuuuguauuuuuaguagagaugaaguuuugccauguugcccgggcuggucuugaacuccuggacucaagcaaucugcgugucuuggcuuuccaaagugcugggauuacaggcaugagccaccaugcccagccuccauaaccucuuuucuauggaagagugcagaagacagaauaagacaagggggcagaaccagcucucuagcuccuuucugggucucaccugagaacccguuaggaaggcagguucguggacccuagcccaaacccacugaaucccgaucugcauuuaauaagaccccagcugacuccucugcaugugcaaaucugagcagcucugcuauaaauuuugucuaaaucaguccugaguaggugacugcagguaaaguacauacauaccacacuacacuagagcaaacgaaacccgcacaauacugacggcacagcaggucuguggaaggagaaggccccagcgagaggaagucacaaccuugccuccacuugcccaaaaaaggcuucguuugcaacuggcuuuucuacaaguuucacucacaucuauuaugccauuuauuuaauaacauacuucaaagguugggaaggggcuaauaaaauggaggacaagauuuaagagucaaaaugcaaguaaaugauuuuaugaucaggggaggccuagguggcaaaaggacguaugcuggugggaggggcauuaugauaguuucauuacaccuuuacuggaagaugguucaacuugcaccuccugucuuuccucacuuauaaacacugcguggcuuuacaucucuguaauagcaucuaaaaugaaguuaaaaagaaaauuucccucaauuucccucuauugcuaaccuucacuaagaaaguccucaguguuaaccagugacaagagcuguucuguuaauucagauuuacuacacauacaaucauaaaaauacuucuuuaguaaaacacuguauuaaaucaagaaucagggccaggugcgguggcucacgccuguaaucccagcacuuugggaggccgaagcggguggaucacaaggucaggagaucgagaccauccuggcuaacacagugaaaccccgucucuacuaaaaauaaaaaaaauuagcugggcuugcuggugggcaccuguagucccagcuacucgggaggcugaggcaggagaauggugugaacccaggaggcggagcuugcagugagcugagaucgcgccacugcacuccagccugggugacagagcaagacuccgucucaaaauaaauaaauaaauaaauaaaauaaaucaagaaucacacgugcugucccacugucccucucugccuguuuacaaugacaaccaucucuaauaacaagaccuacauucaugcagcacuuacuaagugccaggcacaauaccaagcccucacaccccuugccccuuacaugucuugccucauuuaauccucacaacaacccaaggagguagguacuauugucauccuuauuuaacagaugagaaagcugcacagacagguuaaguuacuuguucaagucuccacagcaagugaguggcagagcccggauuuuaccccaggcagucggacucgaaaccguugcuccuccuuaccaccaugaugauuauccacucaccgcuccaucuuugaugaaaguauggcacagaucugcaauuuuguuucuugacagugauauucuccugagaaaaaguucuccccgcucaaucaugaucuuuuuacauuuggaguaauccuaggaagaaaagagcaaacugaggggacagggaagauccaguuaaugcugagaaugucugucacuaaacagagaaguggaaagguaaccccagggagaacaggcacuuacggaguauuccagggaggcaagacugaugaagcggaggaagagcuccccgccagaggacacugccacagaggaguccacaccacacaggguuucuauggcacuggugagauucgcccucagacccuggauugucuccccuggaaugauccaacaaggaaugugauguucacauuagggccacagccccgaccuguaucuucaauucauucauucauucagugaauauuuacuagguacauacuauauaccaggcacuauucuagaugcuagggauacaucagugaacaagacagguaggguucugcugugauggaguuuugauuguaauagaggaagcggauaguaaacaagcacacauagaaauaaagcuggguggcugggcaugguggcucacgccuguaaucucagcacuuugggaggcugaggcauggaaagacauuaaguagcagcggcagaugaggucugcaaggugguaugggugaggcuaagguuguuuggauguuauuuuaagaacaaugggaagacacuggagguugccuuaaagacaugugucucuaggcaagcccuucagauuaaaggcugcauuauuauuuugcuuauacaagauuucaugcuauacccagaugcuuacauuuagggugcugaauuaggggaucacaauaaauaauacuaauaccagaauuuauucuggaauauucccuguagcaucuguacagaaucuggcacaagguggaggccuaauaaacacuuauaaagcugaacugcuacugaaauuuacgcaucaugguuaacacaauauaacauagucacucucgauucaaagucuguuucacuuaugaaagggauccuuuucaugacaacguaagagcucucuccagauugaaaggucugaaaugaaggcagaagcugagcuuggagcuguauuacuacuuuaugcaggcaaacaugcaucucucacuuucuacauuucuaagagucauuagaagacuuuccuggccgaacaugguggcucacgccuguaaucucagcacuuugggagggcgaggcggacggaucaccugaggcuaggaguuuaagaccacuguggccaacauggugaaacccugucucuacuaaaaauaaaaaaauuuggccgggcccgguggcucacgccugcaaucccagcacuuugggaggccgacaugggcggaucacgaggucaggagaucgagaccauucuggcuaacaaagugaaaccccgucucuacuaaaaauacaaaaaauuagcuaggcaugguggcgggcgccuguagucccagcuaccuggaggcugaggcaggagaauggcaugaaccugggaagcggagccugcagugagccaagauggcaccacugcacuccagcccgggugacagagcgagacuccgucucaaaaaaaaaaaaaaaaauuuugccaggcgugguggugcaugccuguaaucccagcuacucagaaggcugaggcaggagaaucgcuugaacuugagaggcagagguugcagugagccgagauugugccauugcacuccagccugggagacaagagcaaaacucugucucaaaaaaaacaaacggccgggcacaguggcucacaccuguaauccuagcacuuugggaggccaaagcgggcagauugccuaagcucaggaguucgagaccagccuggguaacauggugaaacccugucucuaaaauacaaaaaaauuagccggacaagguggugcacaccuauaaucccagcuacucaggaggccaaggcaggagaauugcuugaacccaggaggcggagguugcagugagccaagaucucgccacugcacuccagccugggugacagagugaggcuccgucucuuuaaaaaaaaaaaaaaagaaaagaaaaaaaagacuauccuaagucccagaguguuaacagaugacucucuauauaccuuuaucucucuucaagaacuccagcaacguccggauggcagccacugcugaggccaugucaggaucuucuuucaucugagacuuaaaguauucaauuaacucuggaaaaagggaaaaaagugauucaccuaauucauuuagcagccuauaaggcaagagagcuuguuaaugacuguugacuuuaagaagcaaacaauuuaaaaaauacuuucuuuuuaggguauuugguuucagggaugcaauaaauguugaugggaauagagaaaauaccacuuugcuguuugcaagagcucuuuuuuauuuugaaaaagcuacugguggccgggcgcgguggcucacgccuguaaucccagcacuuugggaguccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagacugcgccacugcacuccagccugggugacagagcgagacuccgucucaaaaaaaaaaaaaaaaaagcuacuggugugcaaggccuaaaaauuaagcccgaguaaaugaugaugaaaagucauucucucuucagccucuuugguccuaaaaucugagaggaucccagagucaaccaucuugccaauuucuccugcaccccuccagacagucuaugcuaauacaugucuauucacauacacauauau

SEQ ID NO: 14467 - RNA, 5891 nt, Homo sapiens
aaaaaaacaccaauugggaaugcaacaacuuuauugaaaggaaagugcaaugaaauuuguugaaaccuuaaaaggggaaacuuagacacccccccucaagcgcaggaccaagugcagaguggacucuuucuggauguuguagucagacagggugcguccaucuuccagcuguuucccagcaaagaucaaccucugcugaucaggagggaugccuuccuuaucuuggaucuuugccuugacauucucgauggugucacugggcuccaccucgagggugauggucuuaccagucagggucuucacgaagauuugcaucccaccucugagacggagcaccaggugcaggguggacucuuucuggauguuguagucagacagggugcguccaucuuccagcuguuucccagcaaagaucaaccucugcuggucaggagggaugccuuccuugucuuggaucuuugccuugacauucucaauggugucacucggcuccacuucgagagugauggucuuaccagucagggucuucacgaagaucugcaucccaccucuaagacggagcaccaggugcaggguggacucuuucuggauguuguagucagacagggugcguccaucuuccagcuguuucccagcaaagaucaaccucugcuggucaggagggaugccuuccuugucuuggaucuuugccuugacauucucaauggugucacucggcuccacuucgagagugauggucuuaccagucagggucuucacgaagaucugcaucccaccucuaagacggagcaccaggugcaggguggacucuuucuggauguuguagucagacagggugcguccaucuuccagcuguuucccagcaaagaucaaccucugcuggucaggagggaugccuuccuugucuuggaucuuugccuugacauucucaauggugucacucggcuccaccucgagagugauggucuuaccagucagggucuucacgaagaucugcaucccaccucugagacggagcaccaggugcaagguggacucuuucuggauguuguagucagacaggguacgaccaucuuccagcuguuuuccggcaaagaucaaccucugcuggucaggagggaugccuuccuugucuuggaucuuugccuugacauucucaauggugucacucggcuccacuucgagagugauggucuuaccagucagggucuucacgaagaucugcaucccaccucugagacggagcaccaggugcaggguagacucuuucuggauguuguagucagacagggugcgcccaucuuccagcugcuuuccggcaaagaucaaccucugcuggucaggaggaaugccuuccuugucuuggaucuuugcuuugacguucucgauagugucacugggcucgaccucaagggugauggucuugccagugagugucuucacgaagauuugcaucccaccucugagacggaguaccaggugcaagguggacucuuucuggauguuguagucagacaggguacgaccaucuuccagcuguuuuccggcaaagaucaaccucugcugaucagaaggaaugccuuccuuaucuuggaucuuugccuugacauucucgauggugucacugggcuccaccucgagggugauggucuuaccagucagggucuucacgaagaucugcaucccaccucugagacggagcaccaggugcaggguagacucuuucuggauguuguagucagacagggugcgcccaucuuccagcugcuuuccggcaaagaucaaccucugcuggucaggaggaaugccuuccuuguccuggaucuuugcuuugacguucucgauggugucacugggcucgaccucaagggugauggucuugccagugagugucuucacgaagauuugcaucccaccucugagacggagcaccaggugcaggguggacucuuucuggauguuguagucagacagggugcgcccaucuuccagcuguuuuccagcaaagaucagccucugcuggucaggagggaugccuuccuuaucuuggaucuuugccuugacauucucgauggugucacugggcucaaccucgagggugauggucuuaccagucagagucuucacgaagaucugcauugucuaacaaaaaagccaaaaacggccagaauuuagcggacaauuuacuagucuaacacugaaaauuacauauugacccaaaugauuacauuucaaaaggugccuaaaaaacuucacaaaacacacucgccaaccccgagcgcauaguucaaaaccggagcuucagcuacuuaagaagauagguacauaaaaccgaccagagaaacugacgccucacuuaucccuccccucaccagagguccggcgccugucgauucaggagagccuacccuaggcccgaacccugcguccugcgacggagaaaagccuaccgcacaccuaccggcagguggccccacccugcauuauaagccaacagaacgggugacgucacgacacgacgagggcgcgcgcucccaaagguacgggugcacugcccaacggcaccgccauaacugccgcccccgcaacagacgacaaaccgaguucuccagucagugacaaacuucacgucaggguccccagauggugccccagcccaucucacccgaauaagagcuuucccgcauuagcgaaggccucaagaccuuggguucuugccgcccaccaugccccccaccuuguuucaacgaccucacagcccgccucacaagcgucuuccauucaagacucgggaacagccgccauuuugcugcgcuccccccaacccccaguucagggcaaccuugcucgcggacccagacuacagcccuuggcggucucuccacacgccuccgucccaccgagcggcccggcggccacgaaagccccggccagcccagcagcccgcuacucaccaagugacgaucacagcgauccacaaacaagaacugcgacccaaaucccggcugcgacggaacuagcugugccacacccggcgcguccuuauauaaucaucggcguucaccgccccacggagaucccuccgcagaaucgccgagaagggacuacuuuuccucgccuguuccgcucucuggaaagaaaaccagugcccuagagucacccaagucccguccuaaaauguccuucugcugauacugggguucuaaggccgagucuuaugagcagcgggccgcuguccugagcguccgggcggaaggaucaggacgcucgcugcgcccuucgucugacguggcagcgcucgccgugaggaggggggcgcccgcgggaggcgccaaaacccggcgcggaggccgcugcaccgggagcgggugggcggcccgcguuccuuagccgcggcuccgcggccccuccccucagcccccgcgguccccucgggucgcgaaccccgcguucggcggacguggggcacgcagcgagcgccuucugcagagucggggucucccuccccucccuccugacccgcccuggcccacccugcgagauggacgggucuuuauuuuugggucacauuugagguaaugacggggcuuccuuugcucagcccccuucaaccucccugagccucccaggccggucgcggggggcucccggggccgcgggacaaggacaaugacucggcagaucucagggcgggcguggcccuaaagcuggggaacgcucgagaacuuuccaggggagacacugcagaggagcuggguguccagguuaaauuuggaaaaaagaggcggaaaccccacacaguuuuauuuuagcuggaacgcaaggcugagcgaacgacauccuucuagacuguucuuccaccuuccuguacauucugagggccagguauggaaagguccuacuugaugccaacagggaggcauggaaauuucucugguuucaauggguacgauuauuguaagcaggauccauucaauaaucggacccauuuaaaccggagauuuuaaaagacaggaauagaaucccaaccuuauuucagugcaggguagggugucaaauaugaaauguaauucuacagggcaauucuauuuugguaaaagaaguggggagaaaagcaucaccagccagcuuuuuaaauuuuuaccacaaccuauuuugugaucccuacgugucauuucuucaguauauuuuuuaaauguuuuaaaauauacgaacauggugagauuuuuuaaaugugucuuuuuaaaguguacagugaaaagucucccucaugcccucaauuucccagccacuguuccuucuggacucuucuacaaauagucccuguuucuacaaauguauuggagguagggaggcuauuuugauuucuacccuuaaaagcuucaaaaaaaagagaaaaagaggcuaccaacugaaaaauauuuugccauuaggaaaaggcugcauucuuguuuuaaguuaugaacauuacauuauuuaaacggcagacuuaaaauaugcaucaaagcaaaaugaaccugcuauauauuuucuaugguaacccauguuucuguguauuuaugaaaauccaagaucugugcauuguucaaaacagacuuugacaucuccaauuuuuaacauuuuaaagagaaugaauucauguguuacugggaaauuaaaacgaauaauaaaagugucauuuuccaggauuggcaggauaccccagugauuuccaauacacauuucugcaaaguuuuuguuuuuuguuuuuccccuacauuucgggaaggaguuuugaagggauuaaaaagcugagauucuuucugaggugaccaggccuggcuuucaaccacgcccugguugcuuuuggcuguuacucugcugcaagccuugugauucauguuguuuaaaggcugagucaccagcuuugugacauagcuuuuuucagaguccaaaagguacagagaaaaaacagcccuaacugcagaggcaggggcgggagaggaggacaggaggaggaaaaaggaagaagaggggaugaggguaggguggguaaugggccaaagguuagcugcaaagagaaaccaauguugucucuagcagaaaaaaauuauugaaaacaucccagcauucccugacuuaaaugguuauugaagcaaacagaaauaaaccuuucuccaaagucacugaggugacagggaagaaaauggccucccaaaacgcaggugucugauguuucucuacaacaaugguucucaacaaggagugauuugcucuuucaggggacauuuggcaauaucuggagauauucuugguugucacaacucaggggagguuaggggaugcuacuacuaauacuagcacuguugguagacaccagggaugccacugaacauucuaugagggacagucccccacaacaaagaauuaucagacccaacauauuaauagugcugaaauuaagaaacccuguccuacaaaggauuuuuguuguugcaacaacugcuuuucuguuuuccgaaaggguucccaaagucuaaaugucccacuuggacucaggagucagguaucaagucacgcucuuaaaaccuaaacccugcugaccuagaaugcgaugugcuagaaugugcaagaaucgggaugagucacuggauccguuuucaguucguuccacccacagauccguccuuugcaggcgccccagaaaagauugcuucagagcuggcaccaauggagaagggacagaggcccagcaacagggcgggauuggcaggcggaagggagcgugugaugagcugagcucacaaagggccggggugcugggcugcagcuggggagggcgggguuggaucagcgccugcuccuccgccuucguuuuuccccucccccuaaggauucaguucccccuucug

SEQ ID NO: 14468 - RNA, 5891 nt, Homo sapiens
cagaagggggaacugaauccuuagggggaggggaaaaacgaaggcggaggagcaggcgcugauccaaccccgcccuccccagcugcagcccagcaccccggcccuuugugagcucagcucaucacacgcucccuuccgccugccaaucccgcccuguugcugggccucugucccuucuccauuggugccagcucugaagcaaucuuuucuggggcgccugcaaaggacggaucuguggguggaacgaacugaaaacggauccagugacucaucccgauucuugcacauucuagcacaucgcauucuaggucagcaggguuuagguuuuaagagcgugacuugauaccugacuccugaguccaagugggacauuuagacuuugggaacccuuucggaaaacagaaaagcaguuguugcaacaacaaaaauccuuuguaggacaggguuucuuaauuucagcacuauuaauauguugggucugauaauucuuuguugugggggacugucccucauagaauguucaguggcaucccuggugucuaccaacagugcuaguauuaguaguagcauccccuaaccuccccugaguugugacaaccaagaauaucuccagauauugccaaauguccccugaaagagcaaaucacuccuuguugagaaccauuguuguagagaaacaucagacaccugcguuuugggaggccauuuucuucccugucaccucagugacuuuggagaaagguuuauuucuguuugcuucaauaaccauuuaagucagggaaugcugggauguuuucaauaauuuuuuucugcuagagacaacauugguuucucuuugcagcuaaccuuuggcccauuacccacccuacccucauccccucuucuuccuuuuuccuccuccuguccuccucucccgccccugccucugcaguuagggcuguuuuuucucuguaccuuuuggacucugaaaaaagcuaugucacaaagcuggugacucagccuuuaaacaacaugaaucacaaggcuugcagcagaguaacagccaaaagcaaccagggcgugguugaaagccaggccuggucaccucagaaagaaucucagcuuuuuaaucccuucaaaacuccuucccgaaauguaggggaaaaacaaaaaacaaaaacuuugcagaaauguguauuggaaaucacugggguauccugccaauccuggaaaaugacacuuuuauuauucguuuuaauuucccaguaacacaugaauucauucucuuuaaaauguuaaaaauuggagaugucaaagucuguuuugaacaaugcacagaucuuggauuuucauaaauacacagaaacauggguuaccauagaaaauauauagcagguucauuuugcuuugaugcauauuuuaagucugccguuuaaauaauguaauguucauaacuuaaaacaagaaugcagccuuuuccuaauggcaaaauauuuuucaguugguagccucuuuuucucuuuuuuuugaagcuuuuaaggguagaaaucaaaauagccucccuaccuccaauacauuuguagaaacagggacuauuuguagaagaguccagaaggaacaguggcugggaaauugagggcaugagggagacuuuucacuguacacuuuaaaaagacacauuuaaaaaaucucaccauguucguauauuuuaaaacauuuaaaaaauauacugaagaaaugacacguagggaucacaaaauagguugugguaaaaauuuaaaaagcuggcuggugaugcuuuucuccccacuucuuuuaccaaaauagaauugcccuguagaauuacauuucauauuugacacccuacccugcacugaaauaagguugggauucuauuccugucuuuuaaaaucuccgguuuaaauggguccgauuauugaauggauccugcuuacaauaaucguacccauugaaaccagagaaauuuccaugccucccuguuggcaucaaguaggaccuuuccauaccuggcccucagaauguacaggaagguggaagaacagucuagaaggaugucguucgcucagccuugcguuccagcuaaaauaaaacugugugggguuuccgccucuuuuuuccaaauuuaaccuggacacccagcuccucugcagugucuccccuggaaaguucucgagcguuccccagcuuuagggccacgcccgcccugagaucugccgagucauuguccuugucccgcggccccgggagccccccgcgaccggccugggaggcucagggagguugaagggggcugagcaaaggaagccccgucauuaccucaaaugugacccaaaaauaaagacccguccaucucgcagggugggccagggcgggucaggagggaggggagggagaccccgacucugcagaaggcgcucgcugcgugccccacguccgccgaacgcgggguucgcgacccgaggggaccgcgggggcugaggggaggggccgcggagccgcggcuaaggaacgcgggccgcccacccgcucccggugcagcggccuccgcgccggguuuuggcgccucccgcgggcgccccccuccucacggcgagcgcugccacgucagacgaagggcgcagcgagcguccugauccuuccgcccggacgcucaggacagcggcccgcugcucauaagacucggccuuagaaccccaguaucagcagaaggacauuuuaggacgggacuugggugacucuagggcacugguuuucuuuccagagagcggaacaggcgaggaaaaguagucccuucucggcgauucugcggagggaucuccguggggcggugaacgccgaugauuauauaaggacgcgccggguguggcacagcuaguuccgucgcagccgggauuugggucgcaguucuuguuuguggaucgcugugaucgucacuuggugaguagcgggcugcugggcuggccggggcuuucguggccgccgggccgcucggugggacggaggcguguggagagaccgccaagggcuguagucuggguccgcgagcaagguugcccugaacuggggguuggggggagcgcagcaaaauggcggcuguucccgagucuugaauggaagacgcuugugaggcgggcugugaggucguugaaacaagguggggggcauggugggcggcaagaacccaaggucuugaggccuucgcuaaugcgggaaagcucuuauucgggugagaugggcuggggcaccaucuggggacccugacgugaaguuugucacugacuggagaacucgguuugucgucuguugcgggggcggcaguuauggcggugccguugggcagugcacccguaccuuugggagcgcgcgcccucgucgugucgugacgucacccguucuguuggcuuauaaugcaggguggggccaccugccgguaggugugcgguaggcuuuucuccgucgcaggacgcaggguucgggccuaggguaggcucuccugaaucgacaggcgccggaccucuggugaggggagggauaagugaggcgucaguuucucuggucgguuuuauguaccuaucuucuuaaguagcugaagcuccgguuuugaacuaugcgcucgggguuggcgaguguguuuugugaaguuuuuuaggcaccuuuugaaauguaaucauuugggucaauauguaauuuucaguguuagacuaguaaauuguccgcuaaauucuggccguuuuuggcuuuuuuguuagacaaugcagaucuucgugaagacucugacugguaagaccaucacccucgagguugagcccagugacaccaucgagaaugucaaggcaaagauccaagauaaggaaggcaucccuccugaccagcagaggcugaucuuugcuggaaaacagcuggaagaugggcgcacccugucugacuacaacauccagaaagaguccacccugcaccuggugcuccgucucagaggugggaugcaaaucuucgugaagacacucacuggcaagaccaucacccuugaggucgagcccagugacaccaucgagaacgucaaagcaaagauccaggacaaggaaggcauuccuccugaccagcagagguugaucuuugccggaaagcagcuggaagaugggcgcacccugucugacuacaacauccagaaagagucuacccugcaccuggugcuccgucucagaggugggaugcagaucuucgugaagacccugacugguaagaccaucacccucgagguggagcccagugacaccaucgagaaugucaaggcaaagauccaagauaaggaaggcauuccuucugaucagcagagguugaucuuugccggaaaacagcuggaagauggucguacccugucugacuacaacauccagaaagaguccaccuugcaccugguacuccgucucagaggugggaugcaaaucuucgugaagacacucacuggcaagaccaucacccuugaggucgagcccagugacacuaucgagaacgucaaagcaaagauccaagacaaggaaggcauuccuccugaccagcagagguugaucuuugccggaaagcagcuggaagaugggcgcacccugucugacuacaacauccagaaagagucuacccugcaccuggugcuccgucucagaggugggaugcagaucuucgugaagacccugacugguaagaccaucacucucgaaguggagccgagugacaccauugagaaugucaaggcaaagauccaagacaaggaaggcaucccuccugaccagcagagguugaucuuugccggaaaacagcuggaagauggucguacccugucugacuacaacauccagaaagaguccaccuugcaccuggugcuccgucucagaggugggaugcagaucuucgugaagacccugacugguaagaccaucacucucgagguggagccgagugacaccauugagaaugucaaggcaaagauccaagacaaggaaggcaucccuccugaccagcagagguugaucuuugcugggaaacagcuggaagauggacgcacccugucugacuacaacauccagaaagaguccacccugcaccuggugcuccgucuuagaggugggaugcagaucuucgugaagacccugacugguaagaccaucacucucgaaguggagccgagugacaccauugagaaugucaaggcaaagauccaagacaaggaaggcaucccuccugaccagcagagguugaucuuugcugggaaacagcuggaagauggacgcacccugucugacuacaacauccagaaagaguccacccugcaccuggugcuccgucuuagaggugggaugcagaucuucgugaagacccugacugguaagaccaucacucucgaaguggagccgagugacaccauugagaaugucaaggcaaagauccaagacaaggaaggcaucccuccugaccagcagagguugaucuuugcugggaaacagcuggaagauggacgcacccugucugacuacaacauccagaaagaguccacccugcaccuggugcuccgucucagaggugggaugcaaaucuucgugaagacccugacugguaagaccaucacccucgagguggagcccagugacaccaucgagaaugucaaggcaaagauccaagauaaggaaggcaucccuccugaucagcagagguugaucuuugcugggaaacagcuggaagauggacgcacccugucugacuacaacauccagaaagaguccacucugcacuugguccugcgcuugagggggggugucuaaguuuccccuuuuaagguuucaacaaauuucauugcacuuuccuuucaauaaaguuguugcauucccaauugguguuuuuuu

SEQ ID NO: 14469 - RNA, 809 nt, Homo sapiens
uugggaaugcaacaacuuuauugaaaggaaagugcaaugaaauuuguugaaaccuuaaaaggggaaacuuagacacccccccucaagcgcaggaccaagugcagaguggacucuuucuggauguuguagucagacagggugcguccaucuuccagcuguuucccagcaaagaucaaccucugcugaucaggagggaugccuuccuuaucuuggaucuuugccuugacauucucgauggugucacugggcuccaccucgagggugauggucuuaccagucagggucuucacgaagauuugcaucccaccucugagacggagcaccaggugcaggguggacucuuucuggauguuguagucagacagggugcguccaucuuccagcuguuucccagcaaagaucaaccucugcuggucaggagggaugccuuccuugucuuggaucuuugccuugacauucucaauggugucacucggcuccacuucgagagugauggucuuaccagucagggucuucacgaagaucugcaucccaccucuaagacggagcaccaggugcaggguggacucuuucuggauguuguagucagacagggugcguccaucuuccagcuguuucccagcaaagaucaaccucugcuggucaggagggaugccuuccuugucuuggaucuuugccuugacauucucaauggugucacucggcuccacuucgagagugauggucuuaccagucagggucuucacgaagaucugcaucccaccucuaagacggagcaccaggugcaggguggacucuuucuggauguu

SEQ ID NO: 14470 - RNA, 809 nt, Homo sapiens
aacauccagaaagaguccacccugcaccuggugcuccgucuuagaggugggaugcagaucuucgugaagacccugacugguaagaccaucacucucgaaguggagccgagugacaccauugagaaugucaaggcaaagauccaagacaaggaaggcaucccuccugaccagcagagguugaucuuugcugggaaacagcuggaagauggacgcacccugucugacuacaacauccagaaagaguccacccugcaccuggugcuccgucuuagaggugggaugcagaucuucgugaagacccugacugguaagaccaucacucucgaaguggagccgagugacaccauugagaaugucaaggcaaagauccaagacaaggaaggcaucccuccugaccagcagagguugaucuuugcugggaaacagcuggaagauggacgcacccugucugacuacaacauccagaaagaguccacccugcaccuggugcuccgucucagaggugggaugcaaaucuucgugaagacccugacugguaagaccaucacccucgagguggagcccagugacaccaucgagaaugucaaggcaaagauccaagauaaggaaggcaucccuccugaucagcagagguugaucuuugcugggaaacagcuggaagauggacgcacccugucugacuacaacauccagaaagaguccacucugcacuugguccugcgcuugagggggggugucuaaguuuccccuuuuaagguuucaacaaauuucauugcacuuuccuuucaauaaaguuguugcauucccaa

SEQ ID NO: 14471 - RNA, 1903 nt, Homo sapiens
guuuacuuuagguucuugcucagaacucugguuuugaccuucaggaaacauuaguuaaaauucaagcagaacauucagaaucaggucagcuuguggguguggaccugaacacagguaagagaaugcaacuguuguagagggaaaacuagauguaauacgugugaguugaagccaggaaagauuaaaaauguuuugcuuugcaauuugacaccagugcuguuagggaacucuggguucuaaaaugggauaaaauaggauauuaauaaaaaauggaaugacuagguauaauuaagggacgaguagacaugaguaauuuggggauacaauuuuggagauguugaguggugguagaugguucagauuaauguugaaggauuuucauauugcauuugccuuacucaguuuuuaaucaaguacuaugauaagaaaauagauguggugauuauauucaugggugaaaaccagcuaaagauagcaauuaaugccagaaaaggggauguagaaaucuagugaaauggugacagcccugaucuuagguuccuguaacaaaacaacacaaauuaaguacaaaguaggagauaacagguaccuccaugcaguaugugcaagaccuauugucaacauuaauagaaaagguuucuggaaugagggaaaugaucaguccauuuuagucagauuauaguugaagugcuauacuucaguaugaguaaacagaaauguauccagaagaagagagggguguucaggacuucuaaguauaagucagacauucaucaaauauuguggacgggggucaugguuuagaguagaaaauugggcuaacagagaagcuuugaauucucauaguuaauacuggaggaaaugagucaucagugauaagcaaagcugcacacaauauuguugguucuuacugacugaacuuauuuuaagauuugguugccuuuuaggugagccaaugguggcagcagaaguaggcguaugggauaacuauuguguaaagaaacagcuucuucacuccugguaaguuugggaaaaugaaaacuaaacuguuagagaaucauacuuuuuucauuugguguucucuguuuaguugcuccuuucccccaugaauaaugugaucagcuggaaguauggaaacugaacuagcccucugauguguagaggggaagggggaaauuuaauuggauguaaugugugcagcuugguuggaagugggaaguugagucgaauuagggcuccuaaucaucugagccaucuuauuuuugucccccuuucagcacugugauugccaccaacauucucuugguugaugagaucaugcgagcuggaaugucuucucugaaagguugaauugaagcuuccucuguaucugaaucuugaagacugcaaagugauccugaggauuacagcuguggaauuuuuguccaagcuucaaauaauuuugaaagaaauuuucccauaugaaaaaaggagagaacacuggcaucuguugaaauuuggaaguucugaaauuauaguauuuuuaaaaauugcacugaaguguauacacauaaagcaggucuuuuauccagugaacaggauguuuugcuuuagcagcagugacauaaaauuccauguuagauaagcauauguuacuuaccuuguuauuaaauauuucuugaaaagcaaauuuuaaugguuuaauuuuauguggacguauguuaaauuauccaacuacccuauuguuaagcauuugguuuuaaaauuuuuaugcuaauauaaaugcucaaguaauuuaaaauauugaaagcaucccuguugguauaaauuucugaguaaaugcauuggaucaguuggacuuugaacgccuuugaaauggcuuugcuaaaaugcucccgccacaaaguuguaggaaaugggaaga

SEQ ID NO: 14472 - RNA, 13651 nt, Homo sapiens
caguagcgggaggcggucgggucaggccccagcugggcgcgagcgggucggcguugagggagccaccgcccucccgccugcgcacugccucucgccccccuccggccagcccgcagccggccgcgucaugccaggcgcugcucggcgguagggagugcccggggccgccgccuccgcccgcccgaagccgcgcccacugcccagagccagagggauggugguagucacggggcgggagccagacagccgucgucaggacggugccauguccagcucugacgccgaagacgacuuucuggagccggccacgccgacggccacgcaggcggggcacgcgcugccccugcugccacaggagguacccgggcgggcggcgggccgcggggcguggggaggggcgcgggggagaagcgggcgcggggcauagcgguccucggcgggugggcggggccgggguugggggcggggcccgcggacuugcgccccucccccgcccaccugcaacucccccgcccaccugcaccccuacccacccaccuucaaccccugucaauuacacccacuaggugugcuuccccacccccuacacccuccgcccaguagucacuggggugauuuacucccaucgccaugucccacuuuuaccgaagacaggagggagggugggccgugggagggggacccuggagccccgagagcugauggugugucugaccaggcaccguagcucgagccuguaaucccaacacauugggagggaggaucgcuugagggcaggaguuggaggccagccugggcaacauagcgaggccccgucccuacuacgacuggaaaaacaaaggcauuuuggguuggaugaauaaaaaaaagaaaagaaaaagaugucuucuagagaauccaacaggaugcuguagugguugcccacaccuagucuccagcuaccuaaggaacaaggcaaggagcugucugcacauaaggggcaggccaguucauagauguaggcacggucaccuggcaucccauggcuuucacucacaggcugcugugcucuggugcacaggggcuuccacgggucuuacuuaaugugugugauacuaucaugucaacaccugaaaugacacucaagagacgggagaagauaccaggcaugguggcucacaucuguaaucucagcaguuugggaugcugaggugggaggauugcuugaucccagcaguuagagacuagucagggcaacagugagacccugccucuacaaaaaugaaaauuagccaggcuugguggugugugccuguagucccaggugcucaggaaggugaguugggaggauugcuugagcccuggagguugaggcugcagugagcuguaauugugccacuguacuccagccugggugugauagaguaagaccguaccuacaaacaaacaaaaacaaaaaaagcaagagaagggaaacgaugccaggugugguggcuuacacuuguaaucccagcacuuugggaggucaaggcaggaggaugguuugaggccaggagucugggaccagcuugggcaacacagacuccaucucuacaaauaaaaaauaaagaggagggaaggugaagcauuacuggacaccgaagauggcuucuaggaggcagggacuaagguagugccagauccaggagcaugugguaugcggagucccaggacaauggaggcccucaacaauugaggcccucaacaggcugggcuaggugaugcucuugggaagcagauaguguugugcugggauugcaagccccauacacacaaugccaugggaaaaugagcaaaaaucuagaaguaaucucugcaauuggaaaaaagucauuagucacaguggugcuauuuuuuugugcacugucauugggaaaaugauaugguuugagggaaagagcacaagaccacagauugcagaccagggccccaccaccaguuccccccacugaugacauugccccaugugagcuccaaaacuguuuccgauggcuuuuguccucucugcuucaauccucucaucucuaauauggagcaagcacuuggauugguaugaaguaucuuuagaaaagguuuaaagagcuccagaaauguuaaguauuauuauuccaaaaugauaucugagcccuugauauacacauaaaaugguuuuagaggaccuacagaauaagcgcaaggcauuuucauguccugugggugcagaagaguaacagugcauacacacacggaaguguaacuaccugucuauuucuuucauucauucggugaauuuugggucuuuauuugagccaggcgcugcacaaggcccugggucagcuuuauuuaauguauuuguacccuauuuuauuucacaaaggauuugaaagcugggaaagguacuguguagauaagcagacuuucacuggagcaggagagauguaauauugaaaaggaugcauggcuauaaucccagcacuuugggaggccaaggcaggaagaucacuugagguuaggacuuugagaccagcuuggccaacauggugaaaccccaucucuacuaaaaauacaaaaauuaguuggguguggccaugcccaccuguagucccagcuacuuuggaggcuggggcagcagaaucucuugaacccgggaggcagagguugcagugaaccgagaucgugccauugcacuccagccuggguguugcaaugagauuccgucucaaaaaaaaaaaaaaaagaugcauagggauacaauuugaauugaucuggaggaaguuugugggaagauuaaagagaacuuaaacugaccucauuuuuucaaaugcaguuugguagaaaccacaagcagugcaaaacaggaaaaaaaaaaaagccuugcauuuuaagggaaaccucgagcuucuuagggcacauuuauaccaucauuuucauguuccucacucagcccuuaccuccagaaccuuagcuggaccggaaaccaggcucacucuacagauuaggagaggaguagaugccuggaaguauucaacacacaacuacugagcucugcugugggcagcccaugauuggugaccaagaugcuuucccugucuuugggaagcuuggggucuaguggagugaauugacagagggaaauaauuggcgauguaucgugcuaggugcuauuauagaggagaauaugacacacggugaaggcacagucgaagaaugugucauuaacucuguccuaggggcaggugagggacaguagacagaaaugcucacagaugaggggaacuugaauagaaauuucuagaaugaguagaugccacuaaacuguaugguguguuggugugaauuagaaaaagggcacauagcaggccgggcgugguggcucacgccgguaaucccagcacuuggggaggccaaggcgggcggaucaugaggucaggagaucgagacaauccuggcuaacacggugaaacccuaucucuacuaaaaauacaaaaaauuagccagucgugguggcaggcaccuguagucccagcuacucgggaggcugaggcaggagaauggugugaacccgagaggcggagguugcagugagccgagaucgcgccacugaacuccagccugggugacacaggcugggacuccgucucaaaaaaaaaaaaaaaaagaaaaagggcacauagcagaugacucucauccaggugcuuuuaugcagugaacaaccuauaacacuguauggguccauuuaacuugccauauagacagaagaaggagacugguaagagcauuuugggcaaagaagacaaugugagcaagagcacuaagauaguaaauucaggaagugaaaggacacugaaggcuugagcucuagagcagcgauaauggaguugagguggagagaccugauuuaaaagcuaucagggggccaggcacaguggcucaugccuguaaucccagcacuuugggaggccgaggcagguggaucaugaggucaggagaucgagaccauccuggcuaacgcagugaaaccccaucucuacuaaaaaaauauauauauauauacaaaaaauuagccgggugugguggagggcgccuguagucccagcuacuccgggaggcugaggcaggagaauggcgugaacccgggaggcggagcuugcagugagccaacaucacgccacugcacuccagccugggagaugagugaaacuccaucucaaaaaaaaaagagcuaugaggguuagaauggguaggacuuggcagaugaugaggguggggcagagggaggagagagaagaaaguguucagauggacccgugggcuugagugacugaaugaaugguguggcaccaaucagaccccagggauugaagauggagcagccccagcucucauuccccguugccugccugagagcccuggugauuucuuuccaguuuccugagguuguuccccuuaacaucggaggggcucacuucacuacacgccuguccacacugcggugcuacgaagacaccauguuggcagccauguucagugggcggcacuacauccccacggacuccgagggccgguacuucaucgaccgagauggcacacacuuuggguaugucucucccucuacaaucaacuuuguaguccuagcaggugauuagcguaggcuugaguaugggaccuugauaucuuccauaguaccuagaagaggagauagcauauugaugaaauuuaauaaauggguuuauugaaagagaucaauuuuuuuuuuuuuuuuugccaaaggagacaaagacagccagagaaauucgaaauaacacacuggcuggaugaaauugcuucaaucauagacaauuaaacaauuuuuauuuucagcucugcgcggugcucaugccuguaaucccagcacuuugggaggcugaggcagguagaucacuugaggccaggaguuccagaccagcucauuacagcauggugaaaccccaucucuacuaaaaauacaaaaauuagcugggugugguggcucauaccugcaaucccagcuacucaggaagcugaggucgaagaaucgcuugaacccaggaggcagagguugcagugacccgagaucacgccucugcgcuccagccugggcgacacgagauuccaucucaaaaaacaaaacaaaauuucauuuuuauuuauuuauuauuuauuuauuuaucucauuauacacccacacacacagauguacacauacaugcacacauauauauauauguauauauggguguguguauacauauauauauauauauauauauauguauauauaugagcucugaugcacugaggcuuccacuggucuugaugugugugauucuaucuaucuaucuaucuaucuaucuaucuaucuauaaaaauaaagauaggaucuugcuguguugcccagacuggucucaagcuccuggccuuaggcaguccucccaccuuggccuccuaaaaugcugguauuacaguauuuauuuaaguuuuagguguuguuuuuuuuucgggggcuguuuuuuuggagauagggucuugcuauguugcccaggguggaauguagugguuguucaccagugccaucauagcucacugcauccuuaaacuccuggcucaagcagucuucucccuucagccuccugaauagcugagacuacaggugugcgccacugcaccuggcuguccuaugcaauaugagaccaggaaguugucaucuguguggagaggaauaaguguaaucccacauagggggauagucuaaaacaacauggagaguaccuuuagaccuggauuuuggggcucagcguugccaugggaaggaggcaugguguguagcagugguuaccagacuucuuucaguaguuuaaaggaauaaaaagagauggaagacugauacaguguuguucuuuaauuuugccaaggaaagucuuuaaaaaaaaaaaaacccucuguuguucuugucacuuaacacuaaaauguggaaaaacacaaugucaacaacagcaaaauagcagccaggcguggugguacuugccuguagucacagcuacuugugaggccgaggugggaggauugguugagcucaggaguuggagucugcagugagccaugauccuaccacugugcuccagccagggcaacagagugagacugucuuuuuuuuuuuuuuuuuuuugagucagcgucuugcucuguugcccaagcugagugcagugaugcaagcacagcucacuacagccuugaccucccaggugcaagcaauuuugcugccucaguuucccaaguagcugggacuagaggugcacaccaccacgccuggcuaauuuuugauguuuuuuagagaugagguuucacuauguuggccaggauguucucgaacaccuggacucaagugauccuccugccucagacugccaaagugcugggauuacaggcccagccuguaguuuguguccggcccggccgagacucugugucuuaaaaaagaaaacaaaaccuuucccaagaaaggacuucugacagucuuacauguaaacaauuuaaagacuuuaugucucagggguuccauguuugugaaaugagaaauaauuauagcugcugcacaggcuugucaaagaggauuauauaaagagccuuggugugaccccuagccauguccuuuucagaguacguggcuggaacucuuagcuccuucagucugacauuggagaugacuagagaccuugaaccaagugcccaggaggcagaaacucuccaaccacuacaucucugugcuggccuccaagaaggauugcccacauugugggaaagaucauuuuuauucucagaaaggagccccuggucaaauaacuugcuuggaagcaucuggguuuccccagugggcuaucagcugccuccaaugcugagaaaacaaagugucacaucgcucugcagaacuauaaaaagauguuuguuugcgggcuguuuggggaaggaaagugccggccccagcuagcagcucccacagcacccuuagcugggccuugccccaggguuuuguuuuucagagcucaccaagguuugcugaagaucuagaagggauuuuggggagggguucuggguuugacuugagguggaugugcccaugcucagguggccacagcuagagagugacagcgccaggcaagggcauggcagaaagcaggagauggcgacauucuuacuuuggcugaugagcuccugugaccuaugauucaucagcagcagaugaaguuguugaaugacucagauaaaauaggcgguucagggcauuucguagggugcauuucuuacuauacagcuuauguaucccuagcguccaccgugaaggcugcuugggccucagucuggggucguuccccauugucaucagcuugcugcacucuggucuaaauguuucugcugaagcuggaccaugguagauguggguguagaaucagccauggcuggaucugagccucuggcagcgguggcuacuugagcaagcauguuccugaaccugucugggccccacuugagccucauuuaugacauagagauaagauagcacacacccccaaugucauugagaggauuacaugggauaacccaugaauaguggcuggcauggaguaauacuuagcgaguguuagcugguguuguauuaggucauagacuaagcuguuauugagguagcagcauuaucuugggguuuacucacugucuuccgcacguacgggugauguaucugauuacucugagcacuaaauaaucuaaaaagcugguggcuugcaccuauggucccaguuauucgggaggcugaggcaagaggacugcuugagcccaggaguuagaggcugcagugagcuaugauugcaccacugcccuccagccugggugacagaacaagauccuaucucuuaaaaaagaagaaaaaaaaucugaaaagugaauuagaaggacugaauuuuuauuuuaagaaaaugcaauaugugauuuuauucagcccugaaaccaguuuguucagacauuagaguuaggcauuuuaccugcucugcauagcuacagaauaauacuaguggcaaggauggggaacaccuagaacucuucugcauugcuguugggaauguaaaaugcugcaaccacuuuguuaaccacgugcuuacccuaugacugaaugacucuacugcuaauacuuaaaagaaauuugugcuuguguccacuaaagguuucuuuuguuuguuuguuuuugugauggagucucacacugucacccagacuggagugcaguggcgugaucuuagcucacugcaaccuccacuucccagguugaagcaguuccccugccucagccuccagaguagcugggauuacagacacccaccaccauaccuggcuaauuuuuguauuuuuaguagagauggaguuucaccguuuuggccaggcuggucuuaaacuccugagcucagaugauccacccaccucggccucccaaagugcugggaucacacgugugagccaccgugccuggccuaaaggucuuauauaggaauguucaucccagcuuuacucauaauagccaaaaacuggaaacaacccaaauguccaucaacaagacaacaggguaaauaaauuacaccauauucaugcaaggguauacuuacauaaugaauaauaacuaauaaaaacaaaaaaacaaacuacugguuuguuuuuauuauuuauuugguggauacauuucaaaaacauuauguuaaaggaaagaagccagguaugaaagagaacauacuauauaauucuguuuauauauauauuucaagaaaaggcaaaacucaucuuuacugauggaaggagaaguuagagugguugcuuccguagggauuaacugggaaguggcaugaggaaccuuaaggaauggaaauguuucaucuugaucuaggugaugguuggauggguauauucauacuuaaaaaaacaacugaacuguacaguuaauauuuguacauuuauugaauauuucaccucaauucuaaaacuauauauauauaaagggcuaggugucauaucuuuccauuauacuuacauauaccuaauaauaccuaauauuauaccuaauaauaguaauuauaguugcuuacugauaacaacaacuaauaacacuuauugaggcccuacucugugccagggauuuucuaaucacuuaauucccuaacacauuaugagguuuuauuguuuucuccaauuuuacagacagggaaacugagacauggaguaguuaaguucauuuacccaguguaacacagcuggcagucugguuuuagauuuuguccaaugcacacuguguggcacugcccaggagcauaagcuccuugucaccgacccucuuuccuuccugcuuagagaugugcugaauuuccugcgcucaggggaccucccacccagggagcguguucgagcuguguacaaagaggcccaguacuaugccaucgggccccuccuggagcagcuggagaacaugcagccacugaagggcgagaaggugcgccaagcguuucugggacucaugcccuauuacaaaggugagggucagcugcccaggaugguggguaugugggaggaggucugcaaggcaucugugaguguuuaggucuccaucagaacaccgggggcagcauucauccagauuacucaagaugcgauggagugucaucccuucccagucacgcuggggagauucagguuaaggugggccuaccuggccuaugacaguuagcaaauuguauuucagaaggacagcccucgucccauuggcuucccuuugcuguggagaaccgugacccuuguuuaaguuugugcccuucauuggcccccugagucccuuccccgggaaaucugucuuuccccuccugcauccugccaucuucaggacuguuucucugugcaucucugcugcccuguccugccucuucacccuagugauagguguuguguucauccuuauagaccacuuggagcggauuguggagaucgcccggcugcgugcgguccagcggaaggcccgcuuugccaagcucaaggucugugucuucaaggaggagaugcccaucacccccuaugaguguccgcuccucaacucccugcgauuugagcggagugagagugacgggcagcuuuuugagcaccacugugaaguggaugugucuuuugggcccugggaggcuguggcugauguuuaugaccugcugcacugccuggucacggaccucucggcccagggucucaccguggaccaccagugcaucggggugugugacaagcaccucgugaaccacuacuacugcaagcgccccaucuaugaguucaagaucacaugguggugaguagccccgguaggcgagagucccaucagggaggauguccaccuugcuugguggcucugggaguaagaucccugaaggggcugcugacugccccagaaucugccgaggugagaacagcauccugaggcacagcucccaggggacagagguguagcuccaaucucccugacugcaccucaggguugggcucagggcuugcggccugcaggcacuccagccagcgcucaccuggccuuuccucaaggcaugguagucuuuccuugaggcugauagcuagggcuugaccaggaagucccgagaaguuuugucaccuucuugaccuugcaagagaguuucugcccauuuuagagccacguuaccaaaucgauguaggccuaaucacuuccucaacccuguucaagcgucccucccuugugcucaguauauuggugugaacacggaacaugaugggggauuuaccugaccagccaccccauagccccuggcugaagaagaaagagcaucuucucucccacugcaccccuucuccuccaagaauaguugcccacauucccaaaauguggaaagacuuuucuuuuccuuccggaacauguucuucaccaccuuuuggagauuuaaccauagcugccaaagcuaugcacccaguuggccuuagaaaaccacaauguuuacagcccugucuuagggccgcggcuucucuuaucuuccaccaccuuccuugcuugcaggguuaucuucucacagggcuggaaugcaaauuucagaggcuucuuuugaagauuccccaagucaagcaggcaagaugccuagaucuucuguuaucuuugacauguaacauccuuuuuagaggcucagaacaccuccuuggcugcuaucucauguguuagaauccaguuuguggugaaccucuuuggaaggggacccccucucuuuaaacccuguuccucuguccugguaacauucuccuucuaggagagccucucuucugagaagguaaaggaagggcugggugagacacacagcuauccuaggagccguaggaagacaaaacuucccuuuuguuuuacuccucacuccucuauuuuuguuuuacucacuucuuuauauuuuguuuuacuccucacuccuguauauuuugguuuacuuacuccucuauuucagaaauugaaaaagauccccaaggaucuguuacuacugcauuuccuucuugcucugucuacagccuaggccaacuagucagggucuggacaugcaucuccuaaaggaagaacuguguagcaccauugaucacaauguaacauuuccaugcugcauuaagggugucucucucuaaucaugauuguaccugucucuuccuggguaaagggagauuuuuuuuuuuaauguguaaagaauugaugcgagccaggaacaugucuguagucccagcuacuugggcacacgccuguaguccaggccacucgagcacacaccuguaguaccagcuacucuggaggcugaggcaggaggaucacuugagcccaggagauuaagacuguaguauacuaugaucgugccuguggcuagccacugugcuccagccugggcaacaccaucguaaaaauaaauaaauaaauaaauaaauuggggaggacagccucacugguaucagacuuacaggaccagauagacaagauggguauaaggggagcugaagucuguguucauaugaggaagagaagaccaagcccugggacuuuggcugaauuccuccguggggcuggacggcagugaucuccuguucccuauguguaaacaaagauuccagggcgugguuuugcacuccuguuguacucuuuuagagguggaaaagagguggauacugagaucuaagaggaaaggauagucauucacguucugagauaugcgcucucucuauuguucucguacacaaagggauagucucuuuucuggagcugaugucccugcuuggagguuagccccaaaacauggcucuuguauuguucuaagagaaaaggcuuucauuuugguucuucugauugguguuaccuacugccuaauauguguucauuuuuugacagagaggcagacuauugaaaaagucugugugaacagagagcaguucauuaagcccauugcuuucaguaauguggccuugaccccuucugcuucccccuucucccauggagcauggcagggcuugguuauuuagaguccauacaugcaagccauugagagacuuguuugcucaaaugcaaguuugcucaaaaacagguccugaaggcuugcuuaggauuacagggaugcuggguaagaacaccguuccucucucucgcuggagaaaucccuguuucucugacucccuuugugauccucacaguaauguauucugugccacuguaggacacaaggcucugggccaguagaacaggcagagaggugacacugggcagcaagcugagagcucuuucuaaauggagugaaggaauucaguggccuaguuucgccauucucuaaugagaaaccaaggccaggcugaaaagugcaauuagaugugguggauugugguaacggccuccagauaaagggguuaucccuguggaagugacuuuuccccauuugaucccuuuucaacucuaaauggccaggcccagaacagaagaaggguugggucuggaaggaaggcuccaaaggaugaaagcuucucccugaucauaaggaagugcaucuuuauagaauuguugugcauaaugucaguaaaucccucucacuugacaagggacuggauucaucuugccuugagacgggccaguaguuaucagugagucaaagcaaagugaaaguuucaggagaugggaccaauggugcaaugcucgccauaacaaaauuccuuaaaaauaaaaaagcuaauguuauagcaacaaaaaaagacugaagcaaaaccacacugaaaugcaucccacuccaggagaggaauucuuagcguaacacucuaaauaaauggaaggaaucaucaccuuccuuauuuuaccucugccuuguucaccaggcugcccagugcuuaccaugcagaaagcagucagcuguacucuggaaguuucuguucuucuuuccuggggcuuaggauauucugggagcugucugagccuugugccuaaggcuuaucaggugauauaaucuuccuguucugggcugcuugcuggaggaauaggaagugacauuuauaagacacaggcggugugagcauccauguguggucuuggucuaaa

SEQ ID NO: 14473 - RNA, 546 nt, Homo sapiens
uuuuguuuuguuuuuuuguuuuuguuuuuguuuuuugcgggcaugaggggcugguggugagaaagccagcugacucuuuauugcuuugggggcagggggcucaggagcucuugguggcgcggguccgcuuccgcuucaccaucacaggcuucuggcugcacaggauggcgcugacccugcggauggcugccaugcgcaggucggggcgguacuuguucuugaggaucaugugucugaugcugcugagcgugacgccagcauucuuguugauggugguccgcgcguaggagguggcaggcuucggcuggccggaucucugcuucgugaccaccaccacaccuuuguccucggcugccggcuccacgcccacagucuuguggugaaucagcccguuguagcggaaggagcuggggccuucaaguuacugggcuuggugcuguaggucggcauaguccucuugaucagaaacuggagcaguucugcacgaccauccauugcagaugcgcggacaugguggcggcuccucucgcaguggcggccugagac

SEQ ID NO: 14474 - RNA, 23882 nt, Homo sapiens
uaugggaaaacaaacuaaugcaguccagggcaguagauggauuucauucagaagagcagcagcuucuacugcaaguucaacagcagcaucaaccccagcagcagcagcaucaccaccaucaccaucaucagcaagcucagccucagcagacaguaccucagcaagcgcagacccagcagguucuuauuccugcaucacagcaaggugagacuggacuuguuuuccuacuuaugacuuggaaauuaaguuugucauuaugaaagaagagaaauauucugcauuuuuuggaucuugucuuuuaaggggcacauggagaaccuaaaaauaaacaaaaaccccucuguugauuucgggcuuuuuccccccuuucucuuggcugagggauguguauguaaauguauauaaauuuguauacaauguagguuguaucuguagaguaaugguagacaaguaauuuacuaauugaaagccuaagauauucagagaaguuauauuaauauuuuguuuugaaaaggcuauauagugauggauuuccuaaguuaaaucuaaaagguuuauuuacuaagggauuuauuauuuuauaugguacaauaguuauuugcuuucucuauaaaacauguucuuucaaagacauguuucagauuaguuuuuaaaauauaucuuacauucuggaguuuuuuguauacuuuggcaaucugaaaauucagcuccauaggaauuuauguaagccuaaauggacugaauuagauuuauuuuaaguuaagaguggauauauaacauaucuuaauuuauauuacuuggauuaaagcuaagaaaaagcaaauauucauagacuguguccauagugccuuguacucugcaagucauuuuauagauacuguuucacuggcaucuuauaagggcuuuguaaaauagcccuuggcucaguuuuacagcugaggaaaaucugagcccagaaaaggcuaagaaacuugaucuguauuuucucucaugacaaacaucuauucaguuauaaaacuuccugagcauucuaauucagugcaucugcuuuuaugggagaggacacuagaaguaaaugaaaaguucauuuuaauaucauuuaguuacucauuugccucauuugacaguauauauaugugucuuaaaauugguaaugacacacaguagaagaguauuuggguuauuuuacuguugauaucuagugguacuuuucauaccuaauuuuaauguguacuuuguaucaaauaauuuuauccuuuuauucuuuuuugaugacuguucuuccuguugccuucagaccuggcauuaggauuuuaggucaucauaaauuaaaauuugauuuucuucacucagagaauauuaggauaauggaguuaucuguucucugaaauuugcggaaucaaacauguaauuccuuuuacgcuuaaguaacauugccauuauuucugauuuguauuuuuuccgacuuuugccgguuuaccacucuucaggcaaccuggugguccccugcuuucaggaggccaccauauugaugccgaacuuauuuggacaccugaucagcauagcacauacagcccagaacuccugggcucaagugauccucccaccuuagccuccugaguugcugggacuacaggcaugcaucccugcacccggcugauuuguauuuuuuaaacagcugaugaaaguggcaugagucugucagcugucauauuuggaagaaaaggacuauguagauuucaaaaacuagucacaacuuuuugagcuuacuuuuauuggauuaguaacucauuguaacagugguaucauuguaucaguaaaacaguuaaccuugaguuaagacaaaauuauguuugaaaauguccaguuuacuuaagaaugcauagaacuauuuauguuuagauguuaagguaacucacuacuucauguuccuaaauucccuugcauccuuaggaauugccacuuaauuuuuuuuuuuugauauggaaccuugucacccauguuagagugcaguggcgugaucucagcuuacugcaaccuccaguuccggaguucaagugauucucaugccucagccugacacccaacuaauuuuuuuguauuuuuaguagagaugggguuucaccauauuggccagucuggucuugaacuccugaccucaagugauccacccgccuuggccucccaaagugcuguaauuacaggugugagccaccacgccugggcuuaaauauuuuuuaauguuuucuaguauaggguggguauaucacagcuguuauuugccauauacauuuauaauguccugagaugaaaugauugaaagcauuugagugcagaaaacaugaaaaacaugaaaaaaguuuucaucauuguauguaaaguguucuugugauuauaaaauagccucaugguuccuuguuugcauguucgcuuguuuuuuuguagccacagcaccacaaguuauuguuccagauucuaaguugauacagcauaugaaugcaucaaacaugguaagacucagaauguagcaguuugauuggcuguacuuaauucuaacccacauuguaauuaugccuauauauguccuauauuaacuacuugaaguuuauugaagacucaagcaaaacagcuguuuuaguuuccugaauauuggaucugaaguuuagcuugguaccuagacauuaagguucauaaaauuacggaauuguuuaagaauaccaaaagaauggugcuuugugagaguuauuccauucccuacuauuuccgaaaaaguuuuaggguaccuaccaagcuuauaaugccaaguaugguucuguuucaggagaccuaguaauugcaagagggugggaaggcuaagaauugugaacuuuuaaaaaaugaagauagacuggauaguucaguauaacuauuuuuaaaaucaagcauuuaaaaauauuacucugacuuaaccauaguauagucuaauaagucauuauaguguguaaauuaccacagaauacauuuuaaccagcugaguuauauuagaauuuuuauauuucugaggacuauccacuaaacuuuacaaguccucacucauauuuucaaauuacauuucagacauauaauauuucucaacaaauguaguauagguuaacuguaaacuugaaagaaccucuucagauccuuagaaaaucuuuaccuauauccuugaaguuguuuuuuguuuuuuuuuuuuuuuuggauaaaacauuaaaauauagucagauuagaguaguucaauacuuccuuauaaaugguuuuucuuuauucuguuuaaaauauacagacuguugauuucauugaguggugacucagcucuuacauuucauucuucagccaaaacuuuuauuuaaaggugaaagaaucaauauuuguaaaaagaucuuuuaaccuauguaacuaguuaguacuagaaaugagauuuuuuuuucccuccguucaaguuuuuuuuuuuuuuugaagauggagucuuacccugucacccaggcuggagugcaguggugugaucuuggcuaacugcaaccuccgccuccuagguucaagugauccucccaccucagccuccugaguagcugggaguacagguguaugucaccacaccuggcuaauuuuuuuguacuuuuaguagagacaggguuucaccauguuggccaggcuggucgcccaacuccucaccucaagcgaucugcccaccucggccuccugaaguguuaggauuacaggugugagccaccacgcccagccucaaguuuuuuuuuaaaccaaaaagcaguguaugaaaagaugaguucuacuuugugagugauacugaaucacaaaguucauuugugguuuauaagccagauaagaagggcuuacccacuagacagaugacuuccuccuacacauuaccagccucacaaauucauacuguggcagaauugaaaguuucuacaugauaguagaaauugcaguuuuuaaauucacaaauaucgaggaucucuguuuguacuuguaguugcaguuucuagaaucuuuucguuuacaugaaaauaaaaaauuucaugccuguuauuucucacaagauuuuuuauuggaaaaaacuccauuuuaagucuaaggccccaauuuuuuuuaaccuccacccuuaaaaaaaaaaaagucucacuauauguugcuuauuguaguugauguuauuaagacuauauccuagggaauaacucacauuauuuuaaaacaaauuuuggcagagucucuugugguaggccccucuaaaagaauuuuaaauguuguggaagagaauuuugaauuaguaaguuauuucugggauaaaaauuagugguccaucucuuacuuacugguuaagucuccuuuauucuaaagagcauauguauuuaaacaaaucauaggucaguuacucaggaaaauugauuuaacauuucuguauauuuuacauuuuacuuuguuguuuuuagucaguguuuccuucauguauuucugaacauaaucaguauaggcucuguaccaauaaaaguguuuuagguuuuuguggguuugcauuauucugauuuagaaauagcaaaaauauauuuguucuuucuaauggcucuguuugcauuagaaaugaacuaaucauaaaaacgugagauaauauaguagaaggcuauuucagggaacuucuagaaaaccauuguuuucgguucuuuuuuaugaaaugauuggucuaaugcauuauuuguguuugggcuguuuuguggaauacaagaagaaauuuuaauaguuauuaaguauaaggugguuaguguaugguacaugacucagcaaauauauguuaugcagcuugaauuuguggagggugugcagguaguuauugggucguguauucuauauggaaacuacuaugucaguuugcugguagagggagaauugcugucuuucaaaauaugaauuauaggcacuuaauauuucuaaauauuuuuguuuuuuucuuuuuaaauauuucuuaauaguauguggugguuaauauuuuccuuaaacuuagauaaccuuuaauuugcuuauauagccaaguuuuauuuuaaauuggguaauugaguauccaacuuaaauacgaaucacccgggugggcuauaguuaaauucuggagacacagugggaauuucaggcccaagauguagaaauuacuuagguuugucaaguggcaacaaguguauuuucuuggaaagcuauguaccuagagcccagacuagacaguaguugaacuauuaacucaguuuaauaauuuucuaaguuuguugacuucucugacacuagcauuuccaaagcaguuauauuuauuuuuuuaagcuuuuucagauauggguaguucuaaaacuguauagguuagauugaauguaugaaugguugguagcuaaagaagauugaaaagagagggaaaaaacuaccaaaauguguagcuauagcgggauacaggaaaauacuuaaagugcagaauaaaaaaccagagaauggcauaauucuuugcgggaggacaggaggagaaaacucuccagaacucuccaggaagucaagaauuuguccuggauuuaaagaaauucauaauauaaucccgucuauaucuuuauaacuuaagugucacauacuaacuugauuucaaaauguugaaacuaaaguuugugacuauugcccaggcuggagugcaguggcacaaucucggcucacugcaaccuccaccuucagguucaagccauccucccaccucacccucccaaguagcugggacuacaggugugcaccacccugcucagcuaauuuuuguauuuuuuguagaaaugggauuucaccauauugcccaggcuggucucaaacuccugagcucaagcgaucugcccacgugggccuccuaaagugcugggauuacaggcgugagccagucugccuggugugacuuuucuuaagauuuacagauuuuuuguauuaaucuguuauuaaugcauguuucaccuagaauauaaugccaguaugucccuuuuuucuuugcuaauaugacaucuuagaagaauugucagcuguacucccagugaagucuucugauacaguguucuuuauagauaucuguugauuuuaguagaaauuuuaaaaguuaagaauucuaaaaaguagauaauuauacuuuuaucucaaggaaauggggauaaggaaacagugggaaaggaagcaauaaugaaauagccauuucauauauuguacagcauuguuaauguggguauugucuaaaaauguguagguuagauugaguauaggaaggcuugguaccuuaaagaagauugaugggacaagaaggaaaaaaaaacugcaguaccugugagauuuacuuagagcaccuucucuaggggaaaaaacccaauuauauuguuguauuuaacugcuuaaaauaauuuaguagguuggaggcuagguuggucagucuuguaccauuuuauaaaaugggauuuagccuuacuagauuuuuuaaauuuugguauauucuaaacaaaaaguuucauacacuauuaaaauaugcuagagagaaacaguauuauacauguaugugguuuugauauuuuuucuuuguuuuuuucagagugcugcugcuacagcugcuaccuuagcacucccugcaggugugacuccuguucagcagauauuaacaaauucagguaauuaggaaugauggaaccauuuuaaaauguaauucagaaaauuguacuaucuagcccuuagguuuugucuucuuugaaagacagaaaauacuaauauuucuuuuaccauuugguuuagguuauuaaaauaacuuuauuugagggcuguaacacauauaacuguaaucguuguugaggauacaguaaagaagaugaaaauuguacuugaaccuuugaucugugcaugauaacccuauuauugaaguaugauuauauaaaaaugcuuacuuaguuuuuuacugaacacauuuaacaugccaagugaguauuaaacuucuuugaacuugugauaucaaaguaauuccuagagcauauuaagagcaaauuuauuguaugcuauuauuauacauaguaucucuucauugacaaaagaccaaugucuagcucauguguuuuggcauauuggugcuugaaaaauuuauuuacauggauuuuaaguguucccuauaaucuugauuauauaguuauuauuuauuuucuauucuguguauguuauuuuuguuaauuuguaaauuugugaaauuaggggcuugucuugcuacauauuuuaauaagauguaauuugcuuuuuaaucaauucaagauucuggguugucuaaaggaacauauugggggaauuugauucugugugaauuguaugacaaugaugauaacugguucugugaacuuuuauugcuuuuaccaauuuugaagcaaaguucuuuggugcuuuguuugguucaagauauuaaaugagcuauuaagcuuuuguuccuuuaaagcuuuaaaaaugaacagcucccgaagugucugaucuuacugcucuuucuucacuccuaagguuagcaaagauaauguaagcuuuagucaagucucauaaucuguuguuaaaaccuuguuggaaauagcugaaugaggauguaaauaugaaaaauaaaacauuuuaaggaauguauuugaacauggcgagaagucagagaaggggaggauuaugcauacuguguaugaaugacaaccuuuaauaaaauuguuaguuuucuugauaauuucuugugccuuuggugguaugaaauuaaauaugaauucauuucuuuugagauggucacugcuaaaaugauaacucggaaugcaugcuuuuugcuuuaggccagcuucuucagguggucagagcagccaauggugcccaauauaucuuucagccucagcagucagugguucuacaacaacagguuauaccacaaaugcagccugguggaguacaagcuccuguuauacagcagguaaaauaaucuucuauuaugaucaguaugggguucuguuuuauucuguauguauucccuggguaguuucccucuccuuauaugcacaaaagacucuuuuucagugcuacagacccaguuguuucaaauuucuccuguauacagcuuaacuuagauucagcauguauuaaacauguauuaaacaauuacuguugucucugcccauccuucaucauccccucgaagguggcagcacucuccuuccagcuuccuaagcuggucauucagccuuuauucaauaagcaguuacugagucucgggguauucacaagggucaggggauuuaggagugaaugacacagacaugacucuaguuuuaugaugcuuacuggaaguggguguguagaauccucccuuuuccuuaccucuaauacccaagguaucaagcccuaccaauucuuguuaauaguuuuucuuuucuuuuuuuuuuuuuuuucgagacagagucuugcucuuucacccaggcuggagugcaguggcgcgaucucagcucacugcaaccucugcuugcuggguucaugccauucuccugccucagccucccaaguagcugggacuacaggcgcccaccaccacacuuggcuaacuuuuguauuuuuaguagagaugggguuucaccguguuagcuaggaugguuucuaucuccuuaccuugugauccacccgccucggccucccaaagugcugggauuacaggugugagccacugcgcccggccuuuuuuuuuucuuuaacugcaguuuugccaugguugcagucccuuaauauguuugacacuguuuuuuucucagccucuuuuuucauuuccuuaguucauacuguccaugauuugucacuaaaaugcugcauugucuucuuaaugguuucucugccucucaucuuuugcccuccuaaccuggcugauuuauagucaucuuuuuuuuuuuuuuuuuuugagacagagucucugucaccuaggguggagugcaauggcgcaaucucagcucacugcaacucccgccuccuggguucaagugauucuccugccucagccuccugaguagcugggauuaguggcacgcaccacugugcccagcuaauuuuuguauuuuuaauagagacagaguuucaccaugucuagguuggacuugaacuccugacuucaggugaucugcccgcuuuugccucccaaagugcugggauuaugggcgugagccacugugccuggccuaucuuucuaaaaauccuaaaacuuuuaacagcuuuucauugccuacugagaagagccuaaacaacucaacaugguuuauaaaaucuuuuuguggaucuuguuucuuugaacucuccagguuuauuucuugccaugcucccaguuauuuucuuuagcugcauuuacaucaaaauaaacacuuggaucuacuuguguuauauucuugugcuguggcacuaaaaugaaagaggaaugguuauuuucuugaggaacuuauguacuuuauauguuuaugugucugucucuuuuuuaaaugucaguaaaauaguauuaugauagagacaagaucagagcaguacuauuaauccaguuuauuuacaucuuuccaaaauuauguacugcugucacuucuggguuucacuugauguuacacuucucuuaagaaugccgucuggcaacucccugcacuucccccaaacaaauagaaaaaccuggcuaaucuccuuaaagcagcagucucuuagcuuuuugacaccagggacugguuuuugcagaagacaauuuuuccauguacugggcagcagggaugguuucggggugaaacuuuuaauucaggucaucaggcauaaggagugcacaaccuccauccuugcaugugcaguucacaguaggguuccugcuccuaugagaaucucaugcugcugcugaucugacaggaagcagaguucagguggugaugcuggcucauccaccacucaccuccugcugugcagcccaguuucuaacagggguuggggaccgcugccuuuaagcacaaacagaaacuacuuacuaauaauauaaguaauauuugaucaugcuuuguccccuaaguugaauuugguacacucucuuguguucccauaacacugugucauauuuguacuacaucugcuguguuuuugaguuguuagugcuuugucuauuauaccauuuuuuugucuuuuguguuguuacaccacguguaagcauuuuaaaggaaauacugugucuuauuuuugcauuccuugaaccuaauggcaaguaacaagcaucuaguccuccuccuuuauuauaauacauauaguuaauauuuguuaguauauauuuuuucaaguuguggcuuacuuuagaauccuagaugcagaaccuggaaaggaacuucagaaaucugaucuggugguuuuuagaaaaauaauuagcuuuuaucucacacugagucagaauauuagggguauggccaagguaucaguacuuuuuaaguugccaggugguucauauuugcagccaggauugagaaccauuaagccuaguuugacagugaaacgacagaggccaagaggaguuaaaugacuugcgucugcuguauuuaugucugacuuuagacaaaaguagacccagguuggccaggcguuguggcucacgccuguaaucccagcacuuugggaggcgggcggaucaugaggucgugaguucgagaccagccugaccaacauggcaaaaccccgucucugcuaaaaauaacaaaauuagccgggcaugguggcgcgcaccuguagucccagcuacucaggaggcugaggugggagaauugcuugaacccaggaggcagggguugcagugagccgagaucacaccauugcacuccagccugggugacagaacgagacuccaucuauaaaaaaaaaaaaaaaagguagacccagguuuucagauucucaguccaguguucuucaugugaaggcaguguauaacuuuuguccugguagcuggcauauacauaguaugugcucaauaaaugaagcaguuaucuuuagaaaauccuuauuuucuagaaauuugauaaaauagaaauuuaaugggucacuacacuaguuaaacuaauugcuuuuguacuuugguaguuuuuaacuguguaugaaauauggccauucuggugaaucuuaagcauuuguuucuauuucuguguaccauacuugauccucuuaacuaguuacuguuaugugguuuucuuuugcuuuaggugcuggcuccucuuccuggagggauuucaccacagacaggugucaucauccagccucagcaaaucuuauuuacaggaaauaagacucaaguuauaccuacgacaguggcagcaccuacaccagcccaagcacagauaacugcaacuggccagcagcaaccgcaggcccagccugcucaaacacaagcuccauuggucuuacaaguugauggaacuggggauacaucaucugaagaagaugaagaugaagaagaagacuaugaugaugaugaggaggaagacaaagagaaagauggagcugaagaugggcagguggaagaaguaaguuucuaguaacauacuuaaaauaaucuacuugauuauuuccuuuuuuaguugguacaacacugauaaauuauauccuguuuuuuucagagacuguuaggugcuguacaacauaagauuuuaaagauaaaguuagauuguuuuaacuuuaguaagguuuuuauauucuggcuauauuuaucuucauaaaauauaacuuucauauagcugguaauaaaaaauguauaacaaauuaaauuguauuaauauguguaguaaagaguacagguaauucuaacucuggcuuacgcauuuauaauguggcuuaaacauaagacauugguagauaaauagaugugguuaaucuuuugcuucaguaauuuaaaaagcguggcaacauuuggggagagagcaaacucaagaaccaaaugucacaaauuuauuaaauauuuaaaaccuuuugguccauguucuauaccacuuccuuaaaaaccuauguacccuuaaugucuguguucuucuagaagcauauaaauaugccuuuguuuuccucacuauuucagcuuaguuacuaggcuccaaaaacuauuugucccaccacaauuuucacuguuaauugccuucguuagccuaaaaugcagucuuuuuguuucuuaguacaaaguucuucuaaauuaucuaaguaauuuuuuuucugaagaaaacauaguuuauuauugaauauugaauagacacaaaugaauagaaauguuucaagauaaaaaucauccuggugcccaccaucuaguuaaaauaaaauuccauuauuuaaagugccuuagaugccucucccuaaucccaucauuccuaggccaucaaaguaccuuugcucauacauuuguguugauuauuaauugcuuuuauauuuuaccauauauauuuauauuccuaaauagcauauuguuuaguuuugcauguuuacaacguaaaugaaguaauuacguauucuucugcaaguugguuuuuuccccuuaaaaugauauuccugagguuuauccaaguuguugcauauagcuauaauuauuuucauugcugaauauaccauaauuuuauuugucaauuuuucuaauccaguggacauaaggauuguuucuuguuguuuacuguuacaaacaguuauaaaauauuguaguguaugucuucuggggacacaaaugcaagagguucucuaaauuuuauaccgaacauugaacuucuggcuccuaagucaugcacaucugcaacuuuauaauaaaaugccaaaucacuucugccauucaauacauaauugugcagauguccauacccccuuaucaauaccugauagugucaggcuuccugauuuuugcuggucugguagguagaaaauaguauuauuucauuuugguuuuaguuugcauuuccucacuuaggaguuuuagccucuuuuuguauauuuauuugauauuuguguuuuguauagaagugcuuauugaggucucuugcccguuuccucccccuaaauucuucauaguuucagugcuucuugaaguaacauguuuuuauuaccuuuuccaguuuauugguaggauggaaauauguagcgcuuuuaauauucauccuugaaccagccaccguccuaaugucuuuuguuaguccucauaauguaucuguagauucuuuuguaucuucuguguagacuuucacaucuuauaugaagaacggcaguuuuuuguggcucauuggcuaagccuucgggaacaguauugauuagaaguggugauagcaggcacucuucucuucuucuuaaacugaaaaguaaucuuuuccaugcuucacuguuaaguuuaauguuuguuguggguuuucuuuuuuuuuaauggauaucuucaucagguuaaguaaauucccuucuuugcauugcuuuguuuuuuaaacuguaagugaauguugcauuuaauuaaacaccuuuucugcaaugauuuguauaauuucucacguaauguuauuuauaauggauuucauuaauugauuuucuauuuguaaaccaaucuuguacuccugggauagcacaacuugaucauuuuauauuucucuuuuuauaaauugcugaauucauuuuguugaggacuuuuuuguagauauuuaugauugauagauacugugugauuuucuguucucauacucuucuuacaagguuuucaguuaugguagcuuuguuaaaugaauuuggggacauguuuccuguauuuugaacucuuuuuuuuuuuucaaagauuguauuuaauucuucuguugauauuuguuaaaacaugacacuacagauaccugggucuaguaaucucaugcccuucaaguauuuuguuucuguuugagaccguuuugauaaguuauauuuuucuaggacucucuauauauuuaucuaaauuuucaaguugauuaacaugaaguuaaucaugauauugucuuuuugaugccagaauccuuugucaucuucauuccuaauauaauuauugugccaucuuuuuuuuucccuguucagucuuaccagggauguguugauuuuauuaauguuuucaaagaguaaacuuuuagcuuuauucucucuaguguguuuuucccauucuauucuuuucugacuuaacuguuuuguuuguagagaauaugaucugugugaugugugaaucuuuugaaauugcuugagacuugcuugauuuggucaguuuuuguauaugcuuugaaaagaauguguuuucugcacuuguuugguauuuguaugugucuguuagauuuauauugucaguagguuugcucagaugcucuuuauguauccuugauauuuuuugugugcuugauccauuuuuuuuuugagauggagucucgcucugucacccaagcuggagugcaguggcacuaucucugcucacugcaugcuccaucccccggguuuacgccauucuccugccucagccuccugaguagcugggacuagaggugcccgccaccucgcccggcuaauuuuuuguauuuuuaguagagaugggguuucgcuguguuagccaggauggucuugaucuccugaccucgugauccgcccaccuuggccucccaaagugcugggauuauaggcaugagccaccgcgccuggccacuugauccauuuuuuacuacugagugagauauguucauguuuccugcuaugguaguugauauauuucuucuuguuuuucugccauuuuuccuuuuuguauuuugagccucaaaacaggugcauguaaguuuaacauucauuguuuuuucucagugaguugaaccauuuaugaucauacaaugucuuaaguuauugcuaguaaauuuuuuuuaaccaugaagucuguuuguaugauacuguuagagcuguaccagcuuuguugugguuagaauuugccugguacagcuuuuuucauucuuucacuuuucaaacauuuuggaucuguaaacuuaaucuuuuuaaaauagaauauugcuauuuaugcuauuuguugcaaaacuuuaacaucaaccaagacuauucaguagggacagaauagucuucaacaaauuaugcuuggacaauuagauauccgcaugcaaaagaguuaaguuggaccccuacggcauaccacauacaaaaauuaaaguggauuagggaccuacaucuaagagcugaaauuauaaaacucuuagaagaaaacauagggguaaaucuccauagcuuuggcaacaguuucuuuuuuuuuuuuucgagacagagucucacgcuaucgcccaggcuggagugcaguggcgcgaugucggcucacugcaagcucagccucccggguucacaccauucuccugccucagccucccaaguagcugggacuacaggugcccgccaccaugcccggcuaauuuuuuguauuuuuuuuuuuaguagagacgggguuucacuguguuagccaggauagucucgaucuccugaccucgugaucugcccaccucggccucgcaaaguacugggauuacaggcgugagccauugugcccagccgcuugcaacaguuuucuuagacaugacacccagaguacaagcaaucaaagaaaaaguggacuuuguagauuaaaaaggugguuuuuguuuuuguuuuuguuugagacagaaucucacucuguugcccagacuggagugcaguggcaugaucguggcucacugcagccucagcaucuugaccucccgggcuggagugaucuuucugccucagccuccugaguagcugggagaaaauauuugcaaaucauguauuugauaaggaucuacuauccagaauauauaaagaacucuuaaacagcguaacaacaaaaagauaaugcaauuuaaaaacuggcaaagaacuugaauagacauuucuccaaagaagauacacaaauagcuaacaagcauaugaaaagaugcucagcaucauuagucauuagagaaaugcaaaugaaaaccacacugagauaaccacuuuacaccuucuagaauagcuauacucaaaaaagaaagagaaaauaaaugcuggugaggauuuggagaaauuggagcccuugugcauuguugguggaaauguaaaaugguacagcugcugugggaaacaguuugauaguccucaaaaauucaguauagaauuauccauaugacccagcaguuccacucuuaaauauauacacaagagaacugaaaacauguuuuucaacaaaaacuuguaugugacuguucauagcagcccuauuuaugauauccaagugguauaaacccaaauguucaucagcugauaacaguggaauauuauuuagccauaagaagaaugaaguauucguauaugcuacaacauggaugaaccuugaaaacaugcuaugugaaagacaucagccacacaacgccacauauuauaugauuccauuuauaugaaauauccagaauaggcaaauccauacagacagcagauuauagauugccaggggacagggagaauggggagugacagcuuaauagguaagagugaugaaauguucuggaacuagguaguggugaguguuauauacacuguaaauguucauugcaccugaauuguacauguacaaaugcuaaaauagugaauguuguuaacuugaauuuuaccucagagauuuuuuuuuuuuuuuuugagacggaguuucacucugcugcccaggcuggagugcaguggugcaaucuuggcuuacugcaggcuccgccuucuggguucccgccauucuccugccucagccucccgaguagcugggacuacaggcaccugccaccaugcccggcuaauuuuuuuguauuuuuaguagagacgggguuucaccguguuagccaggauggucucgaucuccugaccucgugaucugccugccucagccucccaaagugcuggaauuacaggugugagccaccacgccugguguagaaaauuuuuuucauuuuacauugaugauaccuauuuuaaauuaaagaauaucuauacauacacaccuguguaaguagguauaggccuagacauaauaauuuuuuuuuuuuguucuuauuguugauauagagucucagguuguuguccaggcuggagugcaauggugugaucaaggcucauagcuucaaccaccuggguucaaguaauccucccacccucauccuccugaguaggugggacuauaggcauaugccaccauaccucgcuaauuuuuuuuauuuuuuguagagguggcaucucacuguauuucccuggcuggucucaaacuccuggccugaagugauugucccgccuaggccacccaaagugcuagaauuaacaggcaugagccacugugccuguccauaauauagucuugauuauugucuucucuacuuugguuuugucuucucuuucugcauuuauuagaaaucucaguuacaucuucuaucuucugucacaauugaagcgaaauuuaacaugguuguuuauuuuaugcucuaguuagguuuuaucuuggccccuaacucucuuuaaugcugagauuuccuacuuucugccuuuaagaaaaaaaaaaagucugaaucuuaauucugcuucauaccucuaccauaaccaucaucaugcuaaacaugcugauuuguauuuagaguccaaguucuuuaauguaaagacagcaaggcagacugcuagccuauugcauugcucuucuuuucuccucuaauuucuccacuguuuucuguuuuauaugauuuguaguacauagugccauuagcucuuuugaaccuucauauuagguccuuuucuaggcaucuuaaacaguuauuguagagaauuaucuucuuguacuguuuuuaaaaaauaaagaaaauaaagauaggccgggugugguggcucacgccuguaaucccagcacuuugggaggccuaggcgggguggaucacgaggucaagagaucaagaccaucuuggccaacauugugaaacaccgucuguacuaaaaacacaaaaauuagcugggugugguggcgcgugccaguagugccagcuacuggggaggcugaggcaggagaauugcucgaagccgggaggcagagguugcagugagccgagauugcaccagccuggcuacagagcgagacugugucucaaaaaaagaaagaagaaaauaaagauaaacaucuuuucagacuuaaaaauuacauagcuuagcuaauuuaauuauauuuaauuucuuacauuucaguaauauuggcaaacuguuaacagcugauuugacaauauuaaauucauggcguacauauaugcauuuggcauuugguucucaaagaacaucaaggucauuauauuuuuuuuuucagugaauauuaaggccuucuuauaguaauaagaacucuccuuuuauuuguaggagccccucaauagugaagaugaugugagugaugaggaaggacaggaacucuuugacacagaaaauguuguuguaugccaauaugauaagguaaggaugucaucuucagauuacugacguuauuuguguuguaauuucuucccuacauuauucuuucugccuuauugaaacauuugggcagcugauucaugccucuuaaauucauuaugaauaguacgaaaacccuguuagaguuuuguggauuauuuuaauagaaugaaagauuaauuucuuagcuuuauguuugaaaaauaaguuaugaaugaaaugaaaagagcuacgaucuucuuuuucuauuuagacagucuuugaacuuguaagcagaguaaacagccacuuugagguuguccuuugugguaauagcuaacucaaugagauaauucuguuuucuauuuagccucaacuaucucaaaacuagaaggguucaauugaaucucuguaacuguuuuuauuauuaaggaaaagacuaaggcaaugaacagugcuaaaaacaaacauaaguuuuuacugaaaauuauuuaaaauauuauuuaacuuugcuguaguuugcuaacauuaaggaauuuuuaaaccagauacugugaaaacuagccauugauuccuuauuuucuuaauuccuagacagggugcuucuuuccaaguauuuuuguuacauuuauuuguauuauuucugagauuuuuguuuucaagacauuuaaauuguaauacaguuuuuuuauugcaaucauuaaauuuauaaugcaugcaaauauuacguugcauuuauaauuuuaguagagaucuuuaccaaaugcuaaaaauucuaacaaaagcuuauuuauucaacauuuauagagugcggaaauuuaccagacacuauucuaggcccuggcgauguaguuaugaacauguaaaauucaugccuugcaugaaguuuccuuuauagaugaagaaaaucuuaauucuguugcuuuuauggaaaugaaugugauaaguagccgugcuuacuucaaacagaucuauagggagaaugccaacacuauggaucuuauuuacuaauaaaaagguggaguuaggcuaguuuuaccagugaaguuauagaaugaagacaguaaggucauugagaguuucacagcauucauuuuugugcauaaugacuucugagagacuguucuuaaaaccauauaccaugugcaguauaauaaauguaauuuccuguuagauacacauagagcaagacuaugagguuaaaacaaaagauaccauuaaaucuuuauuguuaggaagucucagaggaucuccuugcaaccaaauuauccagaacacaauuucaugaugagaugucagauuuaucaggcaagcgaggaccuuuguuuuagccugacugaagaauauacuuuuaagugucuuccuacuuuaagacaaugguuguauucuccuuuggcacaaacuguacucauaauauuuuaaauguuaaaauugguuuguuuugcucccagagacauuacuuuacuguuuuaaauuaguaagugggagauagcucuaaauggugugcugaaugauaaauaauuuuaaaauuugcagaggucuaauuuugagaaucaaaugaauugcucugaagauuggaggagggugguggcuugaugucuuuagccaauaguaaagaacagcaguuuucuuugacugcgcaaaaugagguuggauauuguuugagccaacuugaauuucaggaauguaguuuugaagccuuaacuuuagaaugucaacaaugagucaauuuuagaagagaucauagaacgacuaauaaagcuuguauugccaaucaaaucagaaucuuaguuaaaugcuaauaauaugguagaguucuugcuuacguguggguggauaagggcugauacagcauuuagcgaaaauagcaucagauguagguaaacuugcuuuaacacauuuuuaauuaggaaauuuaagagggcuuucuccuggcuuuaagaauauuccuucaugaagggcuuagggccgguaaauagauugcuuuuuaaguugugacuuuguacuucuauuaauauaaaaauauuuaccauuuauuacccaacaugacuucaguguugacuguguggauuaguuggcccaugaaacuuugguacauuuauuuuuugcaaauuguccuguccuaugacagaaugcaggcaguuucuuuacuugucuauagaaucucuuauuuccuggcuacucaucacuuucuuguuuuugucuagcuaagcccacggucuuucugguugcagucacuugguucaugcuggaaauacauuuguauacacguuuguagaauaaauaauacuuuauaggaauucaaagauaaggggagacagcucuuuucaugugcaacagauacuguuuaugaugucccuuggcacuauucuuggagcuugagauacacuaaugaucaaaacagaacagucccugccauugggaagcuuacuccaaucaggggagauagaugcuaaaacauaauaaauuaggauuuauuuacuuauuuaaaacauaauaaaauauuuauauguuagaagcugauagucgguauggaaaaauaaagagcagggaaagaggacagguuugguuucaguuuuaaauaggauagucauaguaggucuuuggagaaaaugacauuuuagcaaagacuuggaaagaguuagcccugucaucugguggcagagucuguuguaugugaggaacagcaaggaggccuguguggcuagacuggagugagggaagaggagaguacaguaguagguagagagguaagggaaggcagauaguaaggauuuuguaaggacauggcucuuacucuuaagugaaucagaaaguuauuggaagguuucagugagacaaaugguaugaacugauuuaaauuuugaaaggauuacuuugcuuucuuuguagagagcauaauaugaggaggaagcagagguugcugaaacgagacuauuuagggggauauuauaauaauucacaugggagauaaugaugacucggccuauggugaugguauuaaaguuggugagaaguaguuggauuuuggauuuguuuugaaggaagaauguuaacagcauuuccugacucugagauuugugguagaaaagaaaaaggaaucaagaaugacucuugagauuuuuugaugaggauucugaaagaaggauggugauaccaucaguucagaugaggaaaagcugcauguggagcugguuggacaugccaagucugguauguccguuagacauucaagucaucaaucuuaagaugcuacauuuagcauuuauguaguguauuuagaccagagauauaauuaguucuuaauccaacagucuuuacccuaccugcuguuuuaccuuuauugugcuuuguuuugcuuuaauaaguaagcaaaguuugaauccagaagaagaacaugagaguaguuuccaaauaagaugaagguuguuugauugagugauuuuuuuuuuuuaagucucaaaaagcagagcuaggaucaauaaauggaaguuggagaagcagauuuccguaaggguaaacucugaaagauuuuacaagagagcuguuccaaaaaggaauaacuuaauuugaaauucuuugcucacuguuucuaaucguauuuaagcagacacugcacaaccauuugccaggaauaugucaugaagaauguuugcacugggagguuaggccauggaauuuuaggaaugagaucucagaaaauaucuguaccuggccgggugcaguggcucacgccuguaaucccagcacuuugggaggccgaggugggggaucaccugaggucaagaguucaagaccagccuggccagccuggugaaacccaucucuacaaaaauacaaaaauuagcugggcgugauggugagugccuguaaucccagcuacucaggaggcugaggcaggagaaucacuugaaccugggagggggagguugcagugagccaagaucgugccauugcacuccagccuggauaacagagugagacucugucucaaagaaaaaaaagaaaaagaaaauaucuauaccuguugagcauuucugcauuauuauaugaaacagacugauuuaguaaaagcguacuggaccaagacuugaaaaucaugauugucacuuaguagcaguauacacuuggucaaaccauugaacccuauccaaucugucauuucuucuucugaaaaugaaagccugaacuaguugauuuuuuuuuuuuuuuagguaccuuuagaucauagaauagggagaaccagggggccuucuuugcagaagauguggaacuugaacauuaaauaauuagugugacuuacugggaaaaggaagaaaggucacuucaguucauuaaguuuuacaacuccucucccccaccaaauccauggaauuacaaacaacuacggacuauaagugaaggcaaagaugggagugcccagagccugcccuucagcucuuuuuguuuaacuguggauguacauaguuuuugaaaucugguguaagugacuggaugauuagcauccuuuagauguauuuuuaaaauacugcuauguauaagguuccaugguaguuaggucuugagaacucuauaaggaguuuuauuuugguagaagaaaugaguccauaauuguauuacuuacaaauaauguaagaaaugucaaugaaaauaccauugggaauuuaacaguggaaaagaauaguuuuagcugguaagauuugggaaagcuuuguggaggauagucuuuuugagguagaccuugaaaauauauaugcaaaccugguagagagauaagacauuuuguaaagaaauauuuuuuaacuacuuuaaugaacacaaguacuaaaagcuauaaaauaguacuaauuacagauaaauuuguuuuuagacccaccuagugaguuuugugugugguuuuuuuguuguuguuguucuuuuuggugaaauuaaacuuuauuaagaaaccaauuuuuaggccaggugcugugacucacgcuuguaaucccaacacuuugggaggcugagauagaaggaucacgugaggccaggagcucgagcccagccugcacaacauaggagacccuucuucuacaaaaacaaaccaauuugcaaauacaauacuguaaauacuguuuuguggggggguguguguguacguguguguguguauggguuuuuuguuacuuguuuucucuguuuucugauuguaucucucaauuuuuaaaauguuguuuuuguuuagauacacagaaguaaaaacaaauggaaauuucaucucaaggauggcauuaugaaucuuaauggaagagauuauauauuuuccaaagccauuggagaugcagaauggugaa

SEQ ID NO: 14475 - RNA, 23882 nt, Homo sapiens
uucaccauucugcaucuccaauggcuuuggaaaauauauaaucucuuccauuaagauucauaaugccauccuugagaugaaauuuccauuuguuuuuacuucuguguaucuaaacaaaaacaacauuuuaaaaauugagagauacaaucagaaaacagagaaaacaaguaacaaaaaacccauacacacacacacguacacacacacccccccacaaaacaguauuuacaguauuguauuugcaaauugguuuguuuuuguagaagaagggucuccuauguugugcaggcugggcucgagcuccuggccucacgugauccuucuaucucagccucccaaaguguugggauuacaagcgugagucacagcaccuggccuaaaaauugguuucuuaauaaaguuuaauuucaccaaaaagaacaacaacaacaaaaaaaccacacacaaaacucacuaggugggucuaaaaacaaauuuaucuguaauuaguacuauuuuauagcuuuuaguacuuguguucauuaaaguaguuaaaaaauauuucuuuacaaaaugucuuaucucucuaccagguuugcauauauauuuucaaggucuaccucaaaaagacuauccuccacaaagcuuucccaaaucuuaccagcuaaaacuauucuuuuccacuguuaaauucccaaugguauuuucauugacauuucuuacauuauuuguaaguaauacaauuauggacucauuucuucuaccaaaauaaaacuccuuauagaguucucaagaccuaacuaccauggaaccuuauacauagcaguauuuuaaaaauacaucuaaaggaugcuaaucauccagucacuuacaccagauuucaaaaacuauguacauccacaguuaaacaaaaagagcugaagggcaggcucugggcacucccaucuuugccuucacuuauaguccguaguuguuuguaauuccauggauuuggugggggagaggaguuguaaaacuuaaugaacugaagugaccuuucuuccuuuucccaguaagucacacuaauuauuuaauguucaaguuccacaucuucugcaaagaaggcccccugguucucccuauucuaugaucuaaagguaccuaaaaaaaaaaaaaaaucaacuaguucaggcuuucauuuucagaagaagaaaugacagauuggauaggguucaaugguuugaccaaguguauacugcuacuaagugacaaucaugauuuucaagucuugguccaguacgcuuuuacuaaaucagucuguuucauauaauaaugcagaaaugcucaacagguauagauauuuucuuuuucuuuuuuuucuuugagacagagucucacucuguuauccaggcuggagugcaauggcacgaucuuggcucacugcaaccucccccucccagguucaagugauucuccugccucagccuccugaguagcugggauuacaggcacucaccaucacgcccagcuaauuuuuguauuuuuguagagauggguuucaccaggcuggccaggcuggucuugaacucuugaccucaggugaucccccaccucggccucccaaagugcugggauuacaggcgugagccacugcacccggccagguacagauauuuucugagaucucauuccuaaaauuccauggccuaaccucccagugcaaacauucuucaugacauauuccuggcaaaugguugugcagugucugcuuaaauacgauuagaaacagugagcaaagaauuucaaauuaaguuauuccuuuuuggaacagcucucuuguaaaaucuuucagaguuuacccuuacggaaaucugcuucuccaacuuccauuuauugauccuagcucugcuuuuugagacuuaaaaaaaaaaaaucacucaaucaaacaaccuucaucuuauuuggaaacuacucucauguucuucuucuggauucaaacuuugcuuacuuauuaaagcaaaacaaagcacaauaaagguaaaacagcagguaggguaaagacuguuggauuaagaacuaauuauaucucuggucuaaauacacuacauaaaugcuaaauguagcaucuuaagauugaugacuugaaugucuaacggacauaccagacuuggcauguccaaccagcuccacaugcagcuuuuccucaucugaacugaugguaucaccauccuucuuucagaauccucaucaaaaaaucucaagagucauucuugauuccuuuuucuuuucuaccacaaaucucagagucaggaaaugcuguuaacauucuuccuucaaaacaaauccaaaauccaacuacuucucaccaacuuuaauaccaucaccauaggccgagucaucauuaucucccaugugaauuauuauaauaucccccuaaauagucucguuucagcaaccucugcuuccuccucauauuaugcucucuacaaagaaagcaaaguaauccuuucaaaauuuaaaucaguucauaccauuugucucacugaaaccuuccaauaacuuucugauucacuuaagaguaagagccauguccuuacaaaauccuuacuaucugccuucccuuaccucucuaccuacuacuguacucuccucuucccucacuccagucuagccacacaggccuccuugcuguuccucacauacaacagacucugccaccagaugacagggcuaacucuuuccaagucuuugcuaaaaugucauuuucuccaaagaccuacuaugacuauccuauuuaaaacugaaaccaaaccuguccucuuucccugcucuuuauuuuuccauaccgacuaucagcuucuaacauauaaauauuuuauuauguuuuaaauaaguaaauaaauccuaauuuauuauguuuuagcaucuaucuccccugauuggaguaagcuucccaauggcagggacuguucuguuuugaucauuaguguaucucaagcuccaagaauagugccaagggacaucauaaacaguaucuguugcacaugaaaagagcugucuccccuuaucuuugaauuccuauaaaguauuauuuauucuacaaacguguauacaaauguauuuccagcaugaaccaagugacugcaaccagaaagaccgugggcuuagcuagacaaaaacaagaaagugaugaguagccaggaaauaagagauucuauagacaaguaaagaaacugccugcauucugucauaggacaggacaauuugcaaaaaauaaauguaccaaaguuucaugggccaacuaauccacacagucaacacugaagucauguuggguaauaaaugguaaauauuuuuauauuaauagaaguacaaagucacaacuuaaaaagcaaucuauuuaccggcccuaagcccuucaugaaggaauauucuuaaagccaggagaaagcccucuuaaauuuccuaauuaaaaauguguuaaagcaaguuuaccuacaucugaugcuauuuucgcuaaaugcuguaucagcccuuauccacccacacguaagcaagaacucuaccauauuauuagcauuuaacuaagauucugauuugauuggcaauacaagcuuuauuagucguucuaugaucucuucuaaaauugacucauuguugacauucuaaaguuaaggcuucaaaacuacauuccugaaauucaaguuggcucaaacaauauccaaccucauuuugcgcagucaaagaaaacugcuguucuuuacuauuggcuaaagacaucaagccaccacccuccuccaaucuucagagcaauucauuugauucucaaaauuagaccucugcaaauuuuaaaauuauuuaucauucagcacaccauuuagagcuaucucccacuuacuaauuuaaaacaguaaaguaaugucucugggagcaaaacaaaccaauuuuaacauuuaaaauauuaugaguacaguuugugccaaaggagaauacaaccauugucuuaaaguaggaagacacuuaaaaguauauucuucagucaggcuaaaacaaagguccucgcuugccugauaaaucugacaucucaucaugaaauuguguucuggauaauuugguugcaaggagauccucugagacuuccuaacaauaaagauuuaaugguaucuuuuguuuuaaccucauagucuugcucuauguguaucuaacaggaaauuacauuuauuauacugcacaugguauaugguuuuaagaacagucucucagaagucauuaugcacaaaaaugaaugcugugaaacucucaaugaccuuacugucuucauucuauaacuucacugguaaaacuagccuaacuccaccuuuuuauuaguaaauaagauccauaguguuggcauucucccuauagaucuguuugaaguaagcacggcuacuuaucacauucauuuccauaaaagcaacagaauuaagauuuucuucaucuauaaaggaaacuucaugcaaggcaugaauuuuacauguucauaacuacaucgccagggccuagaauagugucugguaaauuuccgcacucuauaaauguugaauaaauaagcuuuuguuagaauuuuuagcauuugguaaagaucucuacuaaaauuauaaaugcaacguaauauuugcaugcauuauaaauuuaaugauugcaauaaaaaaacuguauuacaauuuaaaugucuugaaaacaaaaaucucagaaauaauacaaauaaauguaacaaaaauacuuggaaagaagcacccugucuaggaauuaagaaaauaaggaaucaauggcuaguuuucacaguaucugguuuaaaaauuccuuaauguuagcaaacuacagcaaaguuaaauaauauuuuaaauaauuuucaguaaaaacuuauguuuguuuuuagcacuguucauugccuuagucuuuuccuuaauaauaaaaacaguuacagagauucaauugaacccuucuaguuuugagauaguugaggcuaaauagaaaacagaauuaucucauugaguuagcuauuaccacaaaggacaaccucaaaguggcuguuuacucugcuuacaaguucaaagacugucuaaauagaaaaagaagaucguagcucuuuucauuucauucauaacuuauuuuucaaacauaaagcuaagaaauuaaucuuucauucuauuaaaauaauccacaaaacucuaacaggguuuucguacuauucauaaugaauuuaagaggcaugaaucagcugcccaaauguuucaauaaggcagaaagaauaauguagggaagaaauuacaacacaaauaacgucaguaaucugaagaugacauccuuaccuuaucauauuggcauacaacaacauuuucugugucaaagaguuccuguccuuccucaucacucacaucaucuucacuauugaggggcuccuacaaauaaaaggagaguucuuauuacuauaagaaggccuuaauauucacugaaaaaaaaaauauaaugaccuugauguucuuugagaaccaaaugccaaaugcauauauguacgccaugaauuuaauauugucaaaucagcuguuaacaguuugccaauauuacugaaauguaagaaauuaaauauaauuaaauuagcuaagcuauguaauuuuuaagucugaaaagauguuuaucuuuauuuucuucuuucuuuuuuugagacacagucucgcucuguagccaggcuggugcaaucucggcucacugcaaccucugccucccggcuucgagcaauucuccugccucagccuccccaguagcuggcacuacuggcacgcgccaccacacccagcuaauuuuuguguuuuuaguacagacgguguuucacaauguuggccaagauggucuugaucucuugaccucgugauccaccccgccuaggccucccaaagugcugggauuacaggcgugagccaccacacccggccuaucuuuauuuucuuuauuuuuuaaaaacaguacaagaagauaauucucuacaauaacuguuuaagaugccuagaaaaggaccuaauaugaagguucaaaagagcuaauggcacuauguacuacaaaucauauaaaacagaaaacaguggagaaauuagaggagaaaagaagagcaaugcaauaggcuagcagucugccuugcugucuuuacauuaaagaacuuggacucuaaauacaaaucagcauguuuagcaugaugaugguuaugguagagguaugaagcagaauuaagauucagacuuuuuuuuuuucuuaaaggcagaaaguaggaaaucucagcauuaaagagaguuaggggccaagauaaaaccuaacuagagcauaaaauaaacaaccauguuaaauuucgcuucaauugugacagaagauagaagauguaacugagauuucuaauaaaugcagaaagagaagacaaaaccaaaguagagaagacaauaaucaagacuauauuauggacaggcacaguggcucaugccuguuaauucuagcacuuuggguggccuaggcgggacaaucacuucaggccaggaguuugagaccagccagggaaauacagugagaugccaccucuacaaaaaauaaaaaaaauuagcgagguaugguggcauaugccuauagucccaccuacucaggaggaugagggugggaggauuacuugaacccaggugguugaagcuaugagccuugaucacaccauugcacuccagccuggacaacaaccugagacucuauaucaacaauaagaacaaaaaaaaaaaauuauuaugucuaggccuauaccuacuuacacagguguguauguauagauauucuuuaauuuaaaauagguaucaucaauguaaaaugaaaaaaauuuucuacaccaggcgugguggcucacaccuguaauuccagcacuuugggaggcugaggcaggcagaucacgaggucaggagaucgagaccauccuggcuaacacggugaaaccccgucucuacuaaaaauacaaaaaaauuagccgggcaugguggcaggugccuguagucccagcuacucgggaggcugaggcaggagaauggcgggaacccagaaggcggagccugcaguaagccaagauugcaccacugcacuccagccugggcagcagagugaaacuccgucucaaaaaaaaaaaaaaaaaucucugagguaaaauucaaguuaacaacauucacuauuuuagcauuuguacauguacaauucaggugcaaugaacauuuacaguguauauaacacucaccacuaccuaguuccagaacauuucaucacucuuaccuauuaagcugucacuccccauucucccuguccccuggcaaucuauaaucugcugucuguauggauuugccuauucuggauauuucauauaaauggaaucauauaauauguggcguuguguggcugaugucuuucacauagcauguuuucaagguucauccauguuguagcauauacgaauacuucauucuucuuauggcuaaauaauauuccacuguuaucagcugaugaacauuuggguuuauaccacuuggauaucauaaauagggcugcuaugaacagucacauacaaguuuuuguugaaaaacauguuuucaguucucuuguguauauauuuaagaguggaacugcugggucauauggauaauucuauacugaauuuuugaggacuaucaaacuguuucccacagcagcuguaccauuuuacauuuccaccaacaaugcacaagggcuccaauuucuccaaauccucaccagcauuuauuuucucuuucuuuuuugaguauagcuauucuagaagguguaaagugguuaucucagugugguuuucauuugcauuucucuaaugacuaaugaugcugagcaucuuuucauaugcuuguuagcuauuuguguaucuucuuuggagaaaugucuauucaaguucuuugccaguuuuuaaauugcauuaucuuuuuguuguuacgcuguuuaagaguucuuuauauauucuggauaguagauccuuaucaaauacaugauuugcaaauauuuucucccagcuacucaggaggcugaggcagaaagaucacuccagcccgggaggucaagaugcugaggcugcagugagccacgaucaugccacugcacuccagucugggcaacagagugagauucugucucaaacaaaaacaaaaacaaaaaccaccuuuuuaaucuacaaaguccacuuuuucuuugauugcuuguacucugggugucaugucuaagaaaacuguugcaagcggcugggcacaauggcucacgccuguaaucccaguacuuugcgaggccgaggugggcagaucacgaggucaggagaucgagacuauccuggcuaacacagugaaaccccgucucuacuaaaaaaaaaaauacaaaaaauuagccgggcaugguggcgggcaccuguagucccagcuacuugggaggcugaggcaggagaauggugugaacccgggaggcugagcuugcagugagccgacaucgcgccacugcacuccagccugggcgauagcgugagacucugucucgaaaaaaaaaaaaagaaacuguugccaaagcuauggagauuuaccccuauguuuucuucuaagaguuuuauaauuucagcucuuagauguaggucccuaauccacuuuaauuuuuguaugugguaugccguagggguccaacuuaacucuuuugcaugcggauaucuaauuguccaagcauaauuuguugaagacuauucugucccuacugaauagucuugguugauguuaaaguuuugcaacaaauagcauaaauagcaauauucuauuuuaaaaagauuaaguuuacagauccaaaauguuugaaaagugaaagaaugaaaaaagcuguaccaggcaaauucuaaccacaacaaagcugguacagcucuaacaguaucauacaaacagacuucaugguuaaaaaaaauuuacuagcaauaacuuaagacauuguaugaucauaaaugguucaacucacugagaaaaaacaaugaauguuaaacuuacaugcaccuguuuugaggcucaaaauacaaaaaggaaaaauggcagaaaaacaagaagaaauauaucaacuaccauagcaggaaacaugaacauaucucacucaguaguaaaaaauggaucaaguggccaggcgcgguggcucaugccuauaaucccagcacuuugggaggccaaggugggcggaucacgaggucaggagaucaagaccauccuggcuaacacagcgaaaccccaucucuacuaaaaauacaaaaaauuagccgggcgagguggcgggcaccucuagucccagcuacucaggaggcugaggcaggagaauggcguaaacccgggggauggagcaugcagugagcagagauagugccacugcacuccagcuugggugacagagcgagacuccaucucaaaaaaaaaauggaucaagcacacaaaaaauaucaaggauacauaaagagcaucugagcaaaccuacugacaauauaaaucuaacagacacauacaaauaccaaacaagugcagaaaacacauucuuuucaaagcauauacaaaaacugaccaaaucaagcaagucucaagcaauuucaaaagauucacacaucacacagaucauauucucuacaaacaaaacaguuaagucagaaaagaauagaaugggaaaaacacacuagagagaauaaagcuaaaaguuuacucuuugaaaacauuaauaaaaucaacacaucccugguaagacugaacagggaaaaaaaaagauggcacaauaauuauauuaggaaugaagaugacaaaggauucuggcaucaaaaagacaauaucaugauuaacuucauguuaaucaacuugaaaauuuagauaaauauauagagaguccuagaaaaauauaacuuaucaaaacggucucaaacagaaacaaaauacuugaagggcaugagauuacuagacccagguaucuguagugucauguuuuaacaaauaucaacagaagaauuaaauacaaucuuugaaaaaaaaaaaagaguucaaaauacaggaaacauguccccaaauucauuuaacaaagcuaccauaacugaaaaccuuguaagaagaguaugagaacagaaaaucacacaguaucuaucaaucauaaauaucuacaaaaaaguccucaacaaaaugaauucagcaauuuauaaaaagagaaauauaaaaugaucaaguugugcuaucccaggaguacaagauugguuuacaaauagaaaaucaauuaaugaaauccauuauaaauaacauuacgugagaaauuauacaaaucauugcagaaaagguguuuaauuaaaugcaacauucacuuacaguuuaaaaaacaaagcaaugcaaagaagggaauuuacuuaaccugaugaagauauccauuaaaaaaaaagaaaacccacaacaaacauuaaacuuaacagugaagcauggaaaagauuacuuuucaguuuaagaagaagagaagagugccugcuaucaccacuucuaaucaauacuguucccgaaggcuuagccaaugagccacaaaaaacugccguucuucauauaagaugugaaagucuacacagaagauacaaaagaaucuacagauacauuaugaggacuaacaaaagacauuaggacgguggcugguucaaggaugaauauuaaaagcgcuacauauuuccauccuaccaauaaacuggaaaagguaauaaaaacauguuacuucaagaagcacugaaacuaugaagaauuuagggggaggaaacgggcaagagaccucaauaagcacuucuauacaaaacacaaauaucaaauaaauauacaaaaagaggcuaaaacuccuaagugaggaaaugcaaacuaaaaccaaaaugaaauaauacuauuuucuaccuaccagaccagcaaaaaucaggaagccugacacuaucagguauugauaaggggguauggacaucugcacaauuauguauugaauggcagaagugauuuggcauuuuauuauaaaguugcagaugugcaugacuuaggagccagaaguucaauguucgguauaaaauuuagagaaccucuugcauuuguguccccagaagacauacacuacaauauuuuauaacuguuuguaacaguaaacaacaagaaacaauccuuauguccacuggauuagaaaaauugacaaauaaaauuaugguauauucagcaaugaaaauaauuauagcuauaugcaacaacuuggauaaaccucaggaauaucauuuuaaggggaaaaaaccaacuugcagaagaauacguaauuacuucauuuacguuguaaacaugcaaaacuaaacaauaugcuauuuaggaauauaaauauauaugguaaaauauaaaagcaauuaauaaucaacacaaauguaugagcaaagguacuuugauggccuaggaaugaugggauuagggagaggcaucuaaggcacuuuaaauaauggaauuuuauuuuaacuagauggugggcaccaggaugauuuuuaucuugaaacauuucuauucauuugugucuauucaauauucaauaauaaacuauguuuucuucagaaaaaaaauuacuuagauaauuuagaagaacuuuguacuaagaaacaaaaagacugcauuuuaggcuaacgaaggcaauuaacagugaaaauuguggugggacaaauaguuuuuggagccuaguaacuaagcugaaauagugaggaaaacaaaggcauauuuauaugcuucuagaagaacacagacauuaaggguacauagguuuuuaaggaagugguauagaacauggaccaaaagguuuuaaauauuuaauaaauuugugacauuugguucuugaguuugcucucuccccaaauguugccacgcuuuuuaaauuacugaagcaaaagauuaaccacaucuauuuaucuaccaaugucuuauguuuaagccacauuauaaaugcguaagccagaguuagaauuaccuguacucuuuacuacacauauuaauacaauuuaauuuguuauacauuuuuuauuaccagcuauaugaaaguuauauuuuaugaagauaaauauagccagaauauaaaaaccuuacuaaaguuaaaacaaucuaacuuuaucuuuaaaaucuuauguuguacagcaccuaacagucucugaaaaaaacaggauauaauuuaucaguguuguaccaacuaaaaaaggaaauaaucaaguagauuauuuuaaguauguuacuagaaacuuacuucuuccaccugcccaucuucagcuccaucuuucucuuugucuuccuccucaucaucaucauagucuucuucuucaucuucaucuucuucagaugauguauccccaguuccaucaacuuguaagaccaauggagcuuguguuugagcaggcugggccugcgguugcugcuggccaguugcaguuaucugugcuugggcugguguaggugcugccacugucguagguauaacuugagucuuauuuccuguaaauaagauuugcugaggcuggaugaugacaccugucuguggugaaaucccuccaggaagaggagccagcaccuaaagcaaaagaaaaccacauaacaguaacuaguuaagaggaucaaguaugguacacagaaauagaaacaaaugcuuaagauucaccagaauggccauauuucauacacaguuaaaaacuaccaaaguacaaaagcaauuaguuuaacuaguguagugacccauuaaauuucuauuuuaucaaauuucuagaaaauaaggauuuucuaaagauaacugcuucauuuauugagcacauacuauguauaugccagcuaccaggacaaaaguuauacacugccuucacaugaagaacacuggacugagaaucugaaaaccugggucuaccuuuuuuuuuuuuuuuuauagauggagucucguucugucacccaggcuggagugcaauggugugaucucggcucacugcaaccccugccuccuggguucaagcaauucucccaccucagccuccugaguagcugggacuacaggugcgcgccaccaugcccggcuaauuuuguuauuuuuagcagagacgggguuuugccauguuggucaggcuggucucgaacucacgaccucaugauccgcccgccucccaaagugcugggauuacaggcgugagccacaacgccuggccaaccugggucuacuuuugucuaaagucagacauaaauacagcagacgcaagucauuuaacuccucuuggccucugucguuucacugucaaacuaggcuuaaugguucucaauccuggcugcaaauaugaaccaccuggcaacuuaaaaaguacugauaccuuggccauaccccuaauauucugacucagugugagauaaaagcuaauuauuuuucuaaaaaccaccagaucagauuucugaaguuccuuuccagguucugcaucuaggauucuaaaguaagccacaacuugaaaaaauauauacuaacaaauauuaacuauauguauuauaauaaaggaggaggacuagaugcuuguuacuugccauuagguucaaggaaugcaaaaauaagacacaguauuuccuuuaaaaugcuuacacgugguguaacaacacaaaagacaaaaaaaugguauaauagacaaagcacuaacaacucaaaaacacagcagauguaguacaaauaugacacaguguuaugggaacacaagagaguguaccaaauucaacuuaggggacaaagcaugaucaaauauuacuuauauuauuaguaaguaguuucuguuugugcuuaaaggcagcgguccccaaccccuguuagaaacugggcugcacagcaggaggugagugguggaugagccagcaucaccaccugaacucugcuuccugucagaucagcagcagcaugagauucucauaggagcaggaacccuacugugaacugcacaugcaaggauggagguugugcacuccuuaugccugaugaccugaauuaaaaguuucaccccgaaaccaucccugcugcccaguacauggaaaaauugucuucugcaaaaaccagucccuggugucaaaaagcuaagagacugcugcuuuaaggagauuagccagguuuuucuauuuguuugggggaagugcagggaguugccagacggcauucuuaagagaaguguaacaucaagugaaacccagaagugacagcaguacauaauuuuggaaagauguaaauaaacuggauuaauaguacugcucugaucuugucucuaucauaauacuauuuuacugacauuuaaaaaagagacagacacauaaacauauaaaguacauaaguuccucaagaaaauaaccauuccucuuucauuuuagugccacagcacaagaauauaacacaaguagauccaaguguuuauuuugauguaaaugcagcuaaagaaaauaacugggagcauggcaagaaauaaaccuggagaguucaaagaaacaagauccacaaaaagauuuuauaaaccauguugaguuguuuaggcucuucucaguaggcaaugaaaagcuguuaaaaguuuuaggauuuuuagaaagauaggccaggcacaguggcucacgcccauaaucccagcacuuugggaggcaaaagcgggcagaucaccugaagucaggaguucaaguccaaccuagacauggugaaacucugucucuauuaaaaauacaaaaauuagcugggcacaguggugcgugccacuaaucccagcuacucaggaggcugaggcaggagaaucacuugaacccaggaggcgggaguugcagugagcugagauugcgccauugcacuccacccuaggugacagagacucugucucaaaaaaaaaaaaaaaaaaagaugacuauaaaucagccagguuaggagggcaaaagaugagaggcagagaaaccauuaagaagacaaugcagcauuuuagugacaaaucauggacaguaugaacuaaggaaaugaaaaaagaggcugagaaaaaaacagugucaaacauauuaagggacugcaaccauggcaaaacugcaguuaaagaaaaaaaaaaggccgggcgcaguggcucacaccuguaaucccagcacuuugggaggccgaggcggguggaucacaagguaaggagauagaaaccauccuagcuaacacggugaaaccccaucucuacuaaaaauacaaaaguuagccaagugugguggugggcgccuguagucccagcuacuugggaggcugaggcaggagaauggcaugaacccagcaagcagagguugcagugagcugagaucgcgccacugcacuccagccugggugaaagagcaagacucugucucgaaaaaaaaaaaaaaaagaaaagaaaaacuauuaacaagaauugguagggcuugauaccuuggguauuagagguaaggaaaagggaggauucuacacacccacuuccaguaagcaucauaaaacuagagucaugucugugucauucacuccuaaauccccugacccuugugaauaccccgagacucaguaacugcuuauugaauaaaggcugaaugaccagcuuaggaagcuggaaggagagugcugccaccuucgaggggaugaugaaggaugggcagagacaacaguaauuguuuaauacauguuuaauacaugcugaaucuaaguuaagcuguauacaggagaaauuugaaacaacugggucuguagcacugaaaaagagucuuuugugcauauaaggagagggaaacuacccagggaauacauacagaauaaaacagaaccccauacugaucauaauagaagauuauuuuaccugcuguauaacaggagcuuguacuccaccaggcugcauuugugguauaaccuguuguuguagaaccacugacugcugaggcugaaagauauauugggcaccauuggcugcucugaccaccugaagaagcuggccuaaagcaaaaagcaugcauuccgaguuaucauuuuagcagugaccaucucaaaagaaaugaauucauauuuaauuucauaccaccaaaggcacaagaaauuaucaagaaaacuaacaauuuuauuaaagguugucauucauacacaguaugcauaauccuccccuucucugacuucucgccauguucaaauacauuccuuaaaauguuuuauuuuucauauuuacauccucauucagcuauuuccaacaagguuuuaacaacagauuaugagacuugacuaaagcuuacauuaucuuugcuaaccuuaggagugaagaaagagcaguaagaucagacacuucgggagcuguucauuuuuaaagcuuuaaaggaacaaaagcuuaauagcucauuuaauaucuugaaccaaacaaagcaccaaagaacuuugcuucaaaauugguaaaagcaauaaaaguucacagaaccaguuaucaucauugucauacaauucacacagaaucaaauucccccaauauguuccuuuagacaacccagaaucuugaauugauuaaaaagcaaauuacaucuuauuaaaauauguagcaagacaagccccuaauuucacaaauuuacaaauuaacaaaaauaacauacacagaauagaaaauaaauaauaacuauauaaucaagauuauagggaacacuuaaaauccauguaaauaaauuuuucaagcaccaauaugccaaaacacaugagcuagacauuggucuuuugucaaugaagagauacuauguauaauaauagcauacaauaaauuugcucuuaauaugcucuaggaauuacuuugauaucacaaguucaaagaaguuuaauacucacuuggcauguuaaauguguucaguaaaaaacuaaguaagcauuuuuauauaaucauacuucaauaauaggguuaucaugcacagaucaaagguucaaguacaauuuucaucuucuuuacuguauccucaacaacgauuacaguuauauguguuacagcccucaaauaaaguuauuuuaauaaccuaaaccaaaugguaaaagaaauauuaguauuuucugucuuucaaagaagacaaaaccuaagggcuagauaguacaauuuucugaauuacauuuuaaaaugguuccaucauuccuaauuaccugaauuuguuaauaucugcugaacaggagucacaccugcagggagugcuaagguagcagcuguagcagcagcacucugaaaaaaacaaagaaaaaauaucaaaaccacauacauguauaauacuguuucucucuagcauauuuuaauaguguaugaaacuuuuuguuuagaauauaccaaaauuuaaaaaaucuaguaaggcuaaaucccauuuuauaaaaugguacaagacugaccaaccuagccuccaaccuacuaaauuauuuuaagcaguuaaauacaacaauauaauuggguuuuuuccccuagagaaggugcucuaaguaaaucucacagguacugcaguuuuuuuuuccuucuugucccaucaaucuucuuuaagguaccaagccuuccuauacucaaucuaaccuacacauuuuuagacaauacccacauuaacaaugcuguacaauauaugaaauggcuauuucauuauugcuuccuuucccacuguuuccuuauccccauuuccuugagauaaaaguauaauuaucuacuuuuuagaauucuuaacuuuuaaaauuucuacuaaaaucaacagauaucuauaaagaacacuguaucagaagacuucacugggaguacagcugacaauucuucuaagaugucauauuagcaaagaaaaaagggacauacuggcauuauauucuaggugaaacaugcauuaauaacagauuaauacaaaaaaucuguaaaucuuaagaaaagucacaccaggcagacuggcucacgccuguaaucccagcacuuuaggaggcccacgugggcagaucgcuugagcucaggaguuugagaccagccugggcaauauggugaaaucccauuucuacaaaaaauacaaaaauuagcugagcaggguggugcacaccuguagucccagcuacuugggagggugaggugggaggauggcuugaaccugaagguggagguugcagugagccgagauugugccacugcacuccagccugggcaauagucacaaacuuuaguuucaacauuuugaaaucaaguuaguaugugacacuuaaguuauaaagauauagacgggauuauauuaugaauuucuuuaaauccaggacaaauucuugacuuccuggagaguucuggagaguuuucuccuccuguccucccgcaaagaauuaugccauucucugguuuuuuauucugcacuuuaaguauuuuccuguaucccgcuauagcuacacauuuugguaguuuuuucccucucuuuucaaucuucuuuagcuaccaaccauucauacauucaaucuaaccuauacaguuuuagaacuacccauaucugaaaaagcuuaaaaaaauaaauauaacugcuuuggaaaugcuagugucagagaagucaacaaacuuagaaaauuauuaaacugaguuaauaguucaacuacugucuagucugggcucuagguacauagcuuuccaagaaaauacacuuguugccacuugacaaaccuaaguaauuucuacaucuugggccugaaauucccacugugucuccagaauuuaacuauagcccacccgggugauucguauuuaaguuggauacucaauuacccaauuuaaaauaaaacuuggcuauauaagcaaauuaaagguuaucuaaguuuaaggaaaauauuaaccaccacauacuauuaagaaauauuuaaaaagaaaaaaacaaaaauauuuagaaauauuaagugccuauaauucauauuuugaaagacagcaauucucccucuaccagcaaacugacauaguaguuuccauauagaauacacgacccaauaacuaccugcacacccuccacaaauucaagcugcauaacauauauuugcugagucauguaccauacacuaaccaccuuauacuuaauaacuauuaaaauuucuucuuguauuccacaaaacagcccaaacacaaauaaugcauuagaccaaucauuucauaaaaaagaaccgaaaacaaugguuuucuagaaguucccugaaauagccuucuacuauauuaucucacguuuuuaugauuaguucauuucuaaugcaaacagagccauuagaaagaacaaauauauuuuugcuauuucuaaaucagaauaaugcaaacccacaaaaaccuaaaacacuuuuauugguacagagccuauacugauuauguucagaaauacaugaaggaaacacugacuaaaaacaacaaaguaaaauguaaaauauacagaaauguuaaaucaauuuuccugaguaacugaccuaugauuuguuuaaauacauaugcucuuuagaauaaaggagacuuaaccaguaaguaagagauggaccacuaauuuuuaucccagaaauaacuuacuaauucaaaauucucuuccacaacauuuaaaauucuuuuagaggggccuaccacaagagacucugccaaaauuuguuuuaaaauaaugugaguuauucccuaggauauagucuuaauaacaucaacuacaauaagcaacauauagugagacuuuuuuuuuuuuaaggguggagguuaaaaaaaauuggggccuuagacuuaaaauggaguuuuuuccaauaaaaaaucuugugagaaauaacaggcaugaaauuuuuuauuuucauguaaacgaaaagauucuagaaacugcaacuacaaguacaaacagagauccucgauauuugugaauuuaaaaacugcaauuucuacuaucauguagaaacuuucaauucugccacaguaugaauuugugaggcugguaauguguaggaggaagucaucugucuaguggguaagcccuucuuaucuggcuuauaaaccacaaaugaacuuugugauucaguaucacucacaaaguagaacucaucuuuucauacacugcuuuuugguuuaaaaaaaaacuugaggcugggcgugguggcucacaccuguaauccuaacacuucaggaggccgaggugggcagaucgcuugaggugaggaguugggcgaccagccuggccaacauggugaaacccugucucuacuaaaaguacaaaaaaauuagccagguguggugacauacaccuguacucccagcuacucaggaggcugaggugggaggaucacuugaaccuaggaggcggagguugcaguuagccaagaucacaccacugcacuccagccugggugacaggguaagacuccaucuucaaaaaaaaaaaaaaacuugaacggagggaaaaaaaaaucucauuucuaguacuaacuaguuacauagguuaaaagaucuuuuuacaaauauugauucuuucaccuuuaaauaaaaguuuuggcugaagaaugaaauguaagagcugagucaccacucaaugaaaucaacagucuguauauuuuaaacagaauaaagaaaaaccauuuauaaggaaguauugaacuacucuaaucugacuauauuuuaauguuuuauccaaaaaaaaaaaaaaaacaaaaaacaacuucaaggauauagguaaagauuuucuaaggaucugaagagguucuuucaaguuuacaguuaaccuauacuacauuuguugagaaauauuauaugucugaaauguaauuugaaaauaugagugaggacuuguaaaguuuaguggauaguccucagaaauauaaaaauucuaauauaacucagcugguuaaaauguauucugugguaauuuacacacuauaaugacuuauuagacuauacuaugguuaagucagaguaauauuuuuaaaugcuugauuuuaaaaauaguuauacugaacuauccagucuaucuucauuuuuuaaaaguucacaauucuuagccuucccacccucuugcaauuacuaggucuccugaaacagaaccauacuuggcauuauaagcuugguagguacccuaaaacuuuuucggaaauaguagggaauggaauaacucucacaaagcaccauucuuuugguauucuuaaacaauuccguaauuuuaugaaccuuaaugucuagguaccaagcuaaacuucagauccaauauucaggaaacuaaaacagcuguuuugcuugagucuucaauaaacuucaaguaguuaauauaggacauauauaggcauaauuacaauguggguuagaauuaaguacagccaaucaaacugcuacauucugagucuuaccauguuugaugcauucauaugcuguaucaacuuagaaucuggaacaauaacuuguggugcuguggcuacaaaaaaacaagcgaacaugcaaacaaggaaccaugaggcuauuuuauaaucacaagaacacuuuacauacaaugaugaaaacuuuuuucauguuuuucauguuuucugcacucaaaugcuuucaaucauuucaucucaggacauuauaaauguauauggcaaauaacagcugugauauacccacccuauacuagaaaacauuaaaaaauauuuaagcccaggcgugguggcucacaccuguaauuacagcacuuugggaggccaaggcggguggaucacuugaggucaggaguucaagaccagacuggccaauauggugaaaccccaucucuacuaaaaauacaaaaaaauuaguugggugucaggcugaggcaugagaaucacuugaacuccggaacuggagguugcaguaagcugagaucacgccacugcacucuaacaugggugacaagguuccauaucaaaaaaaaaaaauuaaguggcaauuccuaaggaugcaagggaauuuaggaacaugaaguagugaguuaccuuaacaucuaaacauaaauaguucuaugcauucuuaaguaaacuggacauuuucaaacauaauuuugucuuaacucaagguuaacuguuuuacugauacaaugauaccacuguuacaaugaguuacuaauccaauaaaaguaagcucaaaaaguugugacuaguuuuugaaaucuacauaguccuuuucuuccaaauaugacagcugacagacucaugccacuuucaucagcuguuuaaaaaauacaaaucagccgggugcagggaugcaugccuguagucccagcaacucaggaggcuaaggugggaggaucacuugagcccaggaguucugggcuguaugugcuaugcugaucagguguccaaauaaguucggcaucaauaugguggccuccugaaagcaggggaccaccagguugccugaagagugguaaaccggcaaaagucggaaaaaauacaaaucagaaauaauggcaauguuacuuaagcguaaaaggaauuacauguuugauuccgcaaauuucagagaacagauaacuccauuauccuaauauucucugagugaagaaaaucaaauuuuaauuuaugaugaccuaaaauccuaaugccaggucugaaggcaacaggaagaacagucaucaaaaaagaauaaaaggauaaaauuauuugauacaaaguacacauuaaaauuagguaugaaaaguaccacuagauaucaacaguaaaauaacccaaauacucuucuacugugugucauuaccaauuuuaagacacauauauauacugucaaaugaggcaaaugaguaacuaaaugauauuaaaaugaacuuuucauuuacuucuaguguccucucccauaaaagcagaugcacugaauuagaaugcucaggaaguuuuauaacugaauagauguuugucaugagagaaaauacagaucaaguuucuuagccuuuucugggcucagauuuuccucagcuguaaaacugagccaagggcuauuuuacaaagcccuuauaagaugccagugaaacaguaucuauaaaaugacuugcagaguacaaggcacuauggacacagucuaugaauauuugcuuuuucuuagcuuuaauccaaguaauauaaauuaagauauguuauauauccacucuuaacuuaaaauaaaucuaauucaguccauuuaggcuuacauaaauuccuauggagcugaauuuucagauugccaaaguauacaaaaaacuccagaauguaagauauauuuuaaaaacuaaucugaaacaugucuuugaaagaacauguuuuauagagaaagcaaauaacuauuguaccauauaaaauaauaaaucccuuaguaaauaaaccuuuuagauuuaacuuaggaaauccaucacuauauagccuuuucaaaacaaaauauuaauauaacuucucugaauaucuuaggcuuucaauuaguaaauuacuugucuaccauuacucuacagauacaaccuacauuguauacaaauuuauauacauuuacauacacaucccucagccaagagaaaggggggaaaaagcccgaaaucaacagagggguuuuuguuuauuuuuagguucuccaugugccccuuaaaagacaagauccaaaaaaugcagaauauuucucuucuuucauaaugacaaacuuaauuuccaagucauaaguaggaaaacaaguccagucucaccuugcugugaugcaggaauaagaaccugcugggucugcgcuugcugagguacugucugcugaggcugagcuugcugaugauggugaugguggugaugcugcugcugcugggguugaugcugcuguugaacuugcaguagaagcugcugcucuucugaaugaaauccaucuacugcccuggacugcauuaguuuguuuucccaua

SEQ ID NO: 14476 - RNA, 398 nt, Homo sapiens
aaucucgcuccgccagaccgccgccgcgccgccaucauggacaccagccgugugcagccuaucaagcuggccagggucaccaagguccugggcaggaccgguucucagggacagugcacgcaggugcgcguggaauucauggacgacacgagccgauccaucauccgcaauguaaaaggccccgugcgcgagggcgacgugcucacccuuuuggagucagagcgagaagcccggagguugcgcugagcuuggcugcucgcugggucuuggaugucggguucgaccacuuggccgaugggaauggucugucacaaucugcuccuuuuuuuuguccgccacacguaacugagaugcuccuuuaaauaaagcguuuguguuucaaaaaaaaaaaaaaaaaa

SEQ ID NO: 14477 - RNA, 1689 nt, Homo sapiens
ccuggcagcugucggcuggaaggaacuggucugcucacacuugcuggcuugcgcaucaggacuggcuuuaucuccugacucacggugcaaaggugcacucugcgaacguuaaguccguccccagcgcuuggaauccuacggcccccacagccggauccccucagccuuccagguccucaacucccguggacgcugaacaauggccuccauggggcuacagguaaugggcaucgcgcuggccguccugggcuggcuggccgucaugcugugcugcgcgcugcccauguggcgcgugacggccuucaucggcagcaacauugucaccucgcagaccaucugggagggccuauggaugaacugcguggugcagagcaccggccagaugcagugcaagguguacgacucgcugcuggcacugccgcaggaccugcaggcggcccgcgcccucgucaucaucagcaucaucguggcugcucugggcgugcugcuguccgugguggggggcaaguguaccaacugccuggaggaugaaagcgccaaggccaagaccaugaucguggcgggcgugguguuccuguuggccggccuuauggugauagugccgguguccuggacggcccacaacaucauccaagacuucuacaauccgcugguggccuccgggcagaagcgggagaugggugccucgcucuacgucggcugggccgccuccggccugcugcuccuuggcggggggcugcuuugcugcaacuguccaccccgcacagacaagccuuacuccgccaaguauucugcugcccgcucugcugcugccagcaacuacguguaaggugccacggcuccacucuguuccucucugcuuuguucuucccuggacugagcucagcgcaggcugugaccccaggagggcccugccacgggccacuggcugcuggggacuggggacugggcagagacugagccaggcaggaaggcagcagccuucagccucucuggcccacucggacaacuucccaaggccgccuccugcuagcaagaacagaguccacccuccucuggauauuggggagggacggaagugacaggguguggugguggaguggggagcuggcuucugcuggccaggauagcuuaacccugacuuugggaucugccugcaucggcguuggccacuguccccauuuacauuuuccccacucugucugccugcaucuccucuguuccggguaggccuugauaucaccucugggacugugccuugcucaccgaaacccgcgcccaggaguauggcugaggccuugcccacccaccugccugggaagugcagaguggauggacggguuuagaggggaggggcgaaggugcuguaaacagguuugggcaguggugggggagggggccagagaggcggcucagguugcccagcucuguggccucaggacucucugccucacccgcuucagcccagggccccuggagacugauccccucugaguccucugccccuuccaaggacacuaaugagccugggaggguggcagggaggaggggacagcuucacccuuggaaguccugggguuuuuccucuuccuucuuugugguuucuguuuuguaauuuaagaagagcuauucaucacuguaauuauuauuauuuucuacaauaaaugggaccugugcacaggaggaaau

SEQ ID NO: 14478 - RNA, 3381 nt, Homo sapiens
cgcgaggggaggggcaagcaccgcggguugcccagccuagggcgaggccaggugcggcgcucagggcgacccgcgcaaagccugcggggauuacguaauggcguaaggggcggggauggaggcggggccggacuguucucggggauacguaaggaaacgggaccaagggcggagaaucccgcgaugggggcggggagagggcggggcucaagucggaacugggcggggcggcugaagacggaaaugggcggggcugcgagcuagggcgggagaaggagcgcggggaggacguaccuugugagaugcgagccggccaacagcuugcaagcaugcuccgcuggacccgagccuggaggcucccgcgugagggacucggcccccacggcccuagcuucgcgagggugccugucgcacccagcagcagcagcggcggccgagggggcgccgagccgaggucagucaagggcaccgggcgggaggccauccucuguccuccuuuuccugccgggccccgacggccccaucuccucccuuugggccugucaccucccaggccucucccccaaagcucuuucccccuaccccuuuccccgucuccgccggcucagacucugaccucgauccuuccccugccaggccgcuuccgcuuuccuacaggcuucuggacggggaggcagcccucccggccgucgucuuuuugcacgggcucuucggcagcaaaacuaacuucaacuccaucgccaagaucuuggcccagcagacaggccguagggugagcuuucgagugggcggggcuccuuuggggcugggcgggagugggcggggccugagaggaggcggggcagggggggucccgcuucucacgcucacuuccagaucccucacucugaguauggacccugaacggcaaccccauuuauucccucacguugccaucuucauuaauucauguuguagaucuccaucggggcuggcccaugccuaggcgccugcacccuuuccaugaaggggccugcuuguucacuagggaugaccgggagcucaccaccucuuauggcagcccauucuucugugcuccuacuguuggaaauuccuggagucuccuuccuggcauucuccgagauugccacccagccaggccagcccuucagagacguggucacaacccuggggccugcucuucucuggcagaguggccccagguucuucaucugggccuccuaggucuggaaacugggcccuuccccuccacaggguguauccccaggcucuccacaccuuugaccugcugucccuacaagccuuuggcugucuacccccagaauggggauaucaacgcagccccgucucaccccacuccccaggugcugacgguggaugcucguaaccacggugacagcccccacagcccagacaugagcuacgagaucaugagccaggaccugcaggaccuucugccccagcugggccuggugcccugcgucgucguuggccacagcaugggaggaaagacagccaugcugcuggcacuacagagggugagccgcccaugucuggggccuccucccauucaguauauacccugagggcccugcaggcaaccugggacucacaugaucguuggaugaccaaguucaggcuccaggagccaugccugagacucccuaugucugccuaagacuggucccaguucgguucucucccacagccagagcugguggaacgucucauugcuguagauaucagcccaguggaaagcacaggugucucccacuuugcaaccuauguggcagccaugagggccaucaacaucgcagaugagcugccccgcucccgugcccgaaaacuggcggaugaacagcucaguucugucauccaggugauacacccaaggugccccggaugguauuguagaccaggaccugucaagggaagaguggcacccccagaccgcacaaggaaccucccccaacugcugcacccccacaggacauggccgugcggcagcaccugcucacuaaccugguagagguagacgggcgcuucguguggagggugaacuuggaugcccugacccagcaccuagacaagaucuuggcuuucccacagaggcaggaguccuaccucgggccaacacucuuucuccuugguggaaacucccaguucgugcaguaagcuagccuggguaguaggaggggcaugcuuuacucgcccaggccccagccuggggacccuaccaggggaggccuuggguguggaagggggguggcugagaggccagaaauaccaccgggcauaugggcucacacagcucucuccauuucuccccguucugcuuccacgugucucuuucacuccuccucaucccacuuucacccguuuuugauggccgucgcugcgaugcacagucccagccaccacccugagauuaugcggcucuucccucgggcccagaugcagacggugccgaacgcuggccacuggauccacgcugaccgcccacaggacuucauagcugccauccgaggcuuccuggucuaagaguugcuggcaagaagauggccgggcgugguggcucaugccuguaauuccagcacuuugggaggcuaaggcgggaggaugacuugaggccaggaguuggagaccagccuggccaacauggugaaacccugucucuacuaaaaauacaaaaauuagccuggcgugguggugcacaccuguaaucccagcuacucuggaggcugaggcaggagaaucacuugaacccuggaggcagagguugcaaugagccgagaucacaccacuacacuccagccuaggcaacagagcaagacucugucucaaaaaaaacaaaacaaaaaggaggcacaaaaccccaggcuucaagucucugcagccugcuccacauuugggcacagaaggacucagacaggcacugugugggcacgagguuuuacagggguggucagaccucaggcuuuaaugaauaaagacacuacucccaaaguccugggcugaggucugugucaccaccaacguccccgacccagggagaaucuggaucggggggugcuggcagcuccaggguccacgugggcuccccgaguacccuuggccucucucugcagcugauucuggaccugcugccacaccagcugcugcacguccuccuguggacaggagagcagguucaaggcugagccugugcccucuuuccccacaccucccaggcccugauggcauuccccuaccucccaggccuccagcucccgccucagccucaguuucuccuccaggaccuccagcagcugggccuccauggcguguagccuggcuuugcaucucugcagcuccgccuccaccgccugcuuccugugggug

SEQ ID NO: 14479 - RNA, 3381 nt, Homo sapiens
cacccacaggaagcaggcgguggaggcggagcugcagagaugcaaagccaggcuacacgccauggaggcccagcugcuggagguccuggaggagaaacugaggcugaggcgggagcuggaggccugggagguaggggaaugccaucagggccugggagguguggggaaagagggcacaggcucagccuugaaccugcucuccuguccacaggaggacgugcagcagcugguguggcagcagguccagaaucagcugcagagagaggccaaggguacucggggagcccacguggacccuggagcugccagcaccccccgauccagauucucccugggucggggacguugguggugacacagaccucagcccaggacuuugggaguagugucuuuauucauuaaagccugaggucugaccaccccuguaaaaccucgugcccacacagugccugucugaguccuucugugcccaaauguggagcaggcugcagagacuugaagccugggguuuugugccuccuuuuuguuuuguuuuuuuugagacagagucuugcucuguugccuaggcuggaguguaguggugugaucucggcucauugcaaccucugccuccaggguucaagugauucuccugccucagccuccagaguagcugggauuacaggugugcaccaccacgccaggcuaauuuuuguauuuuuaguagagacaggguuucaccauguuggccaggcuggucuccaacuccuggccucaagucauccucccgccuuagccucccaaagugcuggaauuacaggcaugagccaccacgcccggccaucuucuugccagcaacucuuagaccaggaagccucggauggcagcuaugaaguccugugggcggucagcguggauccaguggccagcguucggcaccgucugcaucugggcccgagggaagagccgcauaaucucagggugguggcugggacugugcaucgcagcgacggccaucaaaaacgggugaaagugggaugaggaggagugaaagagacacguggaagcagaacggggagaaauggagagagcugugugagcccauaugcccggugguauuucuggccucucagccaccccccuuccacacccaaggccuccccugguaggguccccaggcuggggccugggcgaguaaagcaugccccuccuacuacccaggcuagcuuacugcacgaacugggaguuuccaccaaggagaaagaguguuggcccgagguaggacuccugccucugugggaaagccaagaucuugucuaggugcugggucagggcauccaaguucacccuccacacgaagcgcccgucuaccucuaccagguuagugagcaggugcugccgcacggccauguccugugggggugcagcaguugggggagguuccuugugcggucugggggugccacucuucccuugacagguccuggucuacaauaccauccggggcaccuuggguguaucaccuggaugacagaacugagcuguucauccgccaguuuucgggcacgggagcggggcagcucaucugcgauguugauggcccucauggcugccacauagguugcaaagugggagacaccugugcuuuccacugggcugauaucuacagcaaugagacguuccaccagcucuggcugugggagagaaccgaacugggaccagucuuaggcagacauagggagucucaggcauggcuccuggagccugaacuuggucauccaacgaucaugugagucccagguugccugcagggcccucaggguauauacugaaugggaggaggccccagacaugggcggcucacccucuguagugccagcagcauggcugucuuuccucccaugcuguggccaacgacgacgcagggcaccaggcccagcuggggcagaagguccugcagguccuggcucaugaucucguagcucaugucugggcugugggggcugucaccgugguuacgagcauccaccgucagcaccuggggaguggggugagacggggcugcguugauauccccauucuggggguagacagccaaaggcuuguagggacagcaggucaaagguguggagagccuggggauacacccuguggaggggaagggcccaguuuccagaccuaggaggcccagaugaagaaccuggggccacucugccagagaagagcaggccccaggguugugaccacgucucugaagggcuggccuggcuggguggcaaucucggagaaugccaggaaggagacuccaggaauuuccaacaguaggagcacagaagaaugggcugccauaagagguggugagcucccggucaucccuagugaacaagcaggccccuucauggaaagggugcaggcgccuaggcaugggccagccccgauggagaucuacaacaugaauuaaugaagauggcaacgugagggaauaaaugggguugccguucaggguccauacucagagugagggaucuggaagugagcgugagaagcgggacccccccugccccgccuccucucaggccccgcccacucccgcccagccccaaaggagccccgcccacucgaaagcucacccuacggccugucugcugggccaagaucuuggcgauggaguugaaguuaguuuugcugccgaagagcccgugcaaaaagacgacggccgggagggcugccuccccguccagaagccuguaggaaagcggaagcggccuggcaggggaaggaucgaggucagagucugagccggcggagacggggaaagggguagggggaaagagcuuugggggagaggccugggaggugacaggcccaaagggaggagauggggccgucggggcccggcaggaaaaggaggacagaggauggccucccgcccggugcccuugacugaccucggcucggcgcccccucggccgccgcugcugcugcugggugcgacaggcacccucgcgaagcuagggccgugggggccgagucccucacgcgggagccuccaggcucggguccagcggagcaugcuugcaagcuguuggccggcucgcaucucacaagguacguccuccccgcgcuccuucucccgcccuagcucgcagccccgcccauuuccgucuucagccgccccgcccaguuccgacuugagccccgcccucuccccgcccccaucgcgggauucuccgcccuuggucccguuuccuuacguauccccgagaacaguccggccccgccuccauccccgccccuuacgccauuacguaauccccgcaggcuuugcgcgggucgcccugagcgccgcaccuggccucgcccuaggcugggcaacccgcggugcuugccccuccccucgcg

SEQ ID NO: 14480 - RNA, 1227 nt, Homo sapiens
uuacagggguggucagaccucaggcuuuaaugaauaaagacacuacucccaaaguccugggcugaggucugugucaccaccaacguccccgacccagggagaaucuggaucggggggugcuggcagcuccaggguccacgugggcuccccgaguacccuuggccucucucugcagcugauucuggaccugcugccacaccagcugcugcacguccuccuguggacaggagagcagguucaaggcugagccugugcccucuuuccccacaccucccaggcccugauggcauuccccuaccucccaggccuccagcucccgccucagccucaguuucuccuccaggaccuccagcagcugggccuccauggcguguagccuggcuuugcaucucugcagcuccgccuccaccgccugcuuccuguggguggcagagagaguagcugaggcucggacccugugggucugguugugagguccuggggguggacgaguauggccacagcccccgccucagugaagggcagcugguuguguggcuuuccuuccagaaugccugacuagccccccgcuccuccauuagcaggacaaggcccugcaggggagcccccaacuccccucccagcccccaaaagcagcuuccccuuacuuggcaauggcuucaucccguuccuggaggacuugguccagggaggguucuguccgggugucccccagugcuccagccgccugguacucugggcugugucgcagggugacagaggaggaggcagcgaccaagucuugucuggaagaggugucucacucugggcccucccgccuuggccucggcuuugauguugcugucagguggagaggcggcugaggugcucuguaccugccccugcugcugccccagucucauggaccuauggaaaggaagaggagguggaugguguggccacugccuggccucaaugcaagcagcgugggcaggguauuuggaccuccagggagcaaagaauucucacccagucaucagggaaggacgaggcagcuguguucagaagaacacuuacccucaagggcugggacuuaggguggccuggugacugggacucuuggcagcuggguggagcaagcgaaagacauggcccuuugcccucccuucccagcaaggcacucccuggcaggccccaccccugccaggccaaggaggaaggccugcugcauccuagaaacuuccggcc

SEQ ID NO: 14481 - RNA, 1227 nt, Homo sapiens
ggccggaaguuucuaggaugcagcaggccuuccuccuuggccuggcagggguggggccugccagggagugccuugcugggaagggagggcaaagggccaugucuuucgcuugcuccacccagcugccaagagucccagucaccaggccacccuaagucccagcccuugaggguaaguguucuucugaacacagcugccucguccuucccugaugacugggugagaauucuuugcucccuggagguccaaauacccugcccacgcugcuugcauugaggccaggcaguggccacaccauccaccuccucuuccuuuccauagguccaugagacuggggcagcagcaggggcagguacagagcaccucagccgccucuccaccugacagcaacaucaaagccgaggccaaggcgggagggcccagagugagacaccucuuccagacaagacuuggucgcugccuccuccucugucacccugcgacacagcccagaguaccaggcggcuggagcacugggggacacccggacagaacccucccuggaccaaguccuccaggaacgggaugaagccauugccaaguaaggggaagcugcuuuugggggcugggaggggaguugggggcuccccugcagggccuuguccugcuaauggaggagcggggggcuagucaggcauucuggaaggaaagccacacaaccagcugcccuucacugaggcgggggcuguggccauacucguccacccccaggaccucacaaccagacccacaggguccgagccucagcuacucucucugccacccacaggaagcaggcgguggaggcggagcugcagagaugcaaagccaggcuacacgccauggaggcccagcugcuggagguccuggaggagaaacugaggcugaggcgggagcuggaggccugggagguaggggaaugccaucagggccugggagguguggggaaagagggcacaggcucagccuugaaccugcucuccuguccacaggaggacgugcagcagcugguguggcagcagguccagaaucagcugcagagagaggccaaggguacucggggagcccacguggacccuggagcugccagcaccccccgauccagauucucccugggucggggacguugguggugacacagaccucagcccaggacuuugggaguagugucuuuauucauuaaagccugaggucugaccaccccuguaa

SEQ ID NO: 14482 - RNA, 4226 nt, Homo sapiens
cggagccggggcggagcgggccgagcgggccgagccagcagccgagcugggggcgcgggcgggcggcauguaccgggcccgggcggcgcgggcggggccggagcccggcagcccggggcgcuuugggauccucagcaccgggcagcuccgggaccugcuucaggaugagcccaagcuggaccggaucgugcggcucagcaggaagguagcgcggggggcucgagcggggggcgcgggggacgggcagcggccugcgggaccugccgcucgagggaagggccgcgcgggccgggccgcggggccgcccgugggcgcggagccuggcacguacgagugggccccgcggagccacccccgggggagggggcgcuuggagcuggccuggggcggguggggcgccggggacccgaggggggcgccugugcacccccaggauggccgcgaggcguguccuacagcggaugcuccggggagguguguuccggggggcuguguuguggggggcccuggcucgcacacccacguucuguaagggccagaaagaggaggcgccuuccacugggagaacuaggggccugucugacaccuggaggggccguuggggguucacgcauucugggggcgcaagagggggcuuugugccuggcguuggggaggggugcuggaagcugccguguguauugcauaggccaccguaagagaaaguuguauauuucacgggagauaggcccgggcugguugucuguggggggcagaaagggcaaguguguguugaaagcaggcaggcgaggaggggcuugugcaucccacaagggacagauggaggggagugcguucuccaggggcagggaggggagguugggcccugcuagagacaaggaaaaagccuucuccagggccggggcugcuguaagcccggagcagggaggaaaaggggguguguauuccuuggggugugaggauuccacuggaggcagaggaaggggugggaagggaagagagggugacccgagggggugcugugaggggacggggugcagacaccccucuggagaggaugagcagggggugggaguguuuucggugcaaacaccugaggaggaaacagacaaaggccuggagugagagggaagcuguccaugcauggaaaauggggcagaggagggaggggcacuccuccgggaccugagcagacauauuaauugaaaaauuaaaaauuaacuaacauuuguagaggccuuuauaguuuuccucacuuaagucucucaacaaccccauaagguggauguuuuuuaacucgauuuguaaaagaggaaacugaggccagagagggagcucagggcagagccaguucuggucccggccugucaucgucccuucaccuguuggguucaccacccugaaggggugccugacaggugccuuuggccuggcccucaggcacggucgcccaguaggguggacggggcaguaggguggacagggcagauccccugagcgggccucuuagcuccucucugcccgcaguuccagggccugcagcuggagcgugaggccugccuggccuccaacuacgcgcuggccaaggagaaccuggcccugcggccccgccuggagaugggccgggcugcccuggccaucaaauaccaggagcuucgugagguggccgagaacugcgcggacaagcugcagcgacugggugagggcacgucugggagaacccccuggggcuggugggggcaguuggccauccgguggguuggccuugggaagugccaggcucugauggaugggaguugggcggaccugcuccuggcuugcugggcaguagaguugaggaagugagaggaaguggggaggguugggugggagaaaggggacccaauacgcagggucccccugagaugcugagggggacaaagccuccccugucucuuuuguacuaggacgaggagcagaaacuugguaggggccggauccacaaagcggucacaugggcacgguacagaugaggaaacugaggcucuagaccaggggaaagggaaauauagaaucacauggggucagcgggagagugcaagcccggggcccuggccugucugucacucugucccucuguggcccucagaggaaagcaugcaucgcuggaguccccacugcgcgcugggcuggcugcaggcugagcuagaagaggcggagcaggaggcagaggugaggggagggguggcuggggcugggggccaggagggagacccauucucugccacccccuggcucauucuuacaccucaggcuggggagccccuccucugggaaguccacccugaaugccuggcgcaugccagagccuagcauugcuguccaccagcacuggacagccagcagggcucacuuuccuaccugugaauuuuuuucgggcuccccugugacugggcuagggcagcguggaucuggggcuacagaggagcuggggcagacuuugugcuggguugggagugcagcgaucagugagcugaagguggugggcucccgaaggacauguuaagucuauacuucacauaugucccugccucugcuccugccucaucucugauccagcaggucuggugauggcauccuuauuuuagaaguuagggcugggcacaguggcucacgccuguaaucccagcacuuugggagaccgaggcgggcggaucgccugaggucaggaguucgagaccagccugaccaacauggugaaaccccgucucuacaaaauacaaaaaaaaauuagccgggcgugguggugcaugucugucaucucagcuacuugggaggcugaggcaggagaauugcuugaacccgggagguggagguugcagugagccgagauugcgccacugcacuccagccuggaccacagugagacucugucucaggaaaaaaaaaaaaaagugggaggacauuuguccacaguucacuuagcaaguaaucggaggcaggcccaggcuggaacgcagguccccugucccccagcugaggggugaucaccauggggagggccucagggugggaaggagugaggaccaguccccagucuguggucgugccucucccaagccuucccuucccucccggcccaggagcagauggagcagcugcugcucggggagcaaagccuggaggccuuccugccugccuuccagcguggccgcgcccuggcccaccugaggcggacgcaggcagagaagcugcaggagcugcugcggcgucgggagcguucugcccagccggcccccaccucggcugcugauccccccaaauccuucccggcugcagcuguccugcccacuggggccgcccgggggccaccagcagugccccggagccugccccccuuggacucccgcccagugcccccacugaagggcucccccgggugcccccucggcccggccccccugcugagcccucggcccucgcagccagagcccccccaccgguaggauccacggugcggccccccaguuggggggccuagacaaacuugaugcguggcuccuccuccucccccacugccuggguggggggaggggcaggccccucccccuggccucaggcaggcccuggcccuggaggcugagcuggggaggaggguccccuggaagaggcccgagagggggcugggggugggugggcagggcuuuaugccucuggcgcugaagacacccugccuuuuuuguuuccgugccccggggccucuagggugauggaccagccccguuaaagaacuugacucaacuacaggggccugggaagaugccuggguccccuaggggccuugccaaggggaccugucgcaccccaccacuccacugggcucgcacaacgccaaggccgccaggaguguuuuacaucauguccugagccuaccuuucccccaaauucuggggcccacagccuaggagccaggugaucaggccucggcuguggggccagggacaccauggcccuggggcuacuacguguccacacaugcuccagacccuggggcaagguaggccaggggcuucugaccugugcaggugagagugggccauacccaggaaagaccauucuguauuuuucugucccugucuccuuagaauggaagcuuuuugagggcagguccuugucuuuguacguucuguccccagccccgccucuuaggggccgucaauaaaugugaugaugaggaugacgaugcu

SEQ ID NO: 14483 - RNA, 1711 nt, Homo sapiens
cagugacaggugguugcuuugaacuuuauuugagaaaaacagaagauaaauguaucaaaagaacacacagguggcgggggaggcacagccaguggcggcagcaggggugggcauccgggcuaaggcuuuacuuggcggcagucucaucggauuuugcagcuucugggcccccaagcugggcccgcgacucgaaggugacugggauggugaucucguuggacugcguggcuagcuugggcaugggggccuccacggucagugugcccucaggggacagggaggaggaaacuugggugggguccacaccggggggcagccuggacgugcagagaggaaaggcaagcguuacauuacacaccgggugggucccugugcccucuucccugaccccacccccacgccacccacccaccccgaccuggcgccaggacucacguguauuuccgcgugaagcaccgggagauguagccaugcucguccugccgcuccucgugcuugccuuuggggggaagagggaaaucagacugcgggggaggggacugccuuucggccccgcuaggccagaggccccaccuccugcuuggaagcagccaggacugcaggcugguagggauuaacagaggggguuggggaugggggcgugcccgccggucugggcucucagaaacuuccggaaaguucuucgauucagaguuuugggaggaacggagcagggcgcggagcuggggagugagcaguacgcaggcgcacuuggagccgcgcacacgcccacucagcggcuagaaacuggcaccgcgccagggaacuccccgcuuaucuggggauggggcugugggugggaaggggacucuguagaaaagcgcauuuucucucuucaucgaugaucuuuaaaaaaauuuuuguuugcuuuuuuuuuguaauggcgcggggucggggcgggggggcgcgucucgcuauguugcccaggcuagucuugaacuccuggccucaagcgauccucccgucucggccucccaaagcgcugggauuacagagcagaaagcgcccuuagaagcgacccgcacucccaauuccugagcaagggaaucaggaguccuguuuuucccggugcugggccaacguuuaacuccccaggcccccgggacccccguuucaaccgcacgcccccggcccugcccgcccugcuagccuccuccucuccccugcaggagcaggggggcucaccggugaucuccaccacgccauccuuggucuugaccgucagcucguccggggcgaagugguugacauccagggacacgcgccagcgguccgcagugugccggaucuccgagaccccgcugcugaguugccggcugagcgcgcggcuguaggcgggcgcggccacugcggggcucucgauggcggcggggggcagggggcgcacguagccuggccagcugcugccgccuaaccacugcgaccacuccuccggcagccggggcagcccgaaggccuggucgaagaggcggcuaugcggguaccagucgcggaaggggucccagcuggggccccgcaggagcgagaaggggacgcggcgcucggucaugcuggcugacucugcucuggacgucugcucagaaaagugcggggcgcugggcucggcugcgcuuuuaugcuccuccagucggguauuuuuagcaggcgguguuugaggucucuauuaauggca

SEQ ID NO: 14484 - RNA, 1499 nt, Homo sapiens
accugcgggagcgccacgcggacgcccgcaccagccgcacccugcuccuguuggccaaggugcgggccuugcggccacgggcgggaugcacagcuggguguccuaccggggcccuggccuggacugcagaguguucccuaccggcuccggcgaggccacuggcacgcccacguaggcacugcacuucacaguuugcaaagccuuccuguggccaccuuguccgagcuccaucucauggauaagggaacaggccugcgaggggucggggguugccaaggccgcccauccugucgguggugaaucgcgggaccuuccaacccgggucugcuuacucucaggcugcaccuaugugcccggcaccggggugggguauccggugcagcagcgucaguuaaaccuacagaggaaggcccaaguggucucaguuaucauaaggcaucaaacuucaugauccucuccucccugaucccuaguggggcuggagggggcccgugggcauggccucugucgccucugccuccaucgcuacagcugaguagcaaagacuuggggagggggggugggagggggugcaguggcuaggccccuaaccuagcagaaccugguccuuccugcugucaccuccaggcaguccagaacgugggcaacauggacacgccggcuuccagggccaaggaggcuuggauggagccgcugcagcccaccgugcaccagggcguggcgcagcugaaggacuucaucaccaagcucguggacaucgaggagaaggacggugagcgccgcccugcacagacccgcccacagccuacugcugacguuugcuccgcccuugagccccacggccccacccaucgcuguuuguuccucucguggccccacccaccgccugcuguuggcauuugccaggccccuaggccauagacccacgcaccacuguuugugcuuccugugacccugcccacugccugccguugacguuugccccagcccuagacccauggccucacccccccaucaucugcgccuguugacauuugcuccauccuugagcuccauagccccgccgccaccugcuacugacgcgugucccgccuccaagcccauggcccugccuuccucaguccaccugucaccccgcucaccaccagcuguugauguuugcuccgcccuugagccccaugacuacguccacugccugcuguucagauuugcucagcccuugagccccauggccccucccacugcuccgcuccccccagucccgcccucauucacugggcucucuauuccccucccucccuggccuggcagagcuggaccugcagcggacgcugaguuugcaggcgccaccugugaaggaggggccacucuucauccacaggaccaagggcaagggcccccucauguccuccuccuucaagaagcucuacuucucccucacuaccgaggcccucagcuucgcgaagacgcccagcuccaagguggguaaggagggaggc

SEQ ID NO: 14485 - RNA, 12061 nt, Homo sapiens
gaccaauggacucaagacuuacaaacuguccuuuauucagagugagacugcggaacauuaauaauuuaucacgcggggaguccccagaagcccugugcccacgaaccccugugggcggaggagagaggcggggacuccgggagcuuccugagagggccgugucuugggagcaaggugacauauucaguucaggcacgcggaacaugaacucaggaaguggggagacagagagacccaucccccaacucccaggacgggggccaggcccccuaaaaaggcacaauggcagggcagguuuggcagagugguugagugucaggggucgacaaaggacaccaugauguagcgugugccccaggucguuggcagccccucgugguagugggugaggcggccggggugcaggagugcccagcccuuccucggggaggagaucacacagucguagcgcaggaagcggcagccaccucccuggaaagagaagggaaaggaaacauggagugagcagacguggggccuggggagcaggcagauacacggggcagggcggccagaccggggggcacggugcagcagaccggggugacaagggagauggcagauauggcagacaccggaggcuggggugccugcagacaggaagauccaggaggaagcagaggccgccugcccagaagcgauccaggagcugauacccacaaagucacugggaaaugggcagggaggggagcugggggaugcacgcaggggcucuagguggggacccgaggguccugaggugaagcguggguggguagugugacuggggcgcaccucauaguccaggcccuugugguugagggcaacguugagggugaagguggaugagucgugguguggccgcagagacggcugcucgucuggccgguagcgaaccacaaaguucaucaccgcccgcgccugggggagaggagggaagaggcugcagggacagcugcgggcgcagggggucuuuuauuuuguauuauuauuauucuuuugagauagucucgcucugucacucaggcuggagugcaguggugcgaucuuggcucgaucuuggcucacugcaaccucugccucccgguuucaagcaauucucaugccucagccucccgaguagcugggauuauaggcaccugccaccacacccggcuaauuuuuguauuuuuaguagagacgagguuucaccaucuuggccaggcuggucuugaacuccugaccucaggugauccacccaccucagccucgcaaagugcugggauuacaugugugagccaccacgcccggccaucgcagggugucuucagggagaugacggucccuguccagggaggggaggggaggggcggcgggaccccugcguaggaggcucucgcugcucacuggcauuaaauuagggccaagccucaccuugggucucagccuggcgcccucccuccccuggggugccuccugcagcgucucauuccccugggaacuaaaaugcauggagcccaaaugcugccggggccgaaaggggucugcguggagacuuccuguccgggacugggguggggaagguggggaggcagcuggcaggugggcagcgcaccuuggugugguaaccgggaaacaggcucucggucauggggcccacauacguccgcagcagcugcagccacugguccucguaccccaccugcuucauguggauguccacggugggcacauucucguagccuccagccagccuugaauccugggggcggcgggcacugagccacccgccccuccagccauggcgcuccccaccccagggcaguccagccuccuuccucccguccuccagccuucacaccuguguuccucugugcagaacagucuucuuugcuacuucucggccugacucacugcucccggcccuucaagucucagcuaagaugucaccuguccugugaagcucccuacuccucccaagucugggucaaggcuuccccguggcuucuauugcacccaggcugcucaucgcagccuuagaagcugugugguggcugcugcucacagcagggcagagcucgaccggcaugaggcauuccugcagugcagucuaggacaguggcccaggaaugauuuccuuuucucuuuuuuuagagacagagucuugcucugucacccaggcuggaguacugcggcaugaucauagcucacugcagccucuaacucuggggcucaagugauccuucugccucagccuccugaauagcugggacaugccaccaugcccggcuaauuuguugguuuuucugagauggaguuucacucuuguugcccagccuggaguucaaucuuggcucacugcaaccucugccucccggguucaagcaauucuaccucagcucccgaguagcugggacuacaggcgcccgccaccaugcccggcuaauuuuguguuuuuaguagagaugggguuucuccauguuggucaggcuggucucgaacuccugaccccaggugauccaccugccucggccucccaaagugcugggauuacaggcgugagccaccgcaccuggcccaaacucggcuaauuuuuaaauuuuuuguagagacagggucucgcuauguugcccaggcuggccucaaacucccccugcucgagcaauccucccgccucagccucccaaagugcuaggauuacaggcaugagccacugugcccagcaguaaauauuucuugaauacaugaaugaaugcaguugugaccccagggucugccuccccccugggaaccccucuuugcucccauuuuccugauuccauuguuuguuuaccagauccugcaccuccuccucugggaaggccucugcccuccucgcccaggcccuuaccucaugccggccgccugaccacuggccguagugcuccaucucugccaccagcucaucacacauuuguucugacagcagugggaaccaguacacguccgggcauggcugaggauggggcgagggagaacagggcuagcugacgccgcagaacggggaaggggacaggcagcaggcagaaugggaaggggcagggaggagcagggaaggcuuugugagagcagccggggacccgccagguaggggcugagggaguggcaaggcugaggaccgguuucuggcacaggagagguggcagaggguccuggagccccucgugcugggacagugguuuccaaacuuccguaacagugcauaccucuuuuuuuuuuuuuugagauaggguauugcucugucaaccaggcuggagugcaguggcacaaucauagcucacuacagccucgaccuucugggcucaagcgauccucccgccucagacucccaaguagcuggaacuacaggcacaugccaccaugccaagcuaauuuuuucuuuucuuuuuuuuuugagacagggucucgcugugucacccaagguggagugcaguggcgugaucuuggcucacugcaaccucugccucccagguucaagcgauucucccaccucagccucccgaguagcugggacuacaggugcacgccaucacaccugacuaauuuuuguguuuuuuuuuuuuuuuuuuuugguagagacaggauuugccauguuggccaggcuggucucgaacuccugaccucaggugaucugccugccucggccucucaauguacugggauuacaagcaugagcaccacuccuggccucauuucuuauuuaauuuuuuuguuguuguuguagagacagauucucgcuauguugcccaggcuggucuuggacuucuggccucaaccgauccacccaccuuggccucccaaagugcugggauuacaggcaugagccacugagcccagccccauucuucuuuuaagaugugauuucaagcauaacaccaguauacccaauauacaggagaagaggcugucugaucaaugcuggcuuugggggcaagaguccuuucuguucggccucugccuucaucuugucugaacagaaaacccucagaucucuggggaacucagugugaaaacuuugaauccaggcgggggcccccaagaggcgauggccaugagggcaggggguggguggggaggcugcgugggcucaccugcuccacgauuccuuccccuuccagggcccggcuguaguucucguggauguacugcuccuuccaguccugugagaggguggggggcacaucagaucugugccccccucgcucccagcccccaggggaccgcccccucccacucaguguccugcgcuggcagcagccaucacguuuggugucuuccuuagcacaaggcggggaaccugugugcucugggcgugggguccccacucacgacgggguugucgaagaucugccagaggucggggugcaggugcuccgugucguaucuggaaguggccaggagccggccaaauucaugcugauugcucagauggaggaagaugcccuguagugggguggggguguccgugaugcaggcgaugccuggagucugggggacugcccccaggccagaccgugcacccgcgcucaccuugucucgaaagcucuuacagaaggccauguccgggucugugucacugcccgagaacacaucccucuggggcagcuccauccgcaggguaucaccccggaucacauaggccugggagauguaugguacauuccacacaccccuggaggcaccgacaccgcggucagcugggaggacagccccccaaauucugcccagcucaucccgggaaguccuucuucccucaggguaucccagucccugaacauaaggccccugcaugucccuugucaagcacugcuggucccaaccaccccaccucccaaaaugcggucaguuccuaccccaagcuguggcacuucuuuuuuguuucuuguuuuugguuuuugagacggagucuugcucugucacccaggcuggaaugcaguggugugaucuuggcucacugcaaccuccaccucccagguucaagcaauucucccaccuuagccucccaaauagcugggauuagaggugccagccaccaugcccggcugauuuuuguauuuuugguagagaugggguuucaccauguuggccaggcuggucucgaacuccugaccucgaguaauccaccugccucugccuuccaaagugcugggauuacaggcgucagccaccgcggccggcccuuguuuuuuauuuucuugagaaagggucucccucuguuuccaggcuggagugcagugguggaaacauggcucacugcagccucaaccucccaaguucaagugauucucccaccucagccuccguaguagcugggaccacaggcacgcaccaccgugcccagcuaauauuuuaaguuuuuuguagagauaggcucuugcuacguugcucaggcugaucuuaaacucccaggcucaagcaguccuccuaccucagccucccaaagugguggcaucaaaagugugagccacugcagccagccucauggcaccucugacuggugaccacuccaaaccccugagaguagggggcuugggucuaccugggccccgggucggaggaggcggggggcugcaggcuggcgggacucacacucgcuuccgcugcaccagcuccacguaguccucggagcgggcguaguacucaucggggcucagggcgccccagaaguuggaccacagcuugccguggcgggacagcaugggggcgaucaccuuccugcggacaggugggggugagggcugggcagacgggagcaggccuggggagcccggugcccagggcaggagugggguucccggggccuguuggggugcccuccggcugcggggagaggggguaagccaccuguucuccucaaugaggauacgcagggucugcagguuggugaggacagcgucggcguccaggcugaaguagaacucacacucgggguccugccgacacaggucccuggaggugagaggcgagcugagacggcggcagguggggaggcgguguggaugggguaacuggcccaugcccccaggagaagaggagggaggcagugucuauccuuccuuccccaggcucucugcugucugggugagcuggcaagggcaggagugacagcaugggggcugcaaggaugcgaauggggaggcccaggaggggcuggaugggugacaggugaggcaagggccaggcagcagguggcagcaccccugacccuacagccucaucccacccucuccuccccgcaagcacccgcucacauggccaugucccuggccucgccugggcucagagccuccuccggccccacgagcuucacagcugagaagugguccuggagcugcggccaggagucagcgaugugggguucauggaagaccuccugggaggggaagacauagggggaugggcucagagggcagggaggcggcaccugagggaugggggugcaggaaggagaugggggugggggcacgagaguucugaucagggcagggaaagggucccucaggagaggcuccaacaggggagucucacguuguugugcaggaaaagggugacccugucggggggauaguccaggaguagcagccgcugcaggaagcggggcagaaacggaguaggcuguuccacaaacacggccagaaacacccgggggggaggcuggaagaugcaacacgcagggacucagagagaagcccggacuucccugcugcccccacccaaccuccacccugacaggugcagggacccaggagcgaugcccccaccgccccccaguccgcuguccuuguaccuccugcucagcacgcugcccucucgugccccucccuggcacccccaccucaccugcccccccgggaguguccuccgguccugguugcagaagccacagccucccucaggaguccagccauuggggacguaguuucccagguaguugagcugcagcuguuggggacagacugaggcugaguggcugaggccuccagggguggaggugggggucaggcaccucugauaugggggcugggaagggccagcuucucagaaggguuggaggugccuggggguuggggcagggcggggcggggguugagaccacugguggcaccuuagugggaccguuuccauggaccacaauggggagcgugucguaggccacguuccggauacgcacacgguuccgaucaaacuuuaaaaccacuucaucuggggaagaaaaaggccaggcuucagacccccuuucucugggagcuaccaagcaacacauucuucuaaauauggggucccaaauucuccagggaauaaagggacaccagggcuauccuggaguguggcucguugugggcaggaaccuuuggguucugaccaggcugcuggcccagagagcuccacugccuacuaccugcgugaucacaccgcagcugggcgaggaaggggagggugagcugagcgggaggccaguaggagccucagcaucccuaccccuccucauauucucucucuccuuguuuuuuuuuuuuuuuauuuuuauuuuuugagauggagucucacucugucacccaggcuggagugcaauggcguggucucggcucacugcaaccucugccuccugaguucaaaagauucucuugccucagccuuucagguagcugagacuaugggcacaugccacuacaccuggcuaauuuuuguauuuguauuuuuuguuuuuuaugcugagauggagucucacucccaacacgcaggcuggagugcaguggcacgaucuuggcucauugcaacuuccaccuccaggguucaagcgauucuccuuccucagccucccggguagccaggauuacaggcgcgcaccaccaugcccggcuaauuuuuguguuuuuaguagagacaggguuucaccaugucgaccaggcuggccuugaacuccugaccucaggugauccaccugccucggccucccaaagugcuaggauuacaagcaugagccaccacacccagccuaauuuuuguauauuuaguagagacuggguuucacuaugucagccaggcuggucucaaacuucugacuucaugaucugcccgccucagccuuccaaagugcugggauuacagaugugagcugucgcaccuggccuuuuuuuuuuuugagaaggaaucucacucugucacccaggcaggagugcaguggcgcaaucucggcucacugcaagcucugccucccggguuccagugauucuccugccucagccuucugaauagcugggauuacaggcacccgccaccacgcccagcucauuuuuguacuuuuuuuuaguagagacggguuuucgccauguuggccaggcuggucucaaacuccugaccucaagugauccuccugccugggccucccaaaauguugggauuacaggcgugaggcaccgugccuggccucucucucuccccguucuccccauccccugaggcaagucaccaaccccuccacaagcuguuuuccucaucuguacaagaaggauaaccagggaccuucccuuuguuaaauggaaucacagaaguagaccgggcacaguggcucaugccuguaaucccagcacuuugggagguugaggcaggcggaucaccugagguugggaguucgagacuagccuggccaccauggugaaacccugucucuacuaaaaauacaaaaugagcugggcgugguggcgcaugccuguaaucccagcuacucgggaggcugaggcagaagaaucacuugaacccgggagguggaggcugcagugagccaagauuggaccacugcacuccggcccgggcaacagagcgaaacucugucucaaaaaaaaaagucccuggcccggugcccaggcacagcaugugugcaacagaugccagacacguuuuugcuucccuugcuucugguaguaccaucagcacagugcaacuuacacaaccagccacucagacgccugacaaaaccacauagaggugggcuuggaucagcccagcuccuccagaagccucucccagcucaagaccccuagcugcagaggcugcgcaucgcccaccugcggcugucuuccuccucaccuaaagccccguugagguucugaaagauccgagacuuaugauccagauuaaggcugaguuucuccuaaauggaaugagaugcgauggagugguuaaaauggaaggaguggaaaggacaucauuucucacuuuucucucucuuuuuuucuucucuugcuuuuguugcuuaggcuggagugcaauggcacgaucucagcucacugcaaccucugccucccgguuuaauugauucucuugcuucagccuuccaaguaacugggacuacaggagagugucaccacgccuggcuaauuuuuguauuuuuaguagagacgggguuucaccauguuggccaggcuggucucaaacucccaaucucaggugauccacccgccucagccucccaaagugcugggauuauaggcaugagccaccaugguuuuccuuuuuuugugagagacagagucucauucugucacccaggcuggaaugcaguggugcaaaacauccucaaacuccugggcucaagugauggucccaccucagccucccaaguagcugggauuacaggcguacaccaugaagccuggcuaauuuuuucuuucuuuuuuuuuguagagaugaggucucaacuauguuguccaggcuggucuuaaauuccuggacucaagcaauccuccugccuaagccucccaaaagucuuggaugacaggcgugagccaccacgcccaggcacacauuuuucucuuugcaacccccuuugcuccccaaaucccauucagccugaggccuccacucccacagagcugcgggaugcgcccacuccucugccuucccuacccucaguccuggguccagguagagccguguguagaacagcuggucgucgucaucauccuuguacuuccacuggcgcacgauuugguggauggugguggcaaaaccgaugaauccuggcggggagggggaguguugaccucgagacucccagggucccagggccugucccccaggcugucuccagcccucaggcgccuuuaacacucugugucccaccgcucuuggccccucugccuugggcacucugccacucaccaccagaauugaggaagcgcuuccccgugcccaccucaggguacugcuccgccagcccccacucgggccagcagaagcucucugcagagaagagcaggcggcugccacucuggacgaacuucuucagcagcucuguggggcugccggccagaaucacgucguagcugggugaggaaggggaggaugggcagggguccacugggaaccucagcauccuuaccccgcucccuauccccagccccguuaccuauccacaaacaugaugaucauauccucccggucagcguauuucuccauuuccuucuuuaaccaccggaccuucuguccuccaccaacuguucgagccacaucacccccucgccacuccucucccaggcccagggucuguggagaagauugccccgugccaggcaagggguggggaguuguggggggaacuccugaccaggcuuaccguggggaccugggcauccagacuucagcccaccccuccugcugggacccccucccaggggccuuucccucuccucacccgcacaguguaguugaagaacuccgcagagcgcaggaaacgcagguaccccucgguuucagcuguggccacagugaucaccagcagcuucucuguuaccagagggaaauggcacuugagauccaccgcccagcuccgggccucacgugcuuugcuguccucccucucacucgacuucccucccuuucuuccuucccauucuuaaacucuucucacccaggaacacucugaccccaaggagggcagggugggaguggugcccaggaauuccgagucccuuugcauagggaggcuggaaaccccaguucaggguagugaugggcgaggggcuuggcgcgacucagccucaagagcacgcugggcgggggacgggccagacaccuccucgagccuccgacccucuccgggccaggcuggcaggcacgccagccucugcccccucggccgugccgggccuccccgggaucucaccuggguugaccgggucucggccccggggccggucggaggcugaggccgcagggggcagcagcagcggcagcagcagcaggaaccgggguccaggccccgaggaggucaugguggggagcgggcccagacagcacccaggauccugggaucuccgcuacgcgccuggaucccagcuccggaggggagcucuggaaagggggcgcucgggcugcugugcggccgccgcggggagcagcuuggcuggggcuacgcccugaaaaaaaggcguauccggaggcuacagaaagcuccagaugccggcgccacagacaaggcgaggauugucccgggcgcacgggaggcgggggaggggcggcggcucgggccggcgggcgggagacagggacucugggcugagccagccgcuugacacauguggaagcugaaaccuggacaggggaagugaccccuggcggagggucgggcgggacgcgggggcggguccuggccgcagcccugcccagagagugcgggcggaagacggggagagcgagaggcuggcggcgacagggagggaggaagccuaggaguccgccgcgggacggaggccugggggaacugggaguucagcuuucugcagagggccacuaggaaccucggauugcccacggaagccagccacuuucuuugacaguccagcccaccuccucuucugcccggagaagcuccaggggcugccuuugugaucacagcaucuucacaaggaccaaaggaaaauaagauuucuuguaagaacaccgugaccacaucuuuaaaaugacccauuucguggcucccacaagauuuacaccuccacacugaggccggaagugguuuugcccc

SEQ ID NO: 14486 - RNA, 12159 nt, Homo sapiens
ugacauauucuucguauuuauuuauuuuauuauuuuuuugaaacauuuuuacauguuuauuuaucaaaagugaaaaagcauacaauucaacacaauuucaauagcauuugacaccaccccuguggauccuguacauggcugacgucaccguccagugcaaaaucaaaaaagaaagaaagaaaaaccccaaagaaagaggauuuuucaguggagaacauggugggcugauuaggcuucuauuagauuacauucauuucacaucugugugcaauucucccauaaauuggucuuuaaaauauauauauauauuuaaagauauuagaaauauauauuuaaguauauuuaaaauauauauauuuuuaaagagacgggggucuugguauguugcccaggcuggucuugaacuccugggcucaagcaauccucccgccuuggccucccaaagugcauuacauccaucuuugugcccuacccucuggcugguagguuuucagaaauauuaucuaagguaguugaauccgagcugccugucucucucacccaccccccccucacguguccacugcucacacacagcagccggaaaugacacauugaagugagucaccaaugcggcugugagucacccuguaauuggggaaaguucuguccugguaggucaugcagccccuugcauuucugcuccuaaaucuauugaacacauuggaaaccacucuguccucaucugagucucuguccccccacuccguccuuuugauccccugaaggaggaugaaauuguauggucaauuuccaucaaggggaaaaagaggggcgcggggggcgcgagggucucaggcggccacaagguggcagugugggcuccgucacgcuggauguccggaggggugugugccagucaaguggcuggacuuccugagauacggugacacagaccacaaagaaacacuaggagcgaguuuaaauaauauuauuuuccuuaguaguucucuuucucucuaacaagcacucaagggcaaggauaugauaaauauuuagguacaccccuccccaccaagagauuggggggugaagagcugggcacgcaucugacauuucuuccucuauuccuauaaaaauaaaaggaagcagaaaucugcuucaaugaguaaacaagucaccuacacuccaaaauaacccaugcacacuguuucuggggagggagauggccaggccaggagaguugggccacaugaugggggacauucacucugccaccugcagcaccccuguacuggggagggguggccagugccacaguggacucugagaugaaaggguguuucuuccacuggccuuuggccugucaccagccuccuccgcgguggcaggcaguacaagagugauggcaaugugacuggaacagaaauaguuucuaccaggcacacaaaagcuccuguaagccccguaguuccauccugcaaagggccucagugggaaccaggucugcagacccgagugggcagagagacggguggaagcaggugccccagauggucccgcaggcgucaccgucugguuuggagaccuuaagggaguugugcuucaaacuucucucccagggucucagguggagacuagggaguuugaccuaaagguccuccaaggagaggccaaggucuuggagacagaucugguuuaccaucuuuuaacaaaaggcaaaugucuucucuuccuucagaaagagucauuaacacuaaaauucuuuucuucggaguuucuucuuucccgaugcaucuccaguuuugucccagaugaaggcgucuuuccccagggucaggguuccaucacuuggcccaugaaaaggacuguuccugaggguggaagaaccauggggguugagaagcagaaggagugggacagcucaucaggcuggauguggguggaaggacugagaucuaggcagaugagugagcugucuggagucgcagcugccugagucacagagcggggacccggcacugucugugggugauagaagguagccuccucuugggacaggaagcaggguaggguuauggguucccugcccagagcccucucagggauagagggaugucugcaucugucgggacuaguuccugagagaaagaaugggugggaggauguggaacgugauggguuccaggcucaccugugggguugugccggaccacaaagaggaagggucuguccaugaugaucuccucgggggccaugcgggcugagacuaugacagcugcaagagaagggacaaugucuuagaacagagggaugcuggcacuggcaccacccccacccccgccguuuuucuuagagacagggucucccucugucgcccaggugggagugcaguggcaccuucauggcucacugcagccuugaacucaugggcucaagugauccucccaccucagucucccaaguaacuggggcuacaggugcaugccaccaugccuggcuaauuuuuuucuaauuuuuguagagacacagucucauuauauugcccaggcuggucucaaauuccugggcucaagcgauccuccugccucggccucccaaagugcugggauuacaggugugagccacuaagcccagcuggaaguuguuuguuuuccugaauaugaaccuuaaaaguuuagggacauccucugagaccugguuuccuccaggagcuugguagcaauggaucagcucuucccuuacacacauuuaucuaaauccuuuaagggcuuauugauaagcucuuucuuuucuuuucuucucuuucuuucucuuucuuucuuucuuucuuucuuucuuucuuucuuucuuucuuucuuucuuucuuucuuuucucucucucucucuuucuuucuuucuuuucuucagagucaugcucuauugcccaggcuggagugcagcagcgugaucucggcucacugcaaccucugccuccuggauucaagugauucuccugccucagccucccaaguagcugggacuacaggcacaugccaccacgccugccuaauuuuuguauuuuuaguagagauaggguuuugccauguugcccaggcuggucucgaauuccugaccucaagugauccaccugccuuggucccccaaagcgcugggauuacaggugggagccaccaugcccagccugauaagcauguuucuuaaguuuacuucccacugugggaacaacuuggguuuuucuuuaggaggccuuuucacagucagggaacuuaggagccaucaggcgaggaaacaggguuccauggucccaagcccguuuuccaggcugagaaacagguggggagugggugauggcugagcacagacagagcugcucugugccgagagggcugcgggguccuuuccgggucuggggaccaguuauccugaagggcgauggaggcgacacccguggagccucaccugagccagacucaccuguggaugaggaggccaccgugccacucucguucaccucgaucuucacuuucugcagcgccugcgcgacguggagaggcucuuggucugaaacagauguggauacaggauuagaucagcugccgcucucaaggagagguuccuuuuuccucuuaggggcccccgcaguccacuggggugagaaaaugcaaaggaaagucuucuuaccugaaagacucgugaagucagccugaaacugucugaacaugucggucauucccagguucucuaggggcuuccugaggucgacuucagucuccagggagaaccugcagauagcagcaagaggcugcucaagccgggguccccucuggcuggcagcucccaccuuuccccauccccuaccaggugucccccgaaucaaguggccagaauagggacggaggugaagguuggagagggaggccugguucguucguucuuucuuuccuuucuuuuucuuucuuucuuucuuucuuucuuucuuucuuucuuucuuucuuucuuucuuucuuucuuucucucucucucuuucuuucucucucucuucuuuccuuuccuuuccuuccuuccuuccuauuuuucuuuuuuuuuuuuugaaacagauucuugcucugucccccaggcuggagugcaguggcgugaucucggcucacugcagccuccaccucccagguucaugugauucucuggccucagccuccggaguagcugggaucauaggcgcucgcuaccacggcuggcuaauuuuuguauuuuuaauagagacaggguuucaccauguuggccaggcuggucucaaacuccugaccucaagugauccgcccgccuuggccuccccaaaugcugagauuacaggcaugagccaccacacccagccggccugguucuucuucuaaagcuguuuacaaaguccccccuuagagcugaaaauccuaauauucaugaacauucuucugcaaucuccccacccccucccaccuaugacuaauuacuuuccucaaauaagacaguaguuucagcauaauuuuauucagccuggcuggggugggggaagcuaagggcaaauucuccugcaaggauguuggaacaaaaaucuguucugcagauuguguuucugagagcuaacccugaagaggacucaagcagggggccuuugugcacucucugcuucucaccagggcacaacuaauuaccuccauuuuuaugagccagagagagaggagaaaaaaaaaaaagaggaagagagaggaugcaagugagagcacgcaccagcuaaccaacuaaauucuccucuuuccccaagccuggcauuauagcauccggaaauuugggaugagcguggugggaggcuucccuauaauucuggaguuccccagcuccagccuucuccuucugcagaaagauuucaaaaaaucucuuugcuuccuucugcagaaggauuucgaaaaaucugcuuucuuggaaccccagcuagaagcugcgcuuugagcugcuccguccuuggaagugauuucuuuuguuuggauguugacuugaaaggguuggggauggaagugcugauggggcgacccuaaguagauguggacugauugggcccccaccucccucauuucucugacucuccuuuugggggcuuuugcuggguauucuggggauagucaauguggggguguggucaggaagagcuguccccugcccuccagcagaaacagggggagggaugauugcaagacucauaaucaaacccaggccacaguuucccaucagccucccacacaugcauguccugcaagcaucacagaucugggaaauucaaccugggggcggugacuuuagggagccaggagagagggguugguaggucggggagauagcgggguggcuuacuugggcagaaccaggaggcggggcagccuggucauguugccuuuccaguggcugaugagcugggcacucagaauguuggugagggcagagagaggcaccucuuuuucauaaggggcagcaaugaacaugcugaggguguccccgugguagggcaguuccaggaugucguaguaauggccaucgggcguggugaacucagcugugaagacgacaagaugguucguuggaaauggcuccagcucucgcugauggcaacccagcacuggguuuucaccuaguucuccuggcuucuccacuauuucuggaagccaggcucucucucgcucuuggcuuuuggguauccccuguucacugcuccccuauucaguauuuuaauuucuauuucccuucucuucugccaauucaguaucuucuaauuucucucucucugugugugugcauguguguguguguguguguguguguaagagacagggucucacugucacacagacuggagcgcaguggugcaaucauagcucacugcagccuccgaauccgguucaaauguuccucccgccucagcuucuguauuuuguuuguuuguuuguuuguuuguuuugagaaggagucucacucugucgcccaggcuggagugcaauggcaugaucucggcucacugcaaccucccccucccggguucaauagauucucccaccucagccuccugaguagcuggaauuacaggcaccugcuaucaugcccagcuaauuuuuguauuuuuauacagaugggguuucaccauguuggccaggcuggucuugaacuccugaccucaggucauccacccgccuugaccucccaaagugcugggaauacaggcgugagccaccgugccuggccucaccucagcuucuugaguagacuacagaugcaugucaccaagccuggcuaauuaaaaaaaauuuuuuuuuuguagaggcagggucuugcuaugcugcccagacugguauucaacuucuggccucaagcaaucccccuucucagccucccaaagugcugggauuauaggcgugagucgccgcgccaggccuucucugucucuuuuggccuuccuucacuuccauuuuccccacacccagccaccaguucaucccaguccucauccuuuuuuuuuuuuuuuuuuuuuugaauggaauuucacucuuuugcccaggcuggggugaaguggcucaauuucguucggcucacugcaaccuccaccucccgggcucaagugauucuccugccucagccucccgaguagcugggauuacaggcgccugccaccacaccuggcuaauuuuugcauuuuuaguagagacaggguuucaccauguuggccaggcuggucucaaacuccugaccucaaacuccugauccaccugccuuggccucccaaagugcugggauuacaggcgugagccacagcaccuggaguccucauccucuuaaccucaacucccccagcaggauuucucauccccagguaaucacacuagcaacacacgaagaugagacccuggagucagguggacaaauguggcccugagggaaucucuggauuucagcuucuucauccuucaugggauaaaccuccugucuucuguucccauuauccugaugucuccugcuugggaaaucuuugucaaagcuggaguauauucuagggucucuccucccuuaaaggggagcauucccuguggucuuccucccucagagggugacauuuuggguauuccuugggagaccccaggaaugagaugcaguugcugugggcuguggggaaggggcucuuggacuuacuauaguugaacuuguuggucugagccaucaugggcacagagacagugcugccgucugauuuguggaagaggcggcggugggugcuggagucggggaagggagucuuccacuggccguugaaguagagggcauucaccagcaccagccgugucagcugguccacggcuccuuucccaagcaaguugcugaucauaccuaugggaaaaucaaugaucaggaagaucaggaaguuagacgauuuuguuguuguuguuguuguuguuuugagauggagucucacucuauugccaggcuggagugcaguggcgcgaucucggcucgcugcaaccucugucuccgggguucaagcaauucuccugccucagccucccgaauagcugggauuacaggcgccugccaccaugccuggcuaauuuuuguauuuuuaguagagacgggguuucaccauguuggucaggcucgucucaaacuccugaccuuuugauccaccugccuuagccucccaaagugcugggauuacaggugugagccaccaugcccggcugaaguuagacaaaguuuuuaagccuuuuagauguuucccggaguccccaguccucaauuggauguaugucaaagggcugcagucagggguuuaaaugaacccgucuaguuccuuuuuuuggagacaaagucuugcucugucacccaggcuggagugcaguggcaugaucucagcucacugcagccucugccucccggguucaagugauucuuugaaccucauccucccgagcagcugggauuauaggcaugcgccaacacaccuggcuaauuuuuuguauuuuugacagagacaggguuucaccauguuggccaggcuggucucgaacuccugugcucaggcaaucugcccgccuuggccucucaaagugcuaggauuagaggcgugagccaccgugcccagccuaagauuugguucuuaaagcauccagcccuuuguccauagagaagagaaugcugaaaaggagcauuuuuuaggauauguggauuugguuuuuguuuguuuuuuagagaugaggucuuguucugugacccaggcuggagugugguggugcaaacauagcucacugcagccuugaacugcuggacucaagugauccucccaccucagccucccaaguagcugggacuacaggugugcaccaccaugcccggcugguuuuuaaauuuuuugaagagaugaggucuuguuauguuggccaggcuggucucaaacuccaggccucaagccuuccucucgccuagaccucccaaaguguugggcugggauuacaggugugaacuacugcacccaacugggauauguggauuuauuuccaaauucccuuucucuugaggcccaggaaauggguuuccuuucccugccugcucaccuuuugugugugucuucacccagucauugaugaugaaucuggcucucuccaccucugaaaaguccacuugcuugaccgugcuccggaacagccugaagaaguggggcaugaagcccuggaccagcuucagaucccgcuggacgaagaucgcgucuguggugcugaucucauccuuguuccauggccccaugagcuccuuguacagaugccggagggcgggggccaugcccuugucugcaccgggacagagaggagaggacaugugaggcuuaugcugaauugaggguucccagccgagcccacuucccccacaaggggcuccacucugauggaugggggcuaccgugcuuucccagggcucucuggagggagauuucauuccaggaugaaaucucuuuucuguaucuccuuccuuucuucaaaagucucagaucccaacccuuucuuugggcuagaauauuuuucucuguucuuaaauuaugaacccuaaauauuuucuuccuguuuuuuuuuuuuuuuuuuuuuugaguuggaguuuugcucuugucucccaggcuggagugcaauggcgcgaugucagcuuacugcaaccucugccuccuggaugaacccuaaauauuuucuuucuucuucuuuuucuuuuuuuuuuuuuuucagacagggcuucccuuuguugcccaggcugaagugcagugguacaaucauagcucacugcagccuccagcuccugggcucaagccauccucccaccucagccuccugaguaguugggacuacagguaugugucaccacaucuggcuaauuuguaaauuuuuuuguagaggcaggggucucccuguugcucagucuugucucgaacuucuggccucaagugauccuccugccucaaucuuccaaagugcugaaauuacagucauaagccaccuugccuggccuuaguuuuuuuuuucuuuuccuuucuuucuuuguuucuuuguuucuuucuuucuuucucucucucucuuucuuucuuucuucuucuuucuuucucucucuucucucucucucucucuuucuuuucuuuuuuuugacaggucucacucugucacccaggcuggagugcaauggugugaucucagcucacugccaccuccaccucccggguuaaagugauucuugugucucagcuuccugaguagcugggauuacaggugcaccaccucaucagacuaauuuuuauauuuuuauuagagacgggguuucaccguauugcccaggcuggccuugaacuccuagccuugggugauccuccugccucaaacuccgaaagugcugagauuacaggcaugaggcacugugccuggccuuagauuuuuuuccuauagugauggcuaugcuaaguauuucacaaguguaauuccaugaauucuuuuauuuuuuuuuuuugagacggagucucucucugucgcccaggcuggagugcaguggcacgaucucagcucacugcaagcucugccuccuggguucaugccauucuccugccucagccucccgaguagcugggacuacaggcgccugccaccacgccuggcuaauuuuuuuuguauuuuuaguagagauggaguuucacuguguuagccaggauggucuugaucuccugaccucaugauccgcccgccuuggccucccaaagugcugggauuacaggcguuugagccaccgcgcccggcucaugaauucuuuaggacagcaaauaauccucauuuuguagaugggcaaacuuaacgagguuaagaucacacgguggugaauaagcgguaaaucuacuggucagacacccuuggagauucaaggguccagugacuuggaguguagugggaagaagaugggguggccccugcagcacagcuguauggggcuuggcucggcuaagccagagccagccuuuccuuggcuucugguaggucuguucugcaugccacccaccuccccuggugucccguggcucaccaucaaucuugaaucccauagcugcuugaaucugcugcuggguuucuccuccuguugucagcuggagcauggccaacaccgaggccaccccauagggugagaaaaccacguugcgguccuuggaggccugcgccaccugcugaaacacccucaccccgaagucugaggccaggugggccacguaggaugggggauggugcacagcagacccuucaccaaagacaagggccaggcccaggacuaggcaggugagggcuggagacaucugcauccuagagcaauggaaagagggcuggugaaggaaucguucuggaagacaggcgggaggggaggggagcuggccagcugugggcccugcucuucuuguuuccugcaagcaggugguaagugaacacuagggcaaggugcaggaagagaccaugacauguucagguucuaagcccaucccacuccgucucacucagacugacuuauccccgggcaguggcagggagucuucgcccaucuugcccugugggaaucuuggaauccaguccaucucccuucccucugugucccguaaaaaagccuuagaagaaaagcaggugagaagucauuaccacucucugccuuugcagcccagggggaauuuagcccagacucaauuaucaauuaucacaacaucuuugauuugcauaagcuuuaaauuugcuuucuuuucuuuucuuucuuuucuuucuuucuuccucuuuccucuuucuuucuuucuuucuucuuuacuuccuuccuucuuuccucucucucuuucucucucuuucuuccuuccuuucauucauuuuuagagacagggucuugcucugucacccaggcugggugcaauggcucagucuuggcucccugcagccuccgccuccccagcugaagcaauccucccaccucagccucccaaguagcugggaauacaggcacaccagcacgcccagcuaauuuuuguauuuuuuugggagagcaggguuuugccauguugcccaggcuggucucaaacuccugggcucaaguuaucugccugccucagccucacaaagugcugggauuacaggcaugagccacagugcccagccuuaauucucuuaaugcuuucccagcgauuguuucauucaaguuagcaggcaugaggugggaaauggguaagugucuugaugcagagggacugagagagucaagguucuuguuacugggugaugggguuguuggugacgccugaccauccucccugcucuccugcagucaccccuagggcagggucgacccaaggcugcagguccgaggaaaagaaaauagaggaauagcgggggaucauggagggaggagauucuggggaggcgaguucucugccuuaagcccgaaguaagagguuggagggaguuugcuuuucuccuaccugaaguucucagaggugccuugcgauuggcgguucguccugcucuggcggcggcugcugagcugcaggaauucagcugcuggaggggggcgugugggucuucuugacagcgcucuuggcccugcagccaaacacagcugugcucc

SEQ ID NO: 14487 - RNA, 6724 nt, Homo sapiens
uuuuagccaggggcuguugagagauggcagaagggggucuuaauguggggacuguggacaguggggcauucgugggaaccagagggauuuuggacaaguccagauggaaugugcagggcauagguagagggaaaagaaaaucccuuucugggaaaaccauuucuuguuuauugaaacaaugcaggacaucaucaaaguccggguggacacauuccauuaucuacaaauuacaaagguaggcacagcaaagaauaaugaagauuauaagaaaaccaagcgccaggcacggugacucaagccuguaaucccagcacucugggaggcugggguggguggaucacucaaggucaggaguucgagaccagccuggccaacauggagaaaccccaucucuacuaaaaauacaaaaauuagcuaggcgugggagcgggcgucuguaaucccagcuacuugggaggcugaggcaggagaaucauuugaacccaggagguggaaguugcagugagcucagaucgcaccauugcacuccagccuggguaacaagaaugaaacuccaucucaaaaaaaaagaaaaagaaaagaaagaaaaccaaggucccucucccucucccucuccccacggucucccucugccucucuuuccauggucacggucucccucugaugccgagccgaagcuggacuguacugcugccaucucggcucacugcaaccucccugccugauucuccugccucagccugccgagugccugcgauugcaggcgcgcgccgccacgccugacugguuuucguauuuuuuugguggagacgggguuucacuguguuggccgggcuggucuccagcuccuaaccgcgagugauccgccagccucggccuccggaggugccgggauugcagacggagucucguucacucggugcucaauguugcccaggcuggagugcagugucgugaucucggcuagcuacaaccuccaccucccagccgcccgccuuggccucccaaagugccgagauuacagccucugcccggccgccacccccucugggaagugcggagugucucugccuggccgcccauugucugggaugugaggagccccucugcccggcugcccagucugggaagugaggagcgccucuuccuggccgccaucccaucuaggaagugaggagugucucugcccggcugcccaucaucugagauguggggagcaccucagccccgccgccccgucugggaugugaggagcgccucugcccggccgcgacccagucugggaggugaggagcgucucugcccagccgccccgucugagaagugaggagccccuccgccuggcagccgccccgucugagaagugaggagccccuccgcccggcagccgccccguccgggagggagguggggggucagcccccucccggccagccgcgccguccgggagggagguggggggucagcccccgcccggccagccgcgccuuccgggagggaggugggggaucaguccccgcccggccagccgccccgcccgggagcgagguggggggcgccuccgcccggccgcugucccguccgggagguggggggucgccucugcccggccgccccgucugggaggugaggagccccucugcccggccaccaccccgucugggagguguacccaacagcucauugagaacgggccaugaugacgauggcgguuuuguggaauagaaaagggggaaagguggggaaaagauagagaaaucagauuguugccgugucuguguagaaagaaguagacaugggagacuucauuuuguucuguacuaagaaaaauucuucugccuugggaugcuguuaaucuaagaccuuacccccaaccccgugcucucugaaauaugugcuguguccacucaggguuaaauggauuaagggcggugcaagaugugcuuuguuaaacagaugcuugaaggcagcaugcuccuuaagagucaucaccacucccuaaucucaaguacccagggacacaaacacugcggaaggccgcagggucgucugccuaggaaaaccagagaccuuuguucacuuguuuaucugcugaccuucccuccacuauuguccuaugacccugccaaaucccccucugcgagaaacacccaagaaugaucaauaaaaaauuaaaaaaaaaaaaaaaaaaagaaaaccaagaagaugggaaaaccaugcagaauugauuugacgaggaaagccuuggucucuaauacaugcaaugacuagaacaguauuuggucaaagaaccacauaagcucuguacccuggaggaaauguaugcaggcaaggacuaguaaaauaaaaaauaauaauaauuaaaaaaaaaaaaaagaaaggcuggacgcgguggcucacaccuguaaucccagcacuuugggaggcugagguggguggaucaccugaggucaggaguuugagaccagccuggccacuacggugaaaccccaucucuacuaaaaauacaaaaauuacccgggugugguggcgcaugccuguaaucccagcuacuggggagucugaggcaggagacucgcuugaaccugggaggcagagggugcagcgagccgaguucaccccauugcacuccagccugggugucacagugagacucugucucaaaaaaauaauaaauaaauaauuaaauccacuugcaguggucaaaaauaaauguuaaauaaaugggugagaaaucuugcggagaaauagacuccuggcacuauaaaaaugauccuggagaauaauuuggcuagacuuugcaagaaugacaaaaaugauuauaagaaucaguugucucacuuuggggaauacauucugggaaaauaauguaagagaaaaaauauuugcauacagacauuugaggcugcucuguauauuacaggcaagaacuggaaacuguucggcugcagggugacagcuaacuagauugugguuuauuaggggaaugagccuuucuuuguguaugacaacuaugaaaacuauugagaagaaauaguuacgugauacagucauaauccucaaaaacggagaaucaggaauuaugaucaaauagugauaguaacaaggaaaacaucugucuaaauaauuacugaguagaaauagguucggaauuuguaaauagucauuaauuugggagauugggguuuuuuuuguuuuguuuuuuguuuguuuuucauuauuuugugcuauuauucauacguguacauuucuacuucaguuuuuauuauccauuacauaacauacaugcuugauuauuugcuucaaggaaauacaccuuuauaaguaauacucaauaacuacuggguuugagaaugaaggugucagaacgaaugagauuguccuaugaaagaagaggcaggagccagggaggaggaucccacccggccggggcucagccaggaggcagggccauuggggcaggguggcaguccaaggaaccgcucugggaagguuugcaaaggucgggguccccccugccaggugaucgaauuaucguggagugucuggaaggcgggggaaguuuuguugaguucaccaaauaacucagaccaacuggaaaccaaguggaguuucuacaggaccaacuagaauagggaucagcuacaugggggcggggggaggggggcagggaacggugucugucuucauugcagcucugucugcagagccagcacugugauaccucauaguaggugcucagugaaugucugugaagugaauuacuaucuagacaaggaugagacugguaugacucuccaaagcuuucccaccuccaaaaccucggcuuguggggaaucuccaguagggggcacuguggacacgguucgcaucugccucccaaggcugggcuccgcgucaaaaaaaaaaaaaaaaaaugagacugagccaggugcaguggucacuccuguuaucucagcacuuugcguggccaaggcgggaggaugucuugaggccaggaguucaagacuaggcugggcaacauagcaagaccccaucucuacaaaaaaauuuuuaaauuagccagaggugguggcaugcacccguagucccagcugcucgggaggcugaggcagaagauugcucgagcccaggaguucaaggcugcagugagcucugauugugccacugcacuccagccugagugacagagcaaaaccugguuuccuaagggggggauaaaagagggagagaugagaucggggugucccgcuucugugcauguggaggggguaacugggaaccguguacuguaggggaucgcacaccuugggguggaaacagcagcucuccggaguugcaugggagccaugggcagugguccuggcuggugaaaugauucuagccacguggcccacccagggggcaaaacaauagaaaccuucagaaaugaaacgucaccuggcugcaagaagauagucccacaggcgcccuagagauggggaugccaaguggcuucucgggaagcuguaagaauccacagggcauuguaagauggagggaaauauuaaguuuucuucguaaagaggugaggggggcgagagcagcaaaggacacuggaaaaugagaagcauggaugggaaguguugcauugagcauaauuuggagguaaaaucuccaacaccguaacugaguggccuggggaccugauagaaagcccugcucaggacuaaggcagaguucccaguuauaucgcagauacaaagagaccaggaacacgcuuguaaucacagcacuuagggaggcugaggcggguggaugaccugaggucaggaguucgagaccagccuagccaacauggugaaacccccaucucuacuaaaaauacaaaaauuagccaggcgugguggcacaugccuguaaucccagcuacucaggaggcugaggugggagaaucgcuugagcccgggaggcagggguugcagcgagcugagaucguaccacugcacuccagccugggcaacagagugagacccugucucaaaaagaaaaaaaaaaaagagagaaaucaggaacaucaugaaagauacagcaaaauguuuuaccccagcccacugcaccacaccugggauugugacaauuaacuugauaaauuguuccuuuuccuguucggaacugacuagguugugcguggauggaccagugaaaagaaaauccuguuuggguagggaagagggaaguagaaaaccucuuucguauucuuggugucaagaaaugggaagagaaugagggagcagagaccuggguugaguguuggcucugcacuaaacagcugugugaucuuggucuagugccuuaaccucucugagccucaguuuguacaucaguaacauugggauaaugacauccacaugcccacuucacagagcugcugugaggacuggaugagaaauguagagaaguauuucggacaccauaaagcucaaauacaagguguugguuaggaaaaguuucaacugacuuguacccaccugauaccccuccaucagcauaagcguguaugaggauguuagguacauguguugugagugaaagcucuggaacacccgaguagagcuuucugcaaaucagcuucuccuucagaggagaccauuuuguuuugcuuuccagcaguuacuugaagaagccuuaucugaagucacaacagugacuucaggaauagaagggaccaauggccagcuugcugaaauguaaugccauucuuaaaagccagcuaagaaucagaccguauuaguuaaggacccauaagaguagacauuuagaaaaagugaaaaauggcaagaguggcccaaucuuuugagaguuuagagaaaauaucauuuggaaagggaguagcucuccuucuauuuuagccuuauuauuacgguaucuauaaagcaaugccauauucuaaaucugcagaaauaaaauucuaaggggcgaaaguccaaggcagaagucaaaaguuuugcaaggaaaccgaugagguugcugaccugagcugggcaggguugaacaggcgagugccaagaucaaggucucugauugucucuccuugaaagguaagcagagaacuagggcuaucccauaaauuaagugggagauuggaaaggggugcggacuucuguauuggggagaaggucuuggaugaacuggggcagagaacugccagagagaguaccuaggaauacguuguuagcaggagaaagaccaaguucagaugcagacuugggaaaguagguaacuugaccaaagguagcaaaauuagacuacccaacuggauugugaaugcaguuuaugaaauggaucaggacaggagcaaaaauagauuuucuagaaacugcagacuccugugauuggagcaguauacaaaguacagcaacaucagacuagaucucaccugaggugcugggugagaaaucuuagggaccagauggaagagggccuguguauaaagacauuaggaaggagguuugggagggcagccugacuugucuccagagaaaguuagaacugguugacuuagcaaccaagggacacugggucaaagacgaggaaucaggacgucggugccuagugacugagcgccagcccagcccauuucucuacauugccaugggcuaaacccagugugcuguaaacucuucaguuccuuugguuauggauuuuguaucuuuucuguguuucuuaauaaaguucuuuugaa

SEQ ID NO: 14488 - RNA, 7955 nt, Homo sapiens
cgccaggcuuugcagggacaccagugggagguacauaggugcgugucugggacccgagaaucucaguucuguaacuucguccucaguccaaggugcgcugcugcuguugggagcuaaggcuggucaagcacagguuguagaaggaguuggggucaaaggcugcacucaccucuugccagcccacccacccagcagccuguaguucacuggggcuuuuuggagugccccaguagugaggguccaauaccaggacauaggcuuccgugccugacccuacgcagacucccagcaaggccuuggaccuggcaucugcgucccccccaaccaugacugggcccccacccccugcgaagugcgaguaaagccucuccagcuccccgugcagccccacuccccgggguacguggcagaggcgucccuggggcccuccgaagugagcgaggcagaggcuggccuccacgcagccgauccagucccgggagccccggaagccggggggcuugucgcccauguccuccagggccgccuguacggcggccaguccagguacgcccgcgggcuggcccucuggccacgagcacagcgucugcagagugcgguagccgcagccccagccgcggucguccaggccgucgcagccguagugguaguagagguaguggcccgagagcagcgccaggcggacagggccgcggcucggcggggacaggcccacguggacgucccucagcggcuccagggcggugggcgggagcggaggucccaggccaggcacagcguccuccuagcggcgcggagcgaccucaggcuccaacacuuccuuucggcuccgggucuugggccagcugccgcaggaccggcgcgcagacuggggacgcgcuccccgggccucguugaucaccgcaggccgcaauaggcagccaccgaccggcaccgaccgaggagcucccacaaugcuccgccgcgccccgccccgccccgccccuccccuccccuccccuccccuccccuccccucuccuccccuccgccgugccagcuagccugccugcgggccucauuacgcaggcgcgagcuccgcccggcagggcagggcuagggguuggccuuugccuugcgcccgccucggagcucgccuguuucuugcccuccagccccgcuccugcauagacucggcccccgugauuccggcguucugccucuaccccuggcucccuagucgcgcacacucccguggcuguaacaguuuauuggcagcccagaggggcgaaggcaccgcgggggagggagcucagccugagacaugcagaggaccgggagccccgggggacgucggggugggguggggaugggcagagucuggggcucgucuguguuauagcccagcccugaaauaaauaguauauacagcuagggggccgggcggagcggaggacaugggggucccgccggggucacaggucugagcagcgauccugcuugcuguaguggucgaacugguucuuccagugcaccauguaggagcuccagcgguggaacucggccuuccacuggcgcuccgccucgucgagcgugucugcggccagggcgcccagcgaggcgggaggggaggacggcacgaggaaggucggggaucggacauuugggcggguugaaggggggguaugagugcagggaggacgcacggagaaaugcaggcgaccacgugggacgguggcaagaggaucaggagaaugugcgaaagacgagagggaggaugagggcagaggcggggccggagaaggacagcaggaaggagagaggaggagaaaagaaugaccggaagacgggaacagaggggacaggagggggagguugggggaaaaagaagagacagaaaugguugaccguuauagccccaauggggggugcuaccccguccggggccucccacuuccccccaaugucaggcucagguuccaaaagauaauuuuauaaaagaauacuggcuuuuccauuuccauucaaacaacaaaggcgugggggucccugagaagggugggaggcacggcccccuccuccugcccuguccagugugagucucucgguuugaggaggaagggagcacuaggucugagaucccugaguggggcccuuccccacgguccgaccacucauuagaggaggggccccuguggccguaggggaagaggccguguucacagccgccggaggugggagaggaagaggaggagaagcugguggaggaggaggaggggcagggggaggccgggccucggagcagccuccccaugggugaagccugggcaggugcugggagccuccgaggcuagggggagaagagagggguuacaccuggcgggcucccacuccccuccucccagccgcugcccgcuggccccugcauaccgguggcgcugagcaauuuggggaggaagcgguuccagaaggcgcaggccugggcgcgcagcccccgccgcaccuccagcggccgcagguccagacuaacguacugcugagcccccgccguguacgggggccauuguggggccuuggggucucggggcucauugggaucccugcggaaggaagggaaggcucaguccagacgggcagugggaggagguggcccccaacuccacgggaucccggacucuucagcucagcggagagccccagagaacccguccccucccucccaccacuuucuccaaugugcgcggucauuggggucuucccuuccucaagcgcuccgucuccuuccguuucccucagcuuuucuguuccaucuuuguuucucucacuaaaaaaauggcuaggaugucuugagacuuuccuaaauaaccaggacggguccuaugucuacaaacaucacauuuuuuaacaacacccauccaaugcuagauuucauuguccucuucucgauccagguaaacuggugugugugugagagaaugugucacugcuagugaaucaucacugguuugacuuaauccagcuccaacuccuuugucuuggucucccuuuuuuuuuuuuuuuuuuuuuuccagagauagggccacucaggcuggagugcaguggugccaucauagcucacugcagccucaaccucccaggcucaagcaauccuccugccucaccuucccaaguagcugggacuagaggcacgagccaccgugccuggcuaaguuuuguauuuuuuuucuuuuuaagagucggggucuuguuauguuguccagucuggucucaaacuccuggccucaggggauccucccaccuuggccucccaaagggcuggaauuacaggggugagccacugugccccgcccccuccaugucuaccucgucuccuccucacuuuccuuugccucugucucugcaagacccccucugccuucucugucuccuuucuuuuucucuccccuuuuaucuacuuugugagcauaucccucucuggcuguucuauccugccccugucccacccguccuuucugucuccgugugucugccuuuguguguccucccgcccccgacuccuguccuccccagccuucucucccucugcacugcugacccugugcgggcaaaguuggcccaguaucgcaucagucgcugggcgaagauuuucuccucugccguguaguuucgagagggguccagggggaucccaaagaugaacucgaucucguagccguggggcacccccauccacaggggccaggagagcguggaagcacgguguucaaagacguaggcguagacccgggcacccugggcagccagucgcccagccagcugggccacggggcacacgacauuguggucgcccaccacaucgcucagggccucccucaggcgugccggguccucgggaugcagccagucuguguaaugcaggaccacagccucggcugccaggucacuuaccuggggaaccccgacccgcaccccggccaggaacucggcccggcugaugagagacucguugucuuugcugaagccuggggccccguaaaccagaaaauacgagcccucauccuucaccacacccaccagcaccugggggugagggagaggggggugggauggagcgacaggcacagacagacaaguagacagaaacagauggacagacaaagagccagagagaugaacaguuacagacccggaaccauggacagagagaggacgagaucaggggagggaugcagagaaagagaaaauagacccaugguggcuuuccugucugcccugcugaccacccugggaucugagcccucagggaggacuucugggacuucugggaaugggccuggagaagcccucaugccugggucccugcagggaggggagggaccguugggacccagaggagccagcuucacgccagcuagccacuaguuaccugcaggccguggaagucucccgcguugaugagggccucuggggugucacugaggaagucuccaucuaccacaggcacgaaggagaaccggaagacgcuuucuugaggcagcacgugccauucgugguucaccaggaccugcgcuggucguguccgaaggcaggcuaccagcucugugucauucccaccagugccgccuggaggacagcccacaaggugggccagcugcguggcccugcgacgggccucucccaugcccaccguggcccaggguccauugggggcaccgcucugcagcacggcccuguggaacaggccccggcugggcggggacagcaggugcaugcccaccgaggcggcucccgcgcucuccccaaacagcgucacugaugucgggucacccccgaaggcugccacguucuccugcacccacugcagggccagccucugauccaggagacccacauugcccggggccucucggcuccccggcagggccaggaagccaaaggcucccacccgguaguucauggacaccagcacaguccucucggccuguaccaagaagcggccaucguacacguccaaggaggaggccccacuguagaagccacccccauagauccagacgaggacaggggugggggauguaggccggggguaugguguccacacguugagguacaggcaguccucgcucagcucacgguugggguuccacaucucggugcccucaaaaccuggguauaggguguccacauauugguagcagacacucuggaagguuguagcgucuaccaccccugaccaaggcugcuugggcuccgguggcagaaagcgacggggucccauggguggcuccgcaaaggggaugcccaggaaagcagagacagggcccccgggggucuucaggcgaaugccccgcagccggcccccacgcaccgucaccagcagcucugcauccucccggcccucagcccccacuccuccacccaggagccagaggaggaggagaaggaguggggaagccagggaaggcgugugcagcagacacugcgggggccucauggcugcagggcaggcggcgucugcugggagaaagaaagggaaagggugaagggucggucgagaagccaggagggaggagauuagggcacugucggcccaaggguuaucgcucagcugcagaggagguggggcagguuggcaaagaugaggggagagagggagggagggaaggagacaggcagagacaaggacacaggccagcgggcaggaggggaaagagaucaggcagacacccauauccagacaaaugcagggaacagagaggagcacccucucugcuccgcagggguccacugcccucaccucuucccggaacugggccgggcccagcucgugcagugagggcaccagaagccucaguccacgaacaggccacccgacagggcgcggccucacggacgggcagcgccgcugggggagcuugcggcggccugaagcgcagccccgcucuccugggucggccagacccggggcccuggggggcggugggcugggcauucaggguguggaagccucaggucccggggucccccaaauccugccuaguccacuccccacccaacccugccccuucucauccaaugucuggcaccgagcgcugaugcccgcggguucccaucagcugcgcacgcucccagcccagccccagcaaacaggcucgccagcccgcgucccccaggacucgagagccccccauccgucugaagcugccgugcacgccgccgccggcggagggcaguagagaccgagaaaaggucggcgcuccccgccccgagccaggagccgggaacuuggggagggggccugggggcucgagggccuugcagagccgccugaagggcgagccgggacgccugcguucccgggacuccggagauccccggcugcaggggcgggggcgcuauuuugggggcagcagcugcuacgguuccggcaucuccagccaaaggaucaaaauuccccgggugggaacuccccccucucccgccggucacuccuagcccagcccccgccgcccugagcggggggugguggugcugcuggagauuaacuaggaaacccgaguggcgcuaauuauaacucggggcuuccgccgagccuccccuucccaaaaaauagagauggagucuccgcgggagggggcguccugggccucggagggggccucugcggggcgcugcgcaggggcgcuggcuuguggcccuggggaugggggugcccagcccggcgccgggaaccugcgcagcucggguaccgccccaauuagggggugucuuccaguggccccggacuagggagcgaucggggaaggggugcucggggguccccgcgggaaucggagcgcagaggcggcggccguucccgcgggcucgggcuccugcgugggcgucggugagugugaggcggccggggaagaguuccggacgagugcggggcagcggagggcggcgcggggcaggcccggggaagcgggagccgucccguuaggggggccuggaccccucggggagcgcacggugccccggacccgggccuuaaggagagucccgggcggggagggagacucaccugaggcggccgagccgggccgggccgggccgcgccgggagcuggaggcggccgauguuccccggcgcaggcugagccgacucugacagccgccgccuccggccccccgcacacacccccuccgggccucacagcgcccccgcccgcccccgcccacugucuccgcccccgccccuccccgcucucccggguggccaccuccccucucucucccucccuuggagccgagacccggagaccccggggcccagacgcacuccagugccagacgccgaccgacgacagagcgcagugacagacgcgacccaaagaccugcagcggcggaguagacacccacgugacagacagacggacagaagcccguggagacagacacgcgcagacggacgaccucaugcagugacaggcacagacaaacgcagggacgacuuucacagacggacggacacacuuggacacccugucggucucgcucgaggcuggugaaguuagcgcaaggccaaggggucaugcauccccggccacgacacagacggguggcaugggaggagaggcaugugggaguguggcagaguaccguccccuuagggguccagguggcacgggugcagaaaaggugacgugggacacuccuggggaugaaaggacaccugugggaauggagauguaaaaugggaucgcuaguggaaaugaggugggagggcauggagacaggagaccccugggggaggaaggggugacuugggacaccugagaaggcaggacagcgugguagcacgcgcaaggcugcugggcgaggcgcacuccgcggcggcaguggaaacuucuggaacccccgcgggugggucugugcugguucccugacgggugacuucggacuuucgucaccaggguccggucggggcaugacauc

SEQ ID NO: 14489 - RNA, 942 nt, Homo sapiens
guacagaguuggaauuggcuccuuuauggaaaaacugaaaauauaauaaaaauuaaaauaaaaccaguuuuaaaaaagccagccccugggguuuccaccuccugccuccggcccuccagaggggugaggccccaaccccagggcagcagaaggaugagggccuccugcuccuccucuucccccauuccauccccuucuuaucuccacagugggggccccgggaggaaccaaaccugggugggagggcagggacccaaggccccguggcccggggaagggggcugggauugcgccagccccgcagcccuggccuguagugugggcaugggcagggccccuccuggccugggcccaguggggguggggccauuaguuccagaucuugaggaaggagucccaggagcccguggccacagccaugccaucgucggugaccccgaggcagcucacgcgguugucguggccagcgaggacuccugugaagaagagagaagucagaacccauugggccugggcuccaggucccugcccacccagccugggccccagcugucaccugcacggucgcccuucauggcaucccagauguugcaguugaagucgucguagccagcgagcagcagccguccgcugcgcgagaaggcaacagaggugaugccacagaugauguugucaugggaguacaugaggagcuccugaucggcccgcaggucgaagaggcggcacguggcgucgucagagccgguggugaaggcguagccguuggggaagaacugcaggacacgggacccagauggggugagggugagggugaggagcagggccgggagccugguggggagggccuggccuagcucgccccaaaacucacagccacugcauugaugucggauucauggccgaugaaggucugucggcacauggaaucccgcacgucccaca

SEQ ID NO: 14490 - RNA, 942 nt, Homo sapiens
ugugggacgugcgggauuccaugugccgacagaccuucaucggccaugaauccgacaucaaugcaguggcugugaguuuuggggcgagcuaggccaggcccuccccaccaggcucccggcccugcuccucacccucacccucaccccaucugggucccguguccugcaguucuuccccaacggcuacgccuucaccaccggcucugacgacgccacgugccgccucuucgaccugcgggccgaucaggagcuccucauguacucccaugacaacaucaucuguggcaucaccucuguugccuucucgcgcagcggacggcugcugcucgcuggcuacgacgacuucaacugcaacaucugggaugccaugaagggcgaccgugcaggugacagcuggggcccaggcugggugggcagggaccuggagcccaggcccaauggguucugacuucucucuucuucacaggaguccucgcuggccacgacaaccgcgugagcugccucggggucaccgacgauggcauggcuguggccacgggcuccugggacuccuuccucaagaucuggaacuaauggccccacccccacugggcccaggccaggaggggcccugcccaugcccacacuacaggccagggcugcggggcuggcgcaaucccagcccccuuccccgggccacggggccuugggucccugcccucccacccagguuugguuccucccggggcccccacuguggagauaagaaggggauggaaugggggaagaggaggagcaggaggcccucauccuucugcugcccugggguuggggccucaccccucuggagggccggaggcaggagguggaaaccccaggggcuggcuuuuuuaaaacugguuuuauuuuaauuuuuauuauauuuucaguuuuuccauaaaggagccaauuccaacucuguac

SEQ ID NO: 14491 - RNA, 3214 nt, Homo sapiens
aaaaggacucucuggaacauggcaacauuaaucugaccacaagcugacuggcaggugcuuuaaccacaaggugggcauccuaacgcgagcgaccguuuugaggcagaagcccgauggggcccguguccgagcuuagggaggggccggagacgcaaacacaggucucccaggaagcaggcggcgucacaggucgcucugcaggcgcccgcugcagcgggcggagucuggcuggagagaggaggcgggcguccgggaacgcccggaaggggcgaggccagcggcggggcggggcuuauggagaucgugagcugggcgugaggagaaggccggguugggagcugcgaggggccggguuuagcggggugggcguggccgucgagguggggcucggcggguccgaaggaaccuggggcagagcuggaagaggaaaggucuugggggcccugggccugggucugcgggagccccaucuagcgggguuccaaggcggcggcggcaucagucgaggcccugcuccgggagcucaucuuguccccuuucgccccucacgccccccagcucugacuccaggcccuguccccugagcucugcccucggauguccgaccgcccagagccugcaugcgccguggggcgccccaggaccaggagcugguggguccggggcccccugggcgggggucccggggcgccccuccucccuugggacccguugucccgguccuggucuuucccccggaucuaguauucagggcggaccagcggagcggaccccgacagcugcugacccucuauaaccccacaggaacugcgcuucgcuuccgagguaaagggaucggcgccucgugggggcugguggccggacacugggggguuguguuggcuggaggagucagauggguaggguugcacguccagcuuugguggacugggaaagucauguccagccuccggggcagaaggcagaggggacuuaaaugacccacauggcagggcuugucugugugugucucuaucccccaguccugugcacagcaccugccaaauacacgguguuugacgcagagggauaugugaagccccagucuugcauugacaugugagugagcugggaggguggggaggcuuguggaagccaggggucgcugccaccuguugucugaggucugagaccuugcccccuuuaaccuauuugcccuauccucugccugugccccuaagggagagacuucuggggggaggcccagauuuccuuggauuacugccucauucaccccaaugggcuucucuccuaccuugggaccagugugauucgccauguggcacccauucccagccacuaugauguccaggaccgcuuccgcauugagcugucugaggaaggagcugagggccgaguggugggacgcaaggacauuaccuccauucugagagccccagcguacccccuugagcuucagggacagccagauccagcgccucgcccagggccuccugcugggacaccaccacccacggccagacacuuccaggagcgugaguugggagacugggaucuugaguucuguagggagggaggaacuagcauuucccuagagaugagauaaauuggauuugaagaagucuccugguucagucuuuugucuuuugguggaaacauuccuccgaguugagauuuuauaucaggugagggggaaaagacuuacagcuucccugguuucugacuucuacuuagaggaaaaaguucuuccuugacuguaaccgcaguacuuccuaucaugugguagcucaguucaguucaauaagaaaccuguauugagcaauuaacccuguaccaaguugugugcuggguaugagaucaagagaggucccugccugucggauagguccacagaagagagaaaaugaaugcugagggacuggaggagagaguucuuguggugguggggacagaggcuguaggaaggagaggacacuugcaguguaccccuggagggcaguaaaaaguagauacagggugugauggcucacgccuauaaucccagugcuuugggaggcugaggugggcugauaaccugaggccaggaguucaauaccagccugaccaacaugauggaaccccgucucuacuaaaaacacacaaaaauuagcugggagugguggcucgcaccuguaaucccagcuagucgggaggcuaaggcaggagaaucacuugaaccuaggaggcagaggcugcagugagucaggauuguguggcugcacuccagccugggugcaacagagugagacuccgucucaaaaaaaaaaaaaaguagauacaggguguggugacucacaccuauaaucccagugcuuugggaggcugaaguggugggaggauugcaauugcucgaggccaggaguucaagaucagcuuggacaacauagcaagaccaucuacaaacaacuuaaaaauuagccgggcaugguagcaugaacccauagucccagcuacuuaggaagcuaaggcaggaggaucaccugaggccaagaguuccagaccagccuggacaacguagugagacuccaucucuacaaaaaauaaaagauaauuaaaaaaaaaaaguagauacaucuuccuuguucaggcuucucccuggaggaccugggcugggcaggagugggggcugcagcaucugaugagucuuguuucucagacccccgccagcaacuggccaccagcuccuuccuccucuucuugcugacggggauugugucuguggccuuccugcugcucccacucccggacgaacucggcagccagcugccucaaguccugcacgucucccugggacaaaaguugguggccgccuacgucuugggugaggacaguaguggccagggacccaggccccaggaaaaagggagaagggacgggaggagagcuaacagagccccagggcugcccaugcgacccuauucuuucuuuguccccccuccaggccuccucaccaugguguuccuccggaccugagcuccgugcucaacccccagcccaccccacccucccugggcagggucuugaggcagccacugugaugcucauaccuuaccuugccuccuacccucuucucuuuccugccuacuccccacuccucccugacaaaaaacacccagggauuuguacucauuuuccaaguugaauaaaauacauuuuuaaaaugauaaucagaaau

SEQ ID NO: 14492 - RNA, 18582 nt, Homo sapiens
aggcagaggggccucagaggucccccaagccuaggcuggggacauggugugggaaagccagcaggaacgggggggccaagggccuaggagacaggagggcaggagcagggagggggcaaucaggauggucaggggaagccagagacggaagcugcaaaaauucaccaggcuguguggacgggaggaggggcuccgggugagggggauuggccgcaggagaucgggaggaguuauuuggagaaguuagggaugggucuggagagagaggggaggaaauaacugugcccagcuagagucagaugagccccaagguaggcggagagaagggaaaaaaggaugugggacccucaugggacccuaugcaccccuucuuggguaggugaagagaagcugcccuucuuguggcucggagcuugggguugaagagaagagggggaaaggaaauccgauuuccauccaguuguuccccccagagcuggugaguccuuggggagggggauugagaauaauaggauugggggccagaucaccgaggggccaccaaagacuccccgcuucuucccuccucccucccagguggagcauaucaucucauuccucccagucagagaccuuguugcccucggccagaccugccgcuacuuccacgaagugugcgauggggaaggcguguggagacgcaucugucgcagacucaguccgcgccuccaagaucaggguucuggaguccggcccuggaagagagcugccauucugaacuguacaccuuccccagaaccucccguucuccuugccucugucccgccuuagccuuccugcucucuaaaguccccugaugacccccacacucccaacagugcuuccagggccccuuucuccggaagaaacggguccaguucaaacauucucccuugaguacuuccuccaagucuucggaauccacccacagcccccguuagcggccucccugccaagucucccucuguacacagacacuucccgcuuuuucccuagaggcaucccucacuccccaaaccuggaguuuucccuccucuaacccaaggcuucugaacucacuguugauauucugggcaaaauaauuccuugauguggggagcuguccucugcauggugggauguuuaagcagcaacccuggccuccacccaccagauggccagcagcaucccccuuaauugugacaaccaaugcccuugaaggacaaaaucaccccuagccugagaaccaugccauaaacccucuuccccuccagggaucccccaggguguacuucuuacacucacugggagauuaaaagagaagggggacccagaaaacagauccaaagcuaggggugagggaggaugaccggccuucaucaaucauuccuuuucacuccuguuucugucucuucucuuuucuuucuuuuucuuugauuuuuuuuuuuuuuuuuuuuuuuugagacagggucuugcucugucacccaggcuggagcacaguggugcaaucuuggcucaaugcaaccuccaccucccggguucaaguauucucgugccucagccuccugaguagcugggauuacaggcucccgccaccacacccggauaauuuuuguauuuuuaguagagaugggguuuugccacguugcccaggcuggucucaaacuccugggcucccaaagugcugggauuacaggcgugcaaaaauucacugagcugugaggaugggaggaggggcucagggugagggggguggaugccgcacgcagccucugugucuuuauucuuagaguuuuccucaacaucacugaugcaagguugcaccaaagaacugcucacuaagaagcaaauguuugacccugggcugaggugggguggagacuaaaguucacaugucgaguauaaucuaagcuuauuuuccacaucuccuucauaaggggucuguuuguuccccuguccuggggauggggaggaacuacaaaccagcgugucuaagaaaucuacccaagcuccaacucaucucccucgugucaucucaucccuugaaccuuccaucuccuuccuuccuccagacacgaagggccuguauuuccaggcauuuggaggccgccgccgaugucucagcaagagcguggcccccuugcuagcccacggcuaccgccgcuucuugcccaccaaggaucacgucuucauucuugacuacguggggacccucuucuuccucaaaaaugcccuggucuccacccucggccagaugcaguggaagcgggccugucgcuauguuguguugugucguggagccaaggaugugaguagcagaacccuggcagcugagagcccaccuguauuaguccauuuucacacugcuauaaagacguaccagaggccgggugcaguggcuuacaccuguaauccuagcacuuugggaggcugaggcaggcggaucagcugagaccaggaguucgagaccagccuggccaaauggcgaaacccgucucuacuaaaaauacaaaaauuagcugggugugguggugggugccuauaauuccagcuacuugggaggcugaggcaggagaauugcuugaacuugggaggcagaggcugcagugagcugagaucgcacccuugcacuccagccugggcaacaagagggagacuccgucucgaaaaaaaaagacauaccugagaccggguaauuuauaaggcaaagagguuuaauugacucauaguuccacaugacuggggaggccucaggaaacuuacaaucauggcagaagggaaagaggcacgucuuacauggcagcaggcgagagcacacaagcaagagcagggaaaacugccuuauaaauccgucagaccucgugagaacccacuaucacgaaaacaacaugggggaaauugcccccgugagccaaucaccucccacuggguauuacaauucgagaugagauuugggugggggcacagagccuaaccauaucaccaccucucuuuugaggacccaggcccccaucagucuugaggugucuuuccuaugacuucugcccucccacauaggaaccugaaaucaagggcucauuucccaacucuggacccaagcauuucacuucccaccccaggauccagcugccccagccccaucccauuuugaaacucuagaucccagacgcccucaucuuuucccccaguuugccucggacccaaggugugacacaguuuaccguaaauaccucuacgucuuggccacucgggagccgcaggaagugguggguaccaccagcagccgggccugugacuguguugaggucuaucugcagucuagugggcagcgggucuucaagaugacauuccaccacucaaugaccuucaagcagaucgugcugguuggucaggagacccagcgggcucuacugcuccucacagguguggcccaaagcaauggcuuuugcaaacuguuuccugcagauuccucagacccugcugcagaggagggggagggaggccccucagacuggguuccauaugccaccuuauccuagucuccaucuaaacagcucugcccuucucugucuccuagucuaggauucugcuuaauauuuuauaugaauaaaaggcccuguccaggugugguggcucacaccuguaaccccagcacuuugggaggccgaggugagcagaucaccugagaucuggaguuugagaccagccuggccaacauggcgaaaccccaucucuacuaaaaaauacaaaaauuaggucgggugcggcggcucacaccuguaaucccaguuuuugggaggccaaggcggguggaucacgaggucaagagaucgagaccaacauggugaaacccugccugacucuacuaaaaaaaaauacaaaaauuagccaagcgugguggcgcgugccuguagucuaagcuaccugggaggcugaggcaggagaaucccuugaacccaggaggcagagguugcagugagccgagaucacgccacugcacuccagccuggugacagagcgagacuccgucucaaaaaaaaaaaaaaaaaaaaauuagccggacgugguggcauggaccuguagucccagcuacuugggagccugaggcaggagaaucgcuugaacccaggagguggagguuucagugagccgagauuaugccacugcacuccagccugggugacagagugagacuccaucuccaaaaaaaaaaaaaaaaaaaaaaaucagauguccccagcuuccaugccaaccaccucacuauacuccaaacugcucccuacuuucccaauguccuuuauacucaaccacauccccaggccugagacccuuuaggcuuuuucuuaaaauauuuuuuucuuuuuuggagcaagguagagauggggucuugcuauguugcccaggcuggucucgaacucccugccucaagugauccuccugccuuggccucccaaagugcugggauuacaggugugagccaccacacuugaccaccucuaaacuucugaaugccaggcagggcccucaauccccagaccucucacucaaaucggauucuaacaaaucugcuagauuuuucucucugcucaucucucaugcugaaguacuucccugauuuauggugggaacuggagucugggggacuuggggucacucuucccuuauuucuuucucagccccacucuagggcaguaaaugugucacccauauggccuagggagucucuugggauguuuauguggauauuggagaauccccuccccaacuaauugcuuccccuacccccagaggaaggaaagaucuacucuuugguagugaaugagacccagcuugaccagccacgcuccuacacgguucagcuggcccugaggaaggugucccacuaccugccucaccugcgcguggccugcaugacuuccaaccagagcagcacccucuacgucacagguauggaccaccuccccccggcucaagcccgcagccuugguuagacccucuaaacaucaacacccuucacccuuacuccagcugcauggugaaccccugagggcauccuagugaaaagauguguuuagggccggcauggugacucaugccuguaaucccaucacuuugggaaaccgaggcaggugaaucaccugaggucaggaguucaagaccagccuggccaacauggcgaaaccccaucucuacuaaaauacaaaaauuagcugggugugauggcaggcgccuguaaucccagcuacaccagaggccgagacaggagaaucacuugaaccaggagguagagguugcagugaacugagaucgugccacuucgcuccagccugggugaccgagggagacucggucucaaaagauguguuuucaguucccaggcaucauaguugaugcauuccuaguggguaugagacuccuuggaucuuguagcuuucaucccagguggggccuuaucccuaggaaaugggugcccaaagcugcugagcugagggcuccugaccccccagaccaggggggaguguauuuugaggugcauaccccagggguguaucgcgaucucuuugggacccuucaagccuuugacccccuggaccagcagaugccgcuugcucucucacugccugccaagguaggcuccuggagggacggggcaaaccagagggguggcgcuguagggauuggaaggucugaaguauuauaggaaucagauuauugauccagaggggcaggggauccccagggagagguaugccaaaagagaucagcugggggcucggugcggagggaggcugaggagggaguaucgcuugagcccaggagcucuagaccagccugggcaacauagugagaucccaucucuaaaauauauauauagaaagagaucagcuggggauggcagguuaguggcuuggagacucuggaacucagaguuccucuggagggaauggaaucccuauccccuuucuaucuugcacgcuagauccuauucugugcucuuggcuacaaccaccuuggccugguggaugaauuuggccgaaucuucaugcaaggaaauaacagauacgggcagcuaggaacaggggacaaaauggaccgaggggaacccacacaggugagacuauuucccagcaacucucaucccaaccccuuuccuccaauucccuaacccccagaucuguccacuucuccagauuccacagaauccaauuucuguuccuuugggaaguuaagccacucaguauguaaugccagugguacuaccccaugucuuacccaggguuggcacuacgagguccauucugugcagugcacacuguaaaugcaauaggaauuuagugaagggguagggugggugaccugggcaggcuagagacuucuagaagagguaagaugugagcaggggccaggugcagagccucacgccuguaaucccgacacuuugggaggccgagguggacagaucacuugaggucaggaguucuagaccagccugggcaacauggugaaaccccgucucuaccaaaaauauaaaaaauuagcuggcugugguggcacaugccugcaaucccagcuacucaggagguugaggcaggagauucucuugaaccugggaggcugagguugcagugagcugagaucgugccacccuacuccagccugggccacagagcgagacuccgucucaaagaaaaagaaaaaagaugugagcagggcaucguggguuacauaagacuuagguagggauagagaaggcauucugugugaugaggagggggauaggcacgaaacuugcacauaccugggacagugacaagacgggucucacuaaagcacagaaggcaucuugggaaucacugagguaugaggugguacaggugggcacaagcuuagagagguguagauuuggggaagagucacugcagguucuggaauaggagaaggcaacccccaagaggugacugagaaugugucaggagccuugugcagaggaggccaaggaggggagcccgccaggaggcuguugagugaugacagcacuugagacaagcgccuggugcugcagcgagaaugggaaggaauggauacaggagcuauuugggaagaaaaugaauagggccucaaaacugauuagauguagaagagagggguauaagacagagguggcucuggaagaaagauaucucacaccuguaaucccagcacuuugggagaccaagguggguggaucacgugagcccaggagcaugagaucagccuggacaacauggugaaacccugucucuagaaaaaauaaaaaauuagccaggugugguggugggugcuuuuagucccagcuacucgggagucugaggcacgagaauugcuugagccugggaggcagagguugcggugagccgagaucgugccacaacauuccagccugggcaacggagagagacucugucucaaaacaaaacaaaacaaaaaccacacucaauuggaaacgucuagcuggcaauuagauucuaccugggaacaugguugaacaaacagaaguagagacugaaaagcaacucugagaaguaggcccugugguagacaggggaugaagaggugccucuaagacaggccgugcaccccucuaacacugucccagaagccacaugagaaggaaguuccaaauggggugggugguaggguuaauugauggugugacaauguaagauacauuuacuacugacauggaaaagauagucaugccauauuuuuaggugaaaaagacuuuuaugaaaugguuuacauaguaccauuuauuuuuauuuuuauuuuuauuuuauuuucaagauagagucuugcucugucucccaggcuggagugcaauggcgcgaucucggcucacugcaaccucugccucccagguucaagugauucuccugccucagccugccaagaugggauuacagcgcccaccaccaugcccggcuaauuuuuguauuuuuaguagagacggaguuuuaccauguuggccaggcuggucucaaacuccugaccucaggugaucugcacaccuuggccucccaaagugcugggauuacaggugugagccaccgcacccagccucuuuuuauuuuuauuauuacuuuuuugagacauggucuccacugcuucccaagcuggagugcagugacacaaucguagcuugcugcagcuuucaacuccagggcucaagagauccucccgccucaaccucccaagcagcuaggacuacaggaaugcgccacuacgcccagauaaguuuuuguuuuuuuuguuuuuuuuguuuuuuuuuuuuuuagagacagggucuugcuauguugcccaagcuuauauugaacucauggcuuuaagcaauccucccaccucagacuccuaaagugcugggauuacaggugugagccaccacaccuggccccaucccauuuuuuguuuaaaaauacacaacuugcccaucaugguggcugacaucuguaaucccaacuacucaggaggcugagacaggaggauugcuugaggccaggaguugaaggcugcagugagcugugaucaccacugcacuccagccugggugacacugagacccuaucucuaaaaaauaaaaaauauacaauuuauguguauuuguuuguuuagccaacagugaagaauaucuagcaagauguuaauaguagauggugggauuuccaaugauuuuaaaauuaauuuuuugcuugccaauguuucauaauuuuucuagaaugaccauaaauuacuuaucagugucuucagaauuaaagcgcuaacaggcucaggagaaugagggggcagaagacgcccugggauuuagccacugagaggccaagugccucuagagagagcaugucaguaauguaauagagagaaaagcgagaucccagggaggugcuggauagacuggcugugggaaggaacaguaauguggucagccucagauuggucauguaaccaacucugcugcuuaagagagagaggcaggaagcggcaggaagcaaguagaagcuuuuuuuucaaaaacaggguggccauuuuggaaaagaauuaugugauaaguugaaaaugcuaggcuaagcauuucaacuagcucacaccuguaauccuagcacuuugggaggccaaggcagguggauugccugagcccaggaguucgggaccagccugggcaacauggugaaaccccgucucuacuaaaauacaaaagaaauuagccagguguggcggugugcacccauagucccagcuacucgggaggcugaggaaggagaauugcuugaacuggagaggcggagguugcagugaacugaaaucgugccacugcacuucagcuugggcaacagagcgagacuccgucucuacaaaaaaaaaaaaaaugcuagaggcugaggugggaggcccggaguucgagaucaccaugagcaacauagugagacacuaucucuauagaaaauuuaaaaauuuaaaauuuaaaaauuauaggcacaugccgggugugguggcacaugccuguauucccaacuacucaggaggcugaggcagaagaauggcuugagcccaggaggucaaggcugcagugagcuaugauugcaccacugcauuucagccugggcaacagaaugagaccccaucucuaaaaaaagaaaagagaaaauaaaaaugcuagaguggaggcugggcucagugguucaugccuguaaucccagcacuuugggaggccaaggcaggcagaucaccugaggucaggaguucgagaccagccuggucaacauggcaaaaccccuucucuacuaaaaauacaaaaauuagaugggugugguggcaaggaccuguaguccuagcuacuugggaggcugaggugggagaaucacuugaacccaggaaggcagagguugcagugagccgagaucgcacugcugcacuccagccuuccgacucugucucaaacaaaaaaaaaaaaaagaaagaaagaaagaaaagauaauacuagagcaggaagggagggauaguggaagggaaaguccuuccucagggugguguuggggucuaaccuggaauugcacaagaagcaagucuccccgaggcuggcaggcaggaugagaggcuggacuggcauagacgggugggcugagaaugagggguacaccacagcaggcccugggcucaggcaaggagcugauuuucugggggcauagaugagauaccaacagaagugcaagacccuaugugaccaguuagaguaugggggcugcaggggucagcagggcagaccuggggcgugggacagugcuggcucccauuuccuccuccccaguucauucugccccgagccuuccagucaaccuuuucccaccccagcccccccgucccuuggugcucccugcucagggacccuggccguguguccccagguuuguuaccugcagcggcccaucacccuguggugcggccucaaccacucccuggugcugagccagagcucagaguucagcaaggagcugcugggcugcggcuguggggcugggggccgccucccaggcuggcccaaggggagugccuccuucgucaagcuccaagucaaggucagagcggggucaggagagugggcacccagggaggaugagagccaugaaccaggaagcccacaggcuguagcuggggcuccugcagggacccagggggucccauuucccuagcaccaccccaccucccuccucugccgcacaccacgcucucugcuuucucccuuagcagacugugcuggccuugcccaaccucacacaccccugggacuuagccggcucagggcuggugugagagggaagaaugcaauaggcagauuagcccgggcacccugggaaacccugcaaggaaagcaccacucagccaugcccccuuucucuccuccuccaaggucccucugugugccugugcccucugugccaccagggagugccuauacauccuguccagccacgacauugagcagcacgcccccuaucgccaccugccagccagcagggugguggggacuccugagcccagccugggggccagagcaccccaggaccccggggggauggcccaggccugcgaggaguaccucagccagauccacaguugccaaacguugcaggaccgcacggagaagaugaaggagaucguaggguggaugccccugauggccgcacagaaggacuucuucugggaggcccuggacaugcugcagagggcugaaggaggcgggggugguguagggcccccagccccugagaccuaaucccccucaugcuagccuagucccuggaggagggaguccggccccaggccagggacuaaggagcaaugaccauugugcacaugcgugugggaagggguugcuaggggguggggacggcuaaccaggguaagaauguucagggggcugcccaggaggggcccccaaccugacuaucauggacaagagauuugauggauagaauaaaaggcugcagcgaggccugguguggaagccuugggggcugggagggacaggggcagggauggggugggugggugcccggcuuggugggugcaggagggcaggagcccaggcaggggcaggcagcacaagcagcuccaggucucaggugcagcagagcugaugcugccugaacccuucacauuguuguccacucccugcucccaagagcacaccuggucguuuggacugggaaguucuggcccuaccuucuggaacaacucuaugcacagaugcucuuggcuaccccacugggauccccugcccacuagacuuguccccauccugaggcagccuguuccuccugacccccgaaagcuucccacccaucucccuucggccugaagccagccccccuccucucucccuucuguuuaccucccagguuugggcucuauuuucuacuccuuccaccucuuccugaguaacaaggacacucccuucauccacaccccaugccuccugccuugcuuccuguaccuucaaguaguuggaagaggucaugggugagaauuccuucuccuuggccuagucuggcccaggucuggagagaaggcaauggagaugugaaguggaggccaggugugguggcuacgccuauaaucccagcacuuugggaguccgaggugggcggaucaccugaggcuaggaauuugagaccagccuggacagcaugcugaaacccugccucuacuaaaaauacaaaaauuagccagguguggaggcaugcaccugcagucccagcuacucgggaggcuaaggcacaagaauugcuugaacccgggaggcggagguugcagugagcagagaucgcgccacugcacuccagccugggucacagaaugagacucugucucaaaaaaaaaaaaaaaaaaaaaaagaaauugaaguggaaaaugagcuggcagggguggucaggcagggggugagcaaugagggcuccugagcugaggaagcaggggcggggggaggaugggggcuagggaguccucagaaguucccggagauacucccucacuggacagagugggguucccgaugacguuacuugaggccugggagacggccucugccccucacugcuccucccccuccuaaggucaacauuuauguguccuagaccuagagaggucccaggacacgccacugucccgccuuccccauugcccgccccacuggccaguccccacgcccacacacccaaggcugccccaucuggcgcugauuauccugcugcugccgccaccgcugcugcugcucugcaaaauucagcugcugccucugucuugaggaccccagcgccuuucccccggggccaugcugccugcagccacagccucccuccuggggccccuccucacugccugcgcccugcugccuuuugcccagggccagacccccaacuacaccagguaggucucuuggcaucuuccagacagcuccagugaacuucagacccccgauuccuuugggguuaugccuggagauauuuuggguucccuugcugacacaccacuccccagauuccccaccgccucacccuucucuggcccccaaauccuccccaucugcugcaagaccuuggucuccugcaggccaccacugcucccauucccccaccuucguccucuggucucuuaagucuccccacccacccagauccuugaccccccauagaacccaagagagagccaagcuccugaacuugccugguagcuggauuccaggaaggaauucgagagggauuguagggggaggagggggcagugaguggagacuugggagucagaaucugaaguaguuuggaacaggggcagggcuaagguguggagcucgcggagccuggccuccagguucaaucagagggccaucgccacugcagcucccuccaucucuccacccccucccccccaccgccucguggcuguguccacaucuggaaguaguuaggcggcuccugucccuggacugccaggcagagugaggcgggagucuggaaggggggccgaggaggauuccgggaauuccuguugggguggggguggggacucuugggguuggagggauggucgaguugccaggcccacuuuucccuuaucuuugugggagucugggacaccccagcccuguccuggcugguggaagcugccccaggucucucaaggccuuuccauuucaucccccagcuucccuccuuggaguuucauccucaucaccucauccccaucuugccagugcucccccgucccacccgucccugcucuuuccugaccccuuuucuguucuccagacccguguuccugugcggaggggaugugaagggggaaucagguuacguggcaagugagggguuccccaaccucuaccccccuaauaaggagugcaucuggaccauaacggugagaaaccccucugggcacuaccccuuguuaaagucucagaggcaaaaaggccugacugcgaagggaccccccccccgucccccccgcaccaccuucucaaccuggggcagcuccaagugucuucccucugucacugaaggcaucauucccaccguaacacgcaucaucuuaacccuucccucaaaucuucauucuccaguccccggcccucccuccucuuccaaagccucagcucuuguccccugcacaggcuaccagcagagcugcagagaccaggcccucugcucugcacucacauggaggccccuucccauucaguccguuucugcaagaaacgcuuggggcaggggagcugcccucuggcuggguuguguggggccugacucuguggguccccgccucuguccccgcuaucagguccccgagggccagacugugucccucucauuccgagucuucgaccuggagcugcaccccgccugccgcuacgaugcucuggaggucuucgcugggucugggacuuccggccagcggcucggacgcuuuugugggaccuuccggccugcgccccuagucgcccccggcaaccaggugacccugaggaugacgacggaugagggcacaggaggacgaggcuuccugcucugguacagcgggcgggccaccucgggcacuggugagaacucccucaccuccgccuucccccccuccaggccccgccccggccgcagccccgcccccagcccuaaccuccgccccgcccaccccgcgccccagugccuagggcccccuaccucccugacccauuuuccucacuaaccgccccuucagucccuccuccccgucuucucuccccuccucccgcacccacccaucccucuuccagggccccccccaggcgcgaggcggaaaugggucaccgacccgcggguggaaugggcggccugggguuacugggacggugaguaacugccggcccccguccgcaaucgggcucccuccgucgggcgcgagggggcaccccagggcuggggggacuagguuccuccaaccccggggggccccuacacccagcccugggcucccgauugcggucccaucacccccuccuggcggcagaagucucccuugcaauguuucaggcggggaccucccuaaagggguccucgggggcugugccccaagucgaggacacccucuccagccugaaaggggacucugcugcagggccggggagaugggaucuccuaggggaagaggcgcggugcggccgcgggucggggaggggccagaagggggcguccagccaguuccuccucccgcuuccaccgcccgccagugcgcccugcggccccagacuuccccgagccgcgcuccucccggccgcucucuguuaaccugcccccaucuuaccuccccuucuucucguccccucauccugagccccagacauccgagcugccugccggggcucccagccuagaguucuccugaagcugaccgagggucuccaccgccccccacccccgcuccucucuccccuccccagagcaccaauuuugcggggggcggcuggagaaggcccagggaacccugaccacgcccaacuggcccgaguccgauuaccccccgggcaucagcuguuccuggcacaucaucgcgcccccggaccagguaccgacccuccuccccgggcugcccuaggggacccaggcggcgcccuccagcuugcagccagcagagauuuauugaagaucugcugugucccgagcacugcgcuugcgcuggugggcacccaaaacagccccaaccccugcaugcacgcaaacaaaaauguaaaaauuacaacugagacaagucucaggagagcgagguacaggguccugguauaacacgcgggccugucacuugugagugcgccaggacuugaccuugccaaccacgacgaccgacaccccugcagggucccaugggugugugugguccuccgugcuguggugugaacgccuucaggaggggggcccagaggacgcgggaggugggagugggagcugcugcaggcacccaguaggagaugaggugcaggcgcccaggggugucccgccgcgcaguccccgccuccgcccgccgccaggucaucgcgcugaccuucgagaaguuugaccuggagccggacaccuacugccgcuaugacucggucagcguguucaacggagccgugagcgacgacucccggaggcuggggaaguucugcggcgacgcagucccggggugaggggcgggaccugggcgaguccgggagagagucggcggaccgcacgcacgcggcuguuuggaggggcgggguucagcuaaagggacgggaucugaaccccagggcuccaaaccggcgaggggagcagguuggaggccaggcaaagaggagauuuggccccgggucugggguccgcggauagagaggcgacuggggcucugcgaaguugggacgaaguuaaaaggccaccuggccagggguaguggcucaugccuguaaucauagcacuuugggaggcugaagcgggaggaucaccugagcuuaggaauucgagaccagccugggcaacauggcgcaaccuugucuguaccaaaaauacaaaauaauuagcugggcaugguggcgugccuguagucccagcaacuugcggggcugaggcaggaggauuacuugaacccagaaggucaaggcugcaguaagccuagauggagccacugcacucaagccugggagacaaagugagacccugucucaaacaaacaaaaaaggucauggggcugagaagaguguggugcacgcccgcccugacacuucccccaaugcucgguggccaccugcagcuccaucuccuccgaagggaaugaacuccucguccaguucgucucagaucucagugucaccgcugauggcuucucagccuccuacaagacccugccgcggggcacugccaaagaagggcaagggcccggccccaaacggggaacugagccuaaagucaagcugccccccaagucccaaccuccggagaaaacagaggaaucuccuucagccccuggugagucugggauaggggaggaaggggaaacagacugaagggggccauuucaaaaaguucugaccugggcuguggcucacaccuguaaucccagcauuuugggagguccagacagcaggaucgcuuaagccuaggaguuuaccauagcaagacccugucuuuucaaaaauaaaaaauuaggcugggcugguggcucacgccuguaaucccagcacuuugggaggccaaggcaggcagaucaccugaggucaggaguucaagaccaccccggcuaacauggcaacaccacaucucuacuaaaaauacaaaaauuagccagguguggugguacacaccuguaaucccagcuacucgggaggcugaggcaggagagucgcuugaaccugggagguggagauuguagugagccgagauugugccacugcacuccaacuuggguuacagagugagauucugucucaaaaaaaaaaaaaaaacuuagccaggcguguggucauagcuacuccggaggcugaggugggaggauugcuugagcugggaaggucgaggcuucagugagccaugacugugccgcuacacuccagccugggcaacagagcaaaacuccaucuuaaacaaacaaaaaaguucuuccuuggcuacauucacucauugauucaucugguacucacuggugccuccuuccugccgaugaccccuacugggugcuaggaccggaagccugacagagcucugaacaguucaagucaaugaggcuguuauggggacagugcucccuccuaccugcugagcaggucacccuccacccuccucccuccuagaugcacccaccugcccaaagcagugccgccggacaggcaccuugcagagcaacuucugugccagcagccuugguaagaauacccccaaccccauuccagcuccucgaaccaccuccugcuucuguuuccaguccugccaucuggaaccucccaucuccucaucucucacucccauucucccacaguggugacugcgacagugaaguccaugguucgggagccaggggagggccuugccgugacugucagucuuauuggugcuuauaaaacuggaggacuggaccugccuucuccacccacuggugccucccugaaguuuuacgugccuugcaagcagugcccccccaugaagaaagguaacagagauguggggaaauggggaugggucaagcuaagccacacagaaaugaucaagguguggaaucuugagaccugcugacaggucucaagaauaagagaucucaaccccucccuccuucuuccaggagucaguuaucugcugaugggccagguagaagagaacagaggccccguccuuccuccagagagcuuugugguucuccaccggcccaaccaggaccagauccucaccaaccuaagcaagaggaagugccccucucaaccugugcgggcugcugcgucccaggacugagacgcaggccagccccggccccuagcccucaggccuucuuucuuauccaaauaaauguuucuuaaugaggaauggg

SEQ ID NO: 14493 - RNA, 1280 nt, Homo sapiens
auuuauuagcaaaauuacuuuauucuaacaaauaguuuaacacaaaaauacgaacuagcccuccagggaucuuuggggucuacgcuucccaucgccucaguguccggugcaugaggaagguguccucugaagggcggggccggaguugaagucggagagggggcagaccguccagggucagguguggagauucauaaaauagcguuucugggucacacaagauggucaugucuggcccaggcccagguggcuccuguugggagguugggcccaaagcaagguuacacuuugggaggaaggauccggguaaggggguacauggaggaagccccacgcccagaccccaucaccuuugggugcggggcucgagccuguggcggcaggagagccaauuucucccugagcgcggcauucagaaccuguuccuccggcaccugcaggcucaccaggucccggaagagccgcuuggagcgcggcacguucagcccugagagcgcagcggggacggaggugaguggcgcgccucaccccgacucccgcacgcggccggccgcccgccccccucacccucggacacgcucuccuccaggccgcagcggaucuggaacgacuuucucagcuguuccuccacggccuucgcagcaucaaaguggcucccggcugcggcccgcagcuccaggcccaaggccaggcugcucuucagcacgggcaucuccagcuccugcggcaccgcaggcugcggcucggaccgcaccggggagggcggcgucaggcggaagcggaccugggagcagagggcagggcagugaccaggugggcgcgaggccgucgcgggccgggggccagccucccccgcucaccugccgccgcugccgagccgcgccccgccgcuccgcccgccccuuccgccgcccggggcugccgugccgcggcugagggcugucgggccgcgggcucaggcucaaguccaggccgggcucgggcacuggggcucggaguugcgggacuuggggcuccggggguggccccgggaccgccgcggcuucuuccccguccgccgacuucagcucugacuccccacaacccaucaucaucuuuggaggugccuugagggugcggggaugcgggggucgcagacgcuccaacggucaggggacacagccuggcugccgccuccuuucccccgccccuccuagacgccgcuaccggaaaccguuaacccuuuccuucgggggcggagucagcagccccacccacccuguugucgcucccaggcguca

SEQ ID NO: 14494 - RNA, 5634 nt, Homo sapiens
cgucggaagggaaucuccgggcgggguagugcaggcgccggguuucccgcgguccgagcuggcgcgggcggaggagaaucgcucuuaaagggccagcgcacacgcguucuuuuguuccggggccgcagggcggggcaggcccgacuuucgccgucuucuugucuacucuccagaacggccaugauuucccaauucuucauucuguccuccaagggggacccgcucaucuacaaagacuguauccuagacccuuggggcugggaaggggcggaggggccgggcgggaggggcgcccagggccagccugugucgcaggauccuucacugaguccuuccacccgccaguccgcggggacaguggcggccgggauguggccgagcucuucuaccggaagcugacgggacugccaggagacgaguccccgguugucaugguaaccaguggcgggaggcgggugaggagcggggucccgucgggccgggugggcgccagcucccucccaggacugguucauugguagauuccacuuggggggugcauuccgccaaauaaagcuaacgugaggcccggcgcgguggcucacgccuguaaucccagcacuuugggagaccgaggcgggcggaucaccugaggucaggaguucgaaaucagccuggccaacauggugaaacuccgccucuacuaaaaauacaaaaaaaaaaaaaacauagcugggcgugguggcgggcgccuguaaucccaucuacucgggaagcugaggcuugagaaucgcuugaauccaagaggcagagguugcagugagccgagauccggacaccgcacuccagccugggagacagagcgagacucccucucgggguagguggggguggggaaaaaaaaaaaaagagucaaugggcgccagcaacacaccaggcccagcucccugcgugacuccauccucagcaacucgggguaguuaguguaauuaacccccuuuccacauugggaagcugggcccaggcauaugucauguaucucccaaaggcacugcuguugugacuaguaagaggcaucgggauccgagcucaggucuccuggguucugaucacuccaccucccuuuuuuuaacgccucucuucucccugccugugucucagcaucaccauggccgucauuucauucacaucagacacagcggccucuauuugguggucacaacuucagaaaacguuucucccuucagccuccuagaacugcucuccaggugaggaggguugggcugggcaccugguagcuaggaggggucugagaggaggagaaaauacacgcuccaaguguuuccucagguuggccacccuucugggcgauuacuguggcucccugggcgaggggaccaucucccgcaauguggcucugguauacgaacuccuggaugaagugcuggugagaaucaacaauccccuucuguggccccuacccaauuccccugaagauacaucugcucuucuacugugggaugccgugguuaggaggccaagucuaccuuuuuuuuuuuuuuuuuuuuugcuuuuagagacagggucuugcucuguugcccaggcuggacugcaguggugcaguuauagcucacugcagccuggaacuccugggcucaagccguccuccugccccagccuccccugugccuagcuaauuguuuauuuuuuguagagacuagagucucacuguguugcccaggcuggucuugaacucauggccucaagccauucuccuacgucucggccuuccaaagcgcugagaguacaggagugagucaccaugccuggccccacucccccucuuuaccccuucccuccacugaucacucagacuguccuuccuuuaccacuaggacuauggcuauguacagaccacauccacggagaugcugaggaauuucauccagacggaagcuguggucagcaagcccuucagccucuuugaccucagcagcguuggcuuggucaguagagggaaagaggagggugaggaaagagaagagggguuggcugggguugucagaccugaugauugauugcuuuggaugcuuuacaguuuggggcugagacacaacagagcaaaguggcccccagcagugcagccagccgccccguccuguccagucgcucugaccaggugagggaaggauccauggggucagacgcucugguuuugcucugggauccgggaguccaagaucuuaggucgggcacagcggcucacgccuguagucccagcacuuugggaggccgaggugggcagaucaccugaugccaggaguuucagagcagccuggccaacauggugaaaaccugucucuacuaaaaaugcaaaaaaaaaaaaaaaaaaagaaaaagaucuuggcacaucucccacccccccagauguggguggaggugggagaugaucccuuccaucacccauguccucacccuagagcuguagcuuugacuguccuguucuuucucccugucuguccauuucagaacauaggcuauucugcuuccaaccacccaaauucucucucuuucucagagccaaaagaaugaaguuuuuuuggauguggucgagagauugucuguacugauagcaucuaauguaaguuugagcucccaaaccuggagcugaggacagaugggacuugggaaacauggugggguggcuaagacucccagcaacggccgggcacaguggcucaugcuuguaaucccagugcuuugggaggccgaggugggagaauuacuuggggccaggaguuugaaaccagccugggcaacauagccagaccccgucucuacaaaaaauacaaauaaacaaauuacccagacaugguaguguacaccugcugucccagcuacuugggaggcugagccaggaggaucacuugagcccaggagguuaaggcugcaguaagccaagaucgagucacugcacgcuagcccggaugacagagcaagacccugucucuuaaaaaaaauaaauaaguaaaaaaggcugggcacaguggcucaugccuguaaucccagcacuuugagaggccgagguggguggaucacuuaaggucaggaguuugagaccagccuggccaacacagugaaacuccaucucuacuaaaaauacaaaaauuagcuacuuaugguggcaggcaucuguaacccuagcuacuugugaggcugaggcaggagaaugucuugaaccugggagguggagguugcagugagccgagaucacgccacugccagccugggcgacagagcgagaccgucucaaaaaaagaaagaaaaaaagacucuaaccuugacgccccugccucucagggaucccugcugaagguggaugugcagggagagauucggcucaagagcuuccuuccuagcggcucuggugaggcaucugcaggcaggaccaaggguugggguuagggcggguuccuuggugucuuaaaccauggcauugcugagcucuccugauggucucuccuccgacagagaugcgcauuggcuugacggaagaguuuuguguggggaagucagagcugagaggugaggagaaagugggucuuucuccccuuggaguaggucauugccagaguucauggagagaagucagacagagccuccccucuccuugcuccucucccaaaacaggagucaggagagaagucucucucucucucuuuccagguuaugggccaggaauccgggucgaugaagucucguuucacagcucugugaaucuggacgaauuugagucucaucgaauccuccgcuugcaaccaccucagggcgaggucaggguugggguggccucauaaauuccguccaccauggggaagggggcaguggggucgugagaccaaacuaaccuuguugcucucuggucucucagcugacugugaugcgguaccaacucuccgaugaccuccccucaccgcuccccuuccggcucuuccccucugugcagugggaccgaggcucaggccggugagacaauuuccuggguucuagaacuaccuuggaacccaagccaagaccuguauguucccaagacucacugcagaguggggguggugguaguggugauggagugcaaauuggaaaaaggcuuggguugcggccgguggcucacaccuguaauccuagcacuuugggaggcugaggcgggaggaucacuugagcccaggaguuccagaccagccugggcaacauagugagaccccaucucucugaaaaaaaaaaaaaggaaaaagcuuuggcuaauggaguugggcugggcuucagcccuuuucccucuugggaguacagcccacacccacacagccccacauggaggucccugguggggaauggugagaugccaguagaagauggccugagucgugguguuuuacccucucauccaggcuccagguuuaucuaaaguugcgaugugaccugcucucaaagagguaagagugaggcuggccuggcugaguucagcucuaugggacggaagacagggccagggcaccugcugcuucucccuucagaugcagcugccagccucagaagccaguuaagguagaggcuguagaauuugggaagguggggggcaccugugcugaaauccuguuaugacauugaagaggaacaggacaagggacugugccuuccuggggcugacuuuguucccgucuccucuguagccaagcccucaaugucaggcugcaccucccccugccucgagggguggucaggugagugugugcacccaccacggggagauuccuggggagagagugagcucagcaugacgggucugccucaagaaggugccaagcccagcaccuucccuuuccaaacuccagccugucucaggagcugagcagcccagagcagaaggcugagcuggcagagggagcccuucgcugggaccugccucgggugcaaggaggcucucaacucucaggccuuuuccagguauucgcuguggacccccagccccucuccucccacauucacuugcagcccccaccccacccucccgaagcagcugcugccugguucccccagcguggucagcuucuugcccuccuuccucucccugccucugccccucacagauggacgucccagggcccccaggaccucccagccaugggcucuccaccucggccucuccucuggggcugggcccugccagucucuccuucgagcuuccccggcacacgugcucuggccuccagguccgauuccucaggcuggccuucaggccaugcggcaaugccaacccccacaagugggugcgacaccuaagccacagcgacgccuaugucauucggaucugaggcuccccaaacgaggacacgacggccaagguggcaguuugucccacgggaggacagucguuucuuuuccagccuccuggccuucggacucugaaucugggcaggaagaguccucagucccaagaccaggagggggcaaugggcccagccuuucugugguaucugaugcaggaaggacugcaguggaucagaacuuacaaaccaaacuuuuauucugagaaacuggcuguacaauaucuaaaaagaaagugacaugaaggaagcaaucuacaacuuccuuccgcuu

SEQ ID NO: 14495 - RNA, 12956 nt, Homo sapiens
acagauggacgucccagggcccccaggaccucccagccaugggcucuccaccucggccucuccucuggggcugggcccugccagucucuccuucgagcuuccccggcacacgugcucuggccuccagguccgauuccucaggcuggccuucaggccaugcggcaaugccaacccccacaagugggugcgacaccuaagccacagcgacgccuaugucauucggaucugaggcuccccaaacgaggacacgacggccaagguggcaguuugucccacgggaggacagucguuucuuuuccagccuccuggccuucggacucugaaucugggcaggaagaguccucagucccaagaccaggagggggcaaugggcccagccuuucugugguaucugaugcaggaaggacugcaguggaucagaacuuacaaaccaaacuuuuauucugagaaacuggcuguacaauaucuaaaaagaaagugacaugaaggaagcaaucuacaacuuccuuccgcuuagcgagcaugcauguguguacgugcacguguguacaugucugcaugugugggaauccgggggcuggcagguggagcaucacggagcaggcugaggggagccggaguugggcugggagccauuggcuuuuggagucccuggagcuggagggggacuguccccagccuccugcuuccccccacaaagggcacugccgcugaguggggacggggacgaugccgggggaggaacuggagaaggaugggagguggggccuccuuugcccuccccuguugggggaagugagaccacgauguacuucuggacacucccaggaccagagggagcagugcuggggggugcggugguggcgguggagaccaacuugacgaugggcugcacgcuggggacggugguggugacgggcgaaguggugguggaaccugagccgggggccgaggugcugagggacaggaccuggauagaaaggaaaggcaggccgcuugcccugugcccucccugccccccagaggccuggcgaggacgcuucacucgcucccugccugaacaaguuguuccuguaguucacccuguagacagcuauggcuggagaccuuguucaugcagggcagcuacagcccugcaggacccuggugggcgccucuuccagcucuugacuuggggcccagaggggacugugcucuacuccugggccuccccagggugcucugagguaacccaggcccuccagaugcucccugucccacagcucugcauaccugcuggguggauggggcgcuggaggacgaugacauuacaauaaacuugguuggaggaggggaaggcugugguggggcagccgcucgugcagacaccagugucuggacaggaagugcgauggagccaggaaccuucagcaagccaggggugcgagggccaggcuguggggccugcgagagggucagcgugggccggggcugcggggagaagaggaaagggggaaguggcaccaucuacuaagaagaggagucugaagggagaggccugggcuccccucgcucuuccucaguggcucucacuagggcuggggcauccucacucagggccugguugcccugagacuacugacugagggcacauguggcugugugcaagugccugucccacacagggguucuccucugcuuccuccuauuccuccuccccacccggccacggaccugcgugauggucagagugguccuguugaccugcugagccugcagagcagccugggcccgagccuugaccaccugggagcagaggaggggcccaagggacccgaauucugcccgauaggcguccugauugucaggcggugggcgcagcuuugccagaacaggagcacaguguuucugcagaacagaaaaaaagccagguagagggagggcuggggaaaaaagccagguagagggagggcuggugacacucuugagaagaaccuuggggaugggguaaaaaaggacauuccuuaucaucucagugccccuguugaaggccaaauuaugcugaacuauuaguguguguacagaacacugugggcuuucucauaagaaaagaugggcacggggccaggugcagcaucuuaggccuguaucccagcacuugggaggcugagguggguggaucacuugaggucaagagccuggccaaaauggagaaaccucaucuccacuaaaaauacaaaaacuagccaggcaugguggcacgcaccuguagucccagcuacuggggagguugagguacuagaaugcuugaacccaggugguggaggcugcagugagcagagguugcaucagugcacucccgcuugggugacagagugagacugucucagaaaaaaaaaaaaaagaauggcuggguguggugguucaugccuguaaucccagcacuuugggaggcugaggcuggcagaucaccugaggucaggagcucaagaccagccuggccaauauggugaaaccccgucucuacuaaaaauacaaaaaauuagccaggcaugguggcgcgugccuguggucccagcuacuugggaggcugaggcaugagaauugcuugaaccugagaggcagagguugcagugagccugagaucgcaccacugcacuccagccuggguuacagagugagacuccaucucaaaaaaaaaaaaagaaaagaaaaagaaaacaugggcacuaaugugugaaugaacuugcuaaauacuguggcaggaugguuaaucaagagcgcauuugccuuguacagagaagaccacagaguaacaggagcauuggggaaggaugguccaaaugccacaggcugagcguguuaaacccuucuuuuuuggggggcgguggucucccucuguaacccaggcuggagugcaguggcacgaucauagcucucuguagccuugaacuccuggguucaagcaauccucccaccucggccucccuaguagcugggaccacagacacgucaccacucccggcuuuuugguuuuuuuuuuugcaggugggaucucgcuacguuguccaggcuggccucauacuccuaggcucccagagugcugggauuacaggcagaagccaucaugcccagcccccuuauuucuuacucagucuaaucucagucuuuccaucuguaaaauaguaucagacucugcaauguccucugaaaacaugaggcaaagaugggaguaagugaauaaaauaugccauaugcuugcuaaacacugccugugucucagugggcagguguggggacaggggcuucagucaccagcaggaggcucugcacauggucugcuccaauccggucaauguugcucagcacagggccguccagcacacugcggauccgcuccccuuccugcugcagccggggcagaaucagagucuugauaaccuguuagaagggaaaaggacaagcaaaagccggagggucaccagggucucccagauggggguacagugcccucuauaaccucaugacuguguccccucccccauuucuuccucccagaggccuaacaucgugucccagcucagccaagccugcgauggagccauaacgagucguccagggcgucuucucguccacccagcucuguaaggggaaggaaauaaacuaagaugaaggggucugaaaggaugauugacagggaccuaagucuuucauagacacuuuccuuguaaaucauuaagacauuacaaugaggccagacgugguggcucacaccuguaaucccagcacuuugggaggccgaggcaggcagaucaccugaggucaggaguuccagaccacccuagucaacauggugaaacucugucucuacuaaaaauacaaaaauuagccaguuguggccaggugcaguggcucauacccguaaucccagcacuuugggaggccaaggcaggcagaucaccugaggucgggaguucuagagcagccugaccaacauggagaaaccccgucucuacuaaaaacacaaaauuagcuggguguggcggcacaugccuguaaucccagcuacucgggaggcugaggcaggagaaucauuggaacccaggaggcggagguugugguaagccaagauugcaccauugcacuccagccugggcaagaagagcgaaacuccaucucaaaaaaacaaaaacaaaaaaauuagccaguugugguggcaggugccuguaaucccaaguacucaagagucugagggagaagaaucgcuugaacccaggaggcagagggugcggucagcagagauugcaccacugcacuccagccugggcaagagcgagacuccaucucaaaaaaaaaaaaaaaagguauuacagacaagccucaagacccuuagacccccacaaguuccagucccucuucccucugcccccuuguuuccagugugacuucccccaaccagagguggccagugaugaagcaaaugacgcucaaguuuuccuggcucaccuuggugaaggucuuggugauccgggacuggauguuguuagugguugugcuaaaaugcuugcagaucugggccaccaggcgggcagcaaagucucggagugcccagugauuguccacaucuggucgcaggcacaacugucugcucacgaugcaggucaucacagcuggaaucagcucauggaccuaagggagaaagggcgggacagcugauucugguuuuguuugucugcuugagauaaagucuugcucugucacccaggcuggugugcagggacacaaucauggcuaacugcagcaucaaucucccgggcucaagcaauucucccaucucagccucccagguagcuggggccacaggugugcaccaccaugccuggcuaauuuuguuuugguuaauuuuuuuuguagagauagcagucucacuacuguccucaggcuguccucaaacuccugagcucaagcaauccucccacuucggccucccaaaguugcugggauuucaggugugagccacugcugaccacugacuuccuguugguggcagcagggucccuagucccuggaagggaggaugggcaggaucacucacguauuuuucuagauagagcgugggguuguccaucagcgcuuucaccauacgcaucagguagaugaguagggccagguuguucugaaccacguucacacggaccugugggagggagaagugcugggcauggggcagggagacccucacaggagcuuccacugccgucccugcacuguggaaccucaugcucucacccccuccgagauaaagguacugaaccguggcagcaucugauacaguccaggguccguggcaaugcuuugcagggcuuccugugggaggagggaagccagucaggugggggugggauguggggagcaauucauagggcccccaggaggaggcgucucagggccagggcaagcugguggggcccucaccgcccucuuggccucgcaggagcccacgcaggccucggugaucuccuuguaguagagcugcugcuccacagacaacucguggaugcuccggggcuucagucgcaagggggcccccuccagcaagggcggcgccuucuucucuuucccugugugauuggaaaggugggucugacaaagaaagcuccagaagaaaccucaguaacagaagaaccuuaacccuccacuuccccugagacccaggagaccuggcuucuucuuaggcucccccauccuuucuggggcucuggcccugaccucagccacuucaccaauggccacauggaggccuggcaugguggcucacaccuguaaucccagcacuuugggaggccaaggcgggcggaucacaugaggcugaguuugaaaccagccuggccaacauagcaaaacccugucucuacuaaaaaaaauuacaaaaauuagccgggcgugguggugggcaccuguaagcccagcuacucaggaggcugaggcaggagaaucgcuugaacccuggagguggagguugcagugagcugagaucguaccacuacacuccagccugggugacagagugagacucugucucaaaaacaaaaaaaaaggaaacaaaacaaacggccauguggcuuugggcaagaguccagagaggccuagccuaggaggacugaccuuugccgucggcugugguggccccuugaccuuugcccuucagggguccgucuuccuccuggccuggcuuggcugacuucagggguucuguggcuucagccuucuguugcucuuugggagcuggugggaaagcaggcacagcgggaggggugaugagcauaguagaaaaguaaaaggugggaggaggccggaugcgguggcucaugccuguaaucccagcacuuugggaggccaaggcggguggaucaccucaggucagaaguucgagaccagccuggccaacauggugaaaccucgugucuacuaaaauuacaaaaaauuagccgggcgugguggugugugcuuguagucccagcuacucaggaggcugagacacaagaaucgcgugaacccaggaggcacagguuugcagugagccaagauugagccacugcacuccagcacuccugcacuccagcacaggcaacagagugagacucugucucaaaaaaaaaagguggaaggaaggggaaagggacccagagacccagaggguggggcauggagguuaccugggggcggguucucggggauagcuggcuggcagcccucgaugcucagccaaugagcugcaaggaaggcaggugucaaggugaauugccacgcauggacauuggggaguugccccaugcuauggaagcguguuuccacuccugcuccccuugcaacucaccagggaucucacacugagcuuuucuucuauugugaggcuccucacaccuacacacaucuguccuccuuucccuccucccugccacccugcucuccccucccccaaccuuugaggcagacguccaggggcacccggggcagagggguauugaugaugucgcucagaucaaccuccuucuccucauagaaguaaagcucccggcccccaccagaggcgaagcggaaaggaaugaacuccugggcguggaagccauagaguggcuguggcaggagagaggggcauggguaagaagggagccggaggagaccuggcugaaggauggcgucucaccccccccccgccugucuccccaaaucaccucgacauucuuuagcuucaaggcguagucaaugucacugguggugagcuucugccgcuuccccaugugcaugaacuucaaggcauccuggggucggugacagaacagacaucagcccaaaauccuaaggacggggcccugggugacauggacccaauguagagcuggacagaagggccgggucaccugugcgaucucuuugaugcgguagcugaccucauccguuagcagcuggcaggucuccuccugaaucugggcgaugcccauggauucagccaccaccuucauggacuccgagggcagcacaguguugcuaagcuucagcuucuucuccucagccauucuggagucccucuucuccucccuggaaggaugaagcccccgguggagagacggagacccuggcagaggaacggggcaggcagaagaaaaagaaacgugagacacagggagagggccaacaaagggaggacaguggagacaggggaggaacuccgagugucuuauguccauccccacgugagucagcccugagguguaacagagaaagauacaaaucugggcuggggccagguucaguggcucacgccuguaaucccaccagcacuuugggaggacgaggcgggcggaucacuugaggucaggaauucgagaccagccuggccaacauggagaaaccccaucucuacuaaaaauacaaaaauuagcagggcgugguagugcacaccuguaaucccagcuacuagggagacuaaggcacgagaaucacuugaaaccagagggcagagguugcagugagccgagaucacgccacugcacuccagccagggugacuccgucucaggaaaaaaaaaaaaaaaaucuggacugggccuaguggcucaugccuguaauuccaacacucugggagcccaagguaggaggaucgcuugagcccagcaguucacgaccagccuggacaacacagugagaccccaucuguacaaaaaauacaaaaauuagcuggguaugcaggcacagggcuguuguucuagcuacucaggaggcagaggugggaaaacugauagagcccaggagcuccuaggcucaagcaauccucacaccucagccucccaaguagcugggacuauagguguguaccacuacacacagccaauuuuuugcaggggcaggggcagagacagagucucacuauguuguccaggcuggucuugaacugcugggcucacgcaguccuccugcuucggccucccaaaguguuggaauuacaggccugagccaccaggcccagcccagauuuuuaucuuuuucuguuacaccucagggcuucaaucccaccacuuugaaguuuugggcucaagcaauccuccagcguuggccucucaaaguguuggaauuaaaggcgugagccgaagugucuggcccaggcucagcuuuccuuaucuucauagcaaugccauccauccagacacuuguucuuuaucugagccuucacaucaaauccaccagguaggccaggugcgguggcucacgucuguaauuccagcaauuugggaggccaagguggguggaucacuucaggucaggaguucgagaccagccugagcaacaugguaaaacccuuucucuacuaaaaauacaaaaauuagcugggcaugguggcgcgugccuguaaucccagcuacuugggaggcugaggcaggagaaucacuugagccucggcaguagaguuugcagugaguugagauugcgccauugcacuccagccucagugacagauggacucugucucaaaaaaaaaaaaaagguaaaaaaauaaauccggucgggcgcguuggcucacaccuguaaucccagcacuuugggaggccgaggcggacggaucaccaggucaagagauggagaccauccuggccaacauggugaaaucccaucucuacuaaaaauacaaaaacuagcuuggcgugguggcacgcaccuguagucccagcuacucgggaggcugaggcaagagaaucacuugaaccugggaaguggagguugcagugagccaagaucgugccacuggacuccagccuggcgacagagcgagacucugucucaaaaaucaaucaauccaccagguaguccaaccugacuccucugcucccacugcuuggcccaggucaccaucaucuauccacuggguaacuccaaaaaccuccuaacaaugucaaccggagucuacccuugccuuucucuacaucuauuccuaacguugcagccaaaaugcuucugucaaacuguaaagcagauugucauuucuuugcucaaacccucauaauggcucuccacuugccauaaaguaaaaccugaaauccuuauaaugggcaggugcaguggcucagcucaugccuguaaucugugcacuuugggagggugaggugggaagacugcuugggcuuaggaauuccugaccacccugggcaacauagcaaaaccccaucucaggccaggcacaguggcucacgccuguaauccuagcacuuugggagacgaaggugggcggaucacuugagggcaggaguucaagaccagccuggccaacauggugaaacccuaucucuacuaaaaauaaaaaaauuagaugggcaugguggcgggcaccuguaaucacagcuacucgggaggcugaggcagaagaaucacucgaacccgggaggcggagguugcagugagcaaagaucugugucauugcacuccagccugggcaacaaagcaagacuucuucucaaaaacaacaacaacaacaacaaaaaaaacagacgaaauccuuauaauguccuacaaagcccuucaaaauuaccuucuccccauuauaucucugaacgcccuuccuucuuccacuuugauccagacacauacauuccuucuggcugcuccuuaaacuugccagguauguacuugcuuaauagccuuugcugcauucccucugccuggaauguucuucccaaauaucuaauuggcugccuacccugaccacccuauuuaacucugcacucugcccucagagugggggcagcccacuuuuucuuuuccauagcauuuaacaucuuuugggcauggcgcaguggcucacgccuguaaucccaacacuuugggaggccgaggugggcagaucacgaggucaagagaucgagaccauccuggccaacaugguuaaaccccaucucuacuaaaaauacaaaaauuagcugggcguggugaugugcaccuguagucccagauacucgggaggcugaggcaggagaauugcuugaacccaggagguggagguugcagugaguagagguugugccacugcacuccagccuggcaacagagugagaccccgucuccguccaccaucuagacagggcucuuuuuuuuuuuuuuuuuuuuugagcuagaguuucacucuuguuguccaggcuggagagcaauggcgcgaucuuggcucacugcaaccuccgccucccagauucaagcaauucuccugucucagccuccugcguagcugggauuacaggcaugcgccaccacaccuggcuaauuuuuguauuuuuaguagagaugggguuucaccauguugcucaggcuggucuugaacuccugaccucagguguuccacccacccuggccucccaaagugcugggauuacaggcgugagccacugugcccggccgacagagcucuuuauuauguucacugauguauuccaggagcccagccugggacaucauaaauauuugugaaguaaaugaauuaguuguaaggcuuagagauauuggugcucaguaaauacuugguaucacuauuauuaauaggucauaggcccaagcuuugagccuacacuguaguuaaaagcaaacugggccggccgugguggcucacgccuguaaucccagcacuuugggaggccgaggcgggcggaucacuaggucaggagauugagaccauccuggcuaacaaggugaaaccucgucucuacuaaaaaauagaaaaaauuagccaggcaugguggcaggcaccuauagucccugcuacucgggaggcugcugaggcaggagaauggcgugagcccgggaggcggagcuugcagugagccgagaucgcaccacugcacuccagccugggcaacagagccagacucugucucaaaaaaaaaaaaaaaacaaaaaaagcaaaguggagccaggugcaguggcucacgccuguaauuugggaggccaaggcgggaagaucaccugagguuaggaguucgagaccacccuggccaacauggugaaacccugucuuuuuguaaaaacacaaaaauuaaccagacaugguggcgggcgccuguagucccagcuaucugggaggcugaggugggagaaccgcuugaaccaggaagcggagguugcagugaaccgagaucgugccacugcacuccagccugggcgauagagagagacuccaucucaaaaaaaaaaaaaaagcaaauuggagccaagagagguaacucaccccaguaaucccagcacuuuggaaggcagagguggggggauuguuugaggccaggaguuugagacagccuggucaacauagugagacccccauuucugcaaaaauuaaaaaauuagacggaccugguggugugaaccugucaucccagcuacuuaggaggcugaggcaggaggaucgcuugaacugaggaguuggaggcugcagugagccaagauggugccacugcacaacagccuggguaacagacggaaacccugucucaaaaaaaaaacaaaaaaaaauuaaaguggcacacuugcaguuggacauuaggaagauuaacauaucaauacugcuuaggaguaguacagguaggguggggccgugcuggaaggaugggaagagggaggccgaaaaacaaauugguucuuuucaaaccaucccugaucuccuccccgacuuuuauaagucuuaucuauagggaacacaacuauucgagacauacucugugccuggcgccggguuuacaagagggggucgugucccacuucccuggcgaacuccuacgaauccuucaauacccggcgguacccucugccaguaaaggcucauaaaacacgcuacagucacaggaucuccucagaucaguggaggcggcaggaaggcgucccagggaaggguuaacuuaagcgagaucccagcagagaagcaggucgaagauccccgggcagcgcgaaaggagguucagagagcccaccccaucuccugcaacaucucuccaaugcaggcacacacacgggguccccacgagcacagacacacaaccaaccguccucuuuccaguccccacaagggaccuucaaagggucuccuccgggguaccacucagacccgcccccgccacccgagcgcggggagcaggaaaacucuagcggcagccgagacgcugcucacccggcgcucggcgccaucuuggccccgcccccucgugggagcagguccuggcagagccuaagagcaagucacugccccuuccccguaccagaauaaguccucuaggcucgcagaaugaaauuauauuuuaaaaguuuguuucuacaucuauauauaaggagcacucccucuugguguaauuacugcaauuuauuccuucacuacccggcugccaggaccuucaagaggcgccacaaaacggaggcagggaaacccguagcaacgaggccccacccuuguug

SEQ ID NO: 14496 - RNA, 12956 nt, Homo sapiens
caacaaggguggggccucguugcuacggguuucccugccuccguuuuguggcgccucuugaagguccuggcagccggguagugaaggaauaaauugcaguaauuacaccaagagggagugcuccuuauauauagauguagaaacaaacuuuuaaaauauaauuucauucugcgagccuagaggacuuauucugguacggggaaggggcagugacuugcucuuaggcucugccaggaccugcucccacgagggggcggggccaagauggcgccgagcgccgggugagcagcgucucggcugccgcuagaguuuuccugcuccccgcgcucggguggcgggggcgggucugagugguaccccggaggagacccuuugaaggucccuuguggggacuggaaagaggacgguugguugugugucugugcucguggggaccccgugugugugccugcauuggagagauguugcaggagauggggugggcucucugaaccuccuuucgcgcugcccggggaucuucgaccugcuucucugcugggaucucgcuuaaguuaacccuucccugggacgccuuccugccgccuccacugaucugaggagauccugugacuguagcguguuuuaugagccuuuacuggcagaggguaccgccggguauugaaggauucguaggaguucgccagggaagugggacacgacccccucuuguaaacccggcgccaggcacagaguaugucucgaauaguuguguucccuauagauaagacuuauaaaagucggggaggagaucagggaugguuugaaaagaaccaauuuguuuuucggccucccucuucccauccuuccagcacggccccacccuaccuguacuacuccuaagcaguauugauauguuaaucuuccuaauguccaacugcaagugugccacuuuaauuuuuuuuuguuuuuuuuuugagacaggguuuccgucuguuacccaggcuguugugcaguggcaccaucuuggcucacugcagccuccaacuccucaguucaagcgauccuccugccucagccuccuaaguagcugggaugacagguucacaccaccagguccgucuaauuuuuuaauuuuugcagaaaugggggucucacuauguugaccaggcugucucaaacuccuggccucaaacaauccccccaccucugccuuccaaagugcugggauuacuggggugaguuaccucucuuggcuccaauuugcuuuuuuuuuuuuuuugagauggagucucucucuaucgcccaggcuggagugcaguggcacgaucucgguucacugcaaccuccgcuuccugguucaagcgguucucccaccucagccucccagauagcugggacuacaggcgcccgccaccaugucugguuaauuuuuguguuuuuacaaaaagacaggguuucaccauguuggccaggguggucucgaacuccuaaccucaggugaucuucccgccuuggccucccaaauuacaggcgugagccacugcaccuggcuccacuuugcuuuuuuuguuuuuuuuuuuuuuuugagacagagucuggcucuguugcccaggcuggagugcaguggugcgaucucggcucacugcaagcuccgccucccgggcucacgccauucuccugccucagcagccucccgaguagcagggacuauaggugccugccaccaugccuggcuaauuuuuucuauuuuuuaguagagacgagguuucaccuuguuagccaggauggucucaaucuccugaccuagugauccgcccgccucggccucccaaagugcugggauuacaggcgugagccaccacggccggcccaguuugcuuuuaacuacaguguaggcucaaagcuugggccuaugaccuauuaauaauagugauaccaaguauuuacugagcaccaauaucucuaagccuuacaacuaauucauuuacuucacaaauauuuaugaugucccaggcugggcuccuggaauacaucagugaacauaauaaagagcucugucggccgggcacaguggcucacgccuguaaucccagcacuuugggaggccaggguggguggaacaccugaggucaggaguucaagaccagccugagcaacauggugaaaccccaucucuacuaaaaauacaaaaauuagccaggugugguggcgcaugccuguaaucccagcuacgcaggaggcugagacaggagaauugcuugaaucugggaggcggagguugcagugagccaagaucgcgccauugcucuccagccuggacaacaagagugaaacucuagcucaaaaaaaaaaaaaaaaaaaaagagcccugucuagaugguggacggagacggggucucacucuguugccaggcuggagugcaguggcacaaccucuacucacugcaaccuccaccuccuggguucaagcaauucuccugccucagccucccgaguaucugggacuacaggugcacaucaccacgcccagcuaauuuuuguauuuuuaguagagaugggguuuaaccauguuggccaggauggucucgaucucuugaccucgugaucugcccaccucggccucccaaaguguugggauuacaggcgugagccacugcgccaugcccaaaagauguuaaaugcuauggaaaagaaaaagugggcugcccccacucugagggcagagugcagaguuaaauaggguggucaggguaggcagccaauuagauauuugggaagaacauuccaggcagagggaaugcagcaaaggcuauuaagcaaguacauaccuggcaaguuuaaggagcagccagaaggaauguaugugucuggaucaaaguggaagaaggaagggcguucagagauauaauggggagaagguaauuuugaagggcuuuguaggacauuauaaggauuucgucuguuuuuuuuguuguuguuguuguuguuuuugagaagaagucuugcuuuguugcccaggcuggagugcaaugacacagaucuuugcucacugcaaccuccgccucccggguucgagugauucuucugccucagccucccgaguagcugugauuacaggugcccgccaccaugcccaucuaauuuuuuuauuuuuaguagagauaggguuucaccauguuggccaggcuggucuugaacuccugcccucaagugauccgcccaccuucgucucccaaagugcuaggauuacaggcgugagccacugugccuggccugagaugggguuuugcuauguugcccaggguggucaggaauuccuaagcccaagcagucuucccaccucacccucccaaagugcacagauuacaggcaugagcugagccacugcaccugcccauuauaaggauuucagguuuuacuuuauggcaaguggagagccauuaugaggguuugagcaaagaaaugacaaucugcuuuacaguuugacagaagcauuuuggcugcaacguuaggaauagauguagagaaaggcaaggguagacuccgguugacauuguuaggagguuuuuggaguuacccaguggauagaugauggugaccugggccaagcagugggagcagaggagucagguuggacuaccugguggauugauugauuuuugagacagagucucgcucugucgccaggcuggaguccaguggcacgaucuuggcucacugcaaccuccacuucccagguucaagugauucucuugccucagccucccgaguagcugggacuacaggugcgugccaccacgccaagcuaguuuuuguauuuuuaguagagaugggauuucaccauguuggccaggauggucuccaucucuugaccuggugauccguccgccucggccucccaaagugcugggauuacaggugugagccaacgcgcccgaccggauuuauuuuuuuaccuuuuuuuuuuuuuugagacagaguccaucugucacugaggcuggagugcaauggcgcaaucucaacucacugcaaacucuacugccgaggcucaagugauucuccugccucagccucccaaguagcugggauuacaggcacgcgccaccaugcccagcuaauuuuuguauuuuuaguagagaaaggguuuuaccauguugcucaggcuggucucgaacuccugaccugaagugauccacccaccuuggccucccaaauugcuggaauuacagacgugagccaccgcaccuggccuaccugguggauuugaugugaaggcucagauaaagaacaagugucuggauggauggcauugcuaugaagauaaggaaagcugagccugggccagacacuucggcucacgccuuuaauuccaacacuuugagaggccaacgcuggaggauugcuugagcccaaaacuucaaaguggugggauugaagcccugagguguaacagaaaaagauaaaaaucugggcugggccugguggcucaggccuguaauuccaacacuuugggaggccgaagcaggaggacugcgugagcccagcaguucaagaccagccuggacaacauagugagacucugucucugccccugccccugcaaaaaauuggcuguguguagugguacacaccuauagucccagcuacuugggaggcugaggugugaggauugcuugagccuaggagcuccugggcucuaucaguuuucccaccucugccuccugaguagcuagaacaacagcccugugccugcauacccagcuaauuuuuguauuuuuuguacagauggggucucacuguguuguccaggcuggucgugaacugcugggcucaagcgauccuccuaccuugggcucccagaguguuggaauuacaggcaugagccacuaggcccaguccagauuuuuuuuuuuuuuuuccugagacggagucacccuggcuggagugcaguggcgugaucucggcucacugcaaccucugcccucugguuucaagugauucucgugccuuagucucccuaguagcugggauuacaggugugcacuaccacgcccugcuaauuuuuguauuuuuaguagagaugggguuucuccauguuggccaggcuggucucgaauuccugaccucaagugauccgcccgccucguccucccaaagugcuggugggauuacaggcgugagccacugaaccuggccccagcccagauuuguaucuuucucuguuacaccucagggcugacucacguggggauggacauaagacacucggaguuccuccccugucuccacuguccucccuuuguuggcccucucccugugucucacguuucuuuuucuucugccugccccguuccucugccagggucuccgucucuccaccgggggcuucauccuuccagggaggagaagagggacuccagaauggcugaggagaagaagcugaagcuuagcaacacugugcugcccucggaguccaugaaggugguggcugaauccaugggcaucgcccagauucaggaggagaccugccagcugcuaacggaugaggucagcuaccgcaucaaagagaucgcacaggugacccggcccuucuguccagcucuacauuggguccaugucacccagggccccguccuuaggauuuugggcugaugucuguucugucaccgaccccaggaugccuugaaguucaugcacauggggaagcggcagaagcucaccaccagugacauugacuacgccuugaagcuaaagaaugucgaggugauuuggggagacaggcggggggggggugagacgccauccuucagccaggucuccuccggcucccuucuuacccaugccccucucuccugccacagccacucuauggcuuccacgcccaggaguucauuccuuuccgcuucgccucuggugggggccgggagcuuuacuucuaugaggagaaggagguugaucugagcgacaucaucaauaccccucugccccgggugccccuggacgucugccucaaagguugggggaggggagagcaggguggcagggaggagggaaaggaggacagauguguguaggugugaggagccucacaauagaagaaaagcucagugugagaucccuggugaguugcaaggggagcaggaguggaaacacgcuuccauagcauggggcaacuccccaauguccaugcguggcaauucaccuugacaccugccuuccuugcagcucauuggcugagcaucgagggcugccagccagcuauccccgagaacccgcccccagguaaccuccaugccccacccucugggucucugggucccuuuccccuuccuuccaccuuuuuuuuuugagacagagucucacucuguugccugugcuggagugcaggagugcuggagugcaguggcucaaucuuggcucacugcaaaccugugccuccuggguucacgcgauucuugugucucagccuccugaguagcugggacuacaagcacacaccaccacgcccggcuaauuuuuuguaauuuuaguagacacgagguuucaccauguuggccaggcuggucucgaacuucugaccugaggugauccacccgccuuggccucccaaagugcugggauuacaggcaugagccaccgcauccggccuccucccaccuuuuacuuuucuacuaugcucaucaccccucccgcugugccugcuuucccaccagcucccaaagagcaacagaaggcugaagccacagaaccccugaagucagccaagccaggccaggaggaagacggaccccugaagggcaaaggucaaggggccaccacagccgacggcaaaggucaguccuccuaggcuaggccucucuggacucuugcccaaagccacauggccguuuguuuuguuuccuuuuuuuuuguuuuugagacagagucucacucugucacccaggcuggaguguagugguacgaucucagcucacugcaaccuccaccuccaggguucaagcgauucuccugccucagccuccugaguagcugggcuuacaggugcccaccaccacgcccggcuaauuuuuguaauuuuuuuuaguagagacaggguuuugcuauguuggccaggcugguuucaaacucagccucaugugauccgcccgccuuggccucccaaagugcugggauuacaggugugagccaccaugccaggccuccauguggccauuggugaaguggcugaggucagggccagagccccagaaaggaugggggagccuaagaagaagccaggucuccugggucucaggggaaguggaggguuaagguucuucuguuacugagguuucuucuggagcuuucuuugucagacccaccuuuccaaucacacagggaaagagaagaaggcgccgcccuugcuggagggggcccccuugcgacugaagccccggagcauccacgaguugucuguggagcagcagcucuacuacaaggagaucaccgaggccugcgugggcuccugcgaggccaagagggcggugagggccccaccagcuugcccuggcccugagacgccuccuccugggggcccuaugaauugcuccccacaucccacccccaccugacuggcuucccuccucccacaggaagcccugcaaagcauugccacggacccuggacuguaucagaugcugccacgguucaguaccuuuaucucggagggggugagagcaugagguuccacagugcagggacggcaguggaagcuccugugagggucucccugccccaugcccagcacuucucccucccacagguccgugugaacgugguucagaacaaccuggcccuacucaucuaccugaugcguauggugaaagcgcugauggacaaccccacgcucuaucuagaaaaauacgugagugauccugcccauccucccuuccagggacuagggacccugcugccaccaacaggaagucaguggucagcaguggcucacaccugaaaucccagcaacuuugggaggccgaagugggaggauugcuugagcucaggaguuugaggacagccugaggacaguagugagacugcuaucucuacaaaaaaaauuaaccaaaacaaaauuagccaggcaugguggugcacaccuguggccccagcuaccugggaggcugagaugggagaauugcuugagcccgggagauugaugcugcaguuagccaugauugugucccugcacaccagccugggugacagagcaagacuuuaucucaagcagacaaacaaaaccagaaucagcugucccgcccuuucucccuuagguccaugagcugauuccagcugugaugaccugcaucgugagcagacaguugugccugcgaccagauguggacaaucacugggcacuccgagacuuugcugcccgccugguggcccagaucugcaagcauuuuagcacaaccacuaacaacauccagucccggaucaccaagaccuucaccaaggugagccaggaaaacuugagcgucauuugcuucaucacuggccaccucugguugggggaagucacacuggaaacaagggggcagagggaagagggacuggaacuugugggggucuaagggucuugaggcuugucuguaauaccuuuuuuuuuuuuuuuugagauggagucucgcucuugcccaggcuggagugcaguggugcaaucucugcugaccgcacccucugccuccuggguucaagcgauucuucucccucagacucuugaguacuugggauuacaggcaccugccaccacaacuggcuaauuuuuuuguuuuuguuuuuuugagauggaguuucgcucuucuugcccaggcuggagugcaauggugcaaucuuggcuuaccacaaccuccgccuccuggguuccaaugauucuccugccucagccucccgaguagcugggauuacaggcaugugccgccacacccagcuaauuuuguguuuuuaguagagacgggguuucuccauguuggucaggcugcucuagaacucccgaccucaggugaucugccugccuuggccucccaaagugcugggauuacggguaugagccacugcaccuggccacaacuggcuaauuuuuguauuuuuaguagagacagaguuucaccauguugacuaggguggucuggaacuccugaccucaggugaucugccugccucggccucccaaagugcugggauuacaggugugagccaccacgucuggccucauuguaaugucuuaaugauuuacaaggaaagugucuaugaaagacuuaggucccugucaaucauccuuucagaccccuucaucuuaguuuauuuccuuccccuuacagagcuggguggacgagaagacgcccuggacgacucguuauggcuccaucgcaggcuuggcugagcugggacacgauguuaggccucugggaggaagaaaugggggaggggacacagucaugagguuauagagggcacuguacccccaucugggagacccuggugacccuccggcuuuugcuuguccuuuucccuucuaacagguuaucaagacucugauucugccccggcugcagcaggaaggggagcggauccgcagugugcuggacggcccugugcugagcaacauugaccggauuggagcagaccaugugcagagccuccugcuggugacugaagccccuguccccacaccugcccacugagacacaggcaguguuuagcaagcauauggcauauuuuauucacuuacucccaucuuugccucauguuuucagaggacauugcagagucugauacuauuuuacagauggaaagacugagauuagacugaguaagaaauaagggggcugggcaugauggcuucugccuguaaucccagcacucugggagccuaggaguaugaggccagccuggacaacguagcgagaucccaccugcaaaaaaaaaaaccaaaaagccgggaguggugacgugucuguggucccagcuacuagggaggccgaggugggaggauugcuugaacccaggaguucaaggcuacagagagcuaugaucgugccacugcacuccagccuggguuacagagggagaccaccgccccccaaaaaagaaggguuuaacacgcucagccuguggcauuuggaccauccuuccccaaugcuccuguuacucuguggucuucucuguacaaggcaaaugcgcucuugauuaaccauccugccacaguauuuagcaaguucauucacacauuagugcccauguuuucuuuuucuuuucuuuuuuuuuuuuugagauggagucucacucuguaacccaggcuggagugcaguggugcgaucucaggcucacugcaaccucugccucucagguucaagcaauucucaugccucagccucccaaguagcugggaccacaggcacgcgccaccaugccuggcuaauuuuuuguauuuuuaguagagacgggguuucaccauauuggccaggcuggucuugagcuccugaccucaggugaucugccagccucagccucccaaagugcugggauuacaggcaugaaccaccacacccagccauucuuuuuuuuuuuuuucugagacagucucacucugucacccaagcgggagugcacugaugcaaccucugcucacugcagccuccaccaccuggguucaagcauucuaguaccucaaccuccccaguagcugggacuacaggugcgugccaccaugccuggcuaguuuuuguauuuuuaguggagaugagguuucuccauuuuggccaggcucuugaccucaagugauccacccaccucagccucccaagugcugggauacaggccuaagaugcugcaccuggccccgugcccaucuuuucuuaugagaaagcccacaguguucuguacacacacuaauaguucagcauaauuuggccuucaacaggggcacugagaugauaaggaauguccuuuuuuaccccauccccaagguucuucucaagagugucaccagcccucccucuaccuggcuuuuuuccccagcccucccucuaccuggcuuuuuuucuguucugcagaaacacugugcuccuguucuggcaaagcugcgcccaccgccugacaaucaggacgccuaucgggcagaauucgggucccuugggccccuccucugcucccagguggucaaggcucgggcccaggcugcucugcaggcucagcaggucaacaggaccacucugaccaucacgcagguccguggccggguggggaggaggaauaggaggaagcagaggagaaccccugugugggacaggcacuugcacacagccacaugugcccucagucaguagucucagggcaaccaggcccugagugaggaugccccagcccuagugagagccacugaggaagagcgaggggagcccaggccucucccuucagacuccucuucuuaguagauggugccacuucccccuuuccucuucuccccgcagccccggcccacgcugacccucucgcaggccccacagccuggcccucgcaccccuggcuugcugaagguuccuggcuccaucgcacuuccuguccagacacuggugucugcacgagcggcugccccaccacagccuuccccuccuccaaccaaguuuauuguaaugucaucguccuccagcgccccauccacccagcagguaugcagagcugugggacagggagcaucuggagggccuggguuaccucagagcacccuggggaggcccaggaguagagcacaguccccucugggccccaagucaagagcuggaagaggcgcccaccaggguccugcagggcuguagcugcccugcaugaacaaggucuccagccauagcugucuacagggugaacuacaggaacaacuuguucaggcagggagcgagugaagcguccucgccaggccucuggggggcagggagggcacagggcaagcggccugccuuuccuuucuauccagguccugucccucagcaccucggcccccggcucagguuccaccaccacuucgcccgucaccaccaccguccccagcgugcagcccaucgucaaguuggucuccaccgccaccaccgcaccccccagcacugcucccucugguccugggaguguccagaaguacaucguggucucacuucccccaacaggggagggcaaaggaggccccaccucccauccuucuccaguuccucccccggcaucguccccguccccacucagcggcagugcccuuuguggggggaagcaggaggcuggggacagucccccuccagcuccagggacuccaaaagccaauggcucccagcccaacuccggcuccccucagccugcuccgugaugcuccaccugccagcccccggauucccacacaugcagacauguacacacgugcacguacacacaugcaugcucgcuaagcggaaggaaguuguagauugcuuccuucaugucacuuucuuuuuagauauuguacagccaguuucucagaauaaaaguuugguuuguaaguucugauccacugcaguccuuccugcaucagauaccacagaaaggcugggcccauugcccccuccuggucuugggacugaggacucuuccugcccagauucagaguccgaaggccaggaggcuggaaaagaaacgacuguccucccgugggacaaacugccaccuuggccgucguguccucguuuggggagccucagauccgaaugacauaggcgucgcuguggcuuaggugucgcacccacuuguggggguuggcauugccgcauggccugaaggccagccugaggaaucggaccuggaggccagagcacgugugccggggaagcucgaaggagagacuggcagggcccagccccagaggagaggccgagguggagagcccauggcugggagguccugggggcccugggacguccaucugu

SEQ ID NO: 14497 - RNA, 5483 nt, Homo sapiens
caugucccugggcuggagaacaucagacucauguuuauuagggagugagggagcacaaagggaggucuccuugcccuuguucuccuuaacacagcucagaguccccaagccugggcccguccagguaggggugggaggugggcgagcagaaggcccuaguucuagcagcaagccaagaccgacaggugugccugccucaucacagaggcccaggacccaauccgcuucuccgacccucgcccuccggcaggcucagacaucaaugggcucccgaccucgguucugccucuucaccacaaacacccucuguccugacaccgucaccagcaguguguguucuccaaagaccacuggaggagagacacaccuucccccgccccaggagagggaagggagcacagaguuagugggugcaacagacuccauggggcggggccacacgcacauuggcugggaucaaagccaaagaaguucuauaguuccaggcucagagauuugaagaugaguggccucugcuagaucuccuuucucuugccuucucauucacaauucugauaccagggagucccaaagggaggaaaguggccagaccagagaccccaggagaugguaggaggcuggaagaagagaagccgagaagccccuggaaguagccccccgcucccaguaccaccaccaagggcaggggcaggggcucaccagacaggcgcuugaagggcacauucaugccgcggugcagccggaaaccgcaggcugugcugaccagcucagagauggcacuggcugccugcucaucauucuccagguccccagaugacugcaugcagacggaggagggagaggggcgggcauuacggcacaggcucaggaaggaauuccaggcacaguccccuugguucucacacuuagacccucucccccuuggcuugccaguacccucagcuuuggaaaaaaacaaccugaaaucucccccuauaauguugucacccuccggaugccauccuguuucccauaauacuggccuuccccggaugagcaguaacuuauccaucuuuuuuuuuuuuuucuuuuuugagacggaaucucguucugucacccaggcuguagugcaguggugcaaucucggccucucggguucaagugauucuccugccucagccucccaaauagcugagauuacaggcacguaccagcaccaccacaucuagcuaauuuuuuauauuuuuaguagagacgggguuuuaccauauuaaucagcuggucucaaacucuugaccucaaaugaucugcccgccucagccucccaaaaugcugggauuacagacgugagccaccgugccuggccauccaucucuuuauugaccaugcuuuucuaaccccauaaaacuggauuucucccaugucccugccuauuugauaaagccacauucuccaaaaugaaugccugcccaccacuuaccuguuaauggcuccaucuuuuucugucuucacacuugcugcccuguuugcagaaucucaaacauaaacauucccuuuguccuugaauaccucccucuguugaccccuagaguaagugaugggacaguggcuugggcuuccucuuuucuggugacugucucaacuuccucuucccucuuccuugauaugggccuccacuagauuuaguuccuuuugcugaacuagcaauauauauuaacugcuauuuuauaucaaacucaaugucuaaaguugggccaucaaauuucaccuuauccuuauccaccuccuucccaauccacuucuuuuuuugauuuccuguuuguuuguuuguuuuuugagacagagucucacucuaucacccaggcuggaguacaguggugcaaucuuggcucacugcaaccucugccuccuggguucaagcaauucuccugccucaaccucccaagaagcugggauuacaugcaugugcuuccaugccaggcuaauuuuuuguagagaugagguuucaccauguuggcuagggugcucucgaacucccaaccucaagugauccacccaccucagccucccaaagugcugggauuaaaggcgugagccaccacgcagggacauguuucuuaaggcaucaucacucuuccaggcuuuagaguucuggcuacagaaauauuuccucuauuaccuauuucuagucauuagcaagauauacugauuccuccuuuaaaauaacuucuuccagccaagcacaggagcucaugccuguaaucucagcacucugggaggccaaggcaggaggaaugcuggaggccaggaguuugagaccagccugggcaacauagcaaggccccugucuccacacauuuuuuuuuuuuuuuuaauggcugggcgugguggugcuugccuguaguucuaguuacuugggaugcugaggcgggaggauugcuugggcccaggaguucaaggcuacaaugagaugugaucguuaccacugcacuccagccugagugacggcgagacucuaucuuaaaaaaaaacaaacaaacaaaaaaacaggacggggugcuguggcucacaccuguaaucccagcacuuugggaggccgagguaggcggaucacgaggucaggagauccagaccauccuggcuaacauggugaaaccccaucucuacuaaaaauacaaaaaaguagccgggcaugguggcgggcgccuguagucccagcuacuagggaggcugaggcaggagaauggcgugaacccgggaggcggagcuugcagugaggggagacugcaccacugcacuccagccugggugacagagugagacuccgucucaaaaaaaacaaaaacaaaaacaaaaaaacaggccgggugcaguggcuuaugccuguaaucccagcacuuugggugggaggcugaggcgggcaaaucaugaggucaggaguucgagaccagcccggccaacauggugaaacccucucucuacuaaaaauacaaaaauuagcugggcaugguggugcacaccuguaauccuagcuaaucaggaggcugaggcaggaaaaucacuugaacccggaagacggagguugcagugagcugagaucaugccacugcacuccagccugggccacagagcgagacucugucucaaaaaacaaaaacaaaaaaaaacaaaaacaaaacucuucucuccuugcuccuccuucuuaccaccacuugcccagucucaucucuuuuuuuuuuuguuuuuuuugagacggagucuugcucugucgcccaggcuggaguacaguggugugaucucggcuaacugcaaccuccaccuuccagguucacgccauucuacugccucagcuucccgaguagcugggacuacaagugcccgccaccaggccuggcuaauuuuguuuuuguauuuuuaguacagacgggguuucaccguguuggccaggauggucucgaucuccugaccucgugauccgcccgccuuggccucccaaagugcuagaauuacaggcaugaaccaccacgcccagcccagucucaucucuuaaugacgccuccuucugcccaucuucacaucacuaacaacaauauugcucaaccaccucacugggucuuguuucuguuuuaaaaaaccuuucaaacuguauuaccuucaagaauaaguucaaguguguuaaccuggccuugaagauccuucacaauuacauccucccugaccauauccuccucucuucccucaaaccuucccaaaucuuuucagcauaaacuuaccaucaguucagauagguuagugccacacaccugcaaauaaguccucccccacuguaaauacucuccuuuaaggugggcugaauuccuaccucccggaaaguuaguuaccuugucauaacauguugaauuuuuaauauccuggauucccucaauagucuuuaccaccuguauuguuuucaacccuuaaccuuaagcuuugucucuaccuaagucaaaaacaucuggagacuuaacacuauacaguacuauggaacaaaauacaaaugccucuuuaagaaauaccaaauaaaggccagacgugguggcucacgccuguaaucuagagaccuaacaccauacaguacuauggaacaaaauacaaaugccuuuuuaagaaauaccaaauaaaggccaggcauguuggcucacgccuguaaucccagcacuuugggaggcugaggcagguggaucaccugaggucaggaguuugagaccagccuggcuaacacggugaaaccccguuucuacuaaaaauacaaaaaauuagcagagcaugguggcacgugccuauaaucccagcuacucgggaggcugaggcaggagaaucgcuugaaccccggaggcggagguugcagugagccgaggucgcaccacugcacuccagcuugggcaacaagaacgaaacucagucucaaaaacuauaaauaaauaaaucgcagccguuaggagacuaagauuccacagacugauuacugaaaguaauugcaaaaacugcaaauacuuuuguaccaaccuaauagaugccaggcaggaaaccagauaaaagccgagaaaagaagggccaauauuagaagggguuaccgggcugugugcacuaagggacccccucccuuucccagaacgcaccgccagcacugcaccuucacucaguaccagguagccgagcuggucugggauucgcuccagccccugggucagcgcagaagucuaguggguaaagaugcaagucgugagaagcaugcuagagggauggacggcccgauacccuucaccugcaaacccaagucucuggguugacgauggccccagguuuucucauuccccagccaggucccuucccggcccccuccccccuacaugguccucaauacugaucuucccgagccuccaucugcccccacucucgcccccgggcuccccuggccuuccacaucccaccuuugcuaccccaaggggccuuugcugccccacuggccccugcccccagacccucucuucaccucccuucgucuccgcccgaccugcagacuacccgcagccccagaacacccucccacagaccccuccccagcauucucgucgccaucccucccauuuccauccccucuuccuccccgagcggauaggaggugaggguggagcgcaggcccaccagggggaaaccacacagacuggggagcagagacgcugaacccccggcggguccucucgcgcaugcguccucacucaccaucgcagucuucggugcugggggagcucccuaccagauagguagcuuccggcuucaggccccggucacgugcuugcagccgcugcgcuccuccuucugcuugcgccacuggccuuuagccccgccucuagcaugaggauuggacaguggccacgucgucagacccaaccagccagugcgaagcgcuguuucccggaggcgcacguugauuggugauauccccucuuuaacacccaucuccc

SEQ ID NO: 14498 - RNA, 2521 nt, Homo sapiens
agaaacaggaagcggaagggagggggcguggccgccgaggccccggaaucugcgggugcccggaccguggaggagggggcggggucccgcugcucugaggcugcgagaaugcaggcgggggcugcggccaggcuucuuggaaaagaaauggaagaccucgucggccaggcggguuggcucacgccaguaaucccagcacugugggaggccgaggcggcaggaucgcuugaggccaggaguucaagaccacccuggccaacauagcaagaacuccucucugcaaaaaauuuaaaaauuauccgggcgcgguggcgcgcgccuguauucccagcuacuuagaaggccuaggcaggaggauccuuugagcccaggaguuugaggcugaagugagcuaugauugggacacuggacugcagccuaggugacagagugagaucuugucucggaaaaaaaaaaaaaaacaacccuuccaaccccacuucucccaggaagauucuccaucccuccccuuuccacccuccauaaaucaaguagaaguuucaaauuauuuauucauucaacaaacaugucagagagaaaugaacagucuaguagcaaauauuucauagagaaauggacguaucauuccaacucaccacgccccaaacuuccuguggcucacuccaucuuuugccccucuagggagcuucggugauguggaucugccuuggggcaggaaaggggaaggggaggucaggccuaguggcucacgccuguaauggcagcacuuugggaggcagagucauguggaucaccugaggugaggaguucaagaccagccuaaccaacauguugaaucccugucucuaaaaauauaaaaauuagccggguaugguggcacguaucuguaauccuagcuacucuggaggcugaggcaggagaaucgcuugaaccugggaggcagagguugcagugagccgagaucaugccacugcacuccagccugggggacagagcaagacuccguuucaaaaaaaaaaaaaguuggggggaaagaacaaaaugaguggaggguggaggagggaagcacugcugggagcccagcgaagagggggcuugcaucgggacaaagacucaucccuucugggagaugcagaaauggcaucuugcugccccccacucaucacaugugcccuucaaacauggcugcucuuccaccuaaaucuguagucugauguuuauggggagaguggccuugaagucuugaggggcagugagacgguaggggggaacugcuuggcauccagcuuguccuuguacuggagcucagggguagcuaggcgcucacauuccucuuggucuugggggcucaauccacuccgaaguauauagcccaaaaccuuagcugacccaaacuggaaggggcggaaccggcgaucagugauguauuuggggucagaagccucacccccuaccagacaauguuucgcuagggccucucggcgagcccggagcucggccacagcugucugcagccggcccuggccguauuucucuauccgugcccagagacugcgguugaaguggacauagagagcccaguccagguuguuccaggcucgggcccgugcagucagcugccgguccuccgcagucaguccacuguugcugacagugcugaggcccugcuuauguccagccugggcauugugcaugaagcccaccacgucaucuagaccccagcacagggcaucugccagcagaaccaaugacucaucgaaguacucagccaccaugaccaggucaaagacagaguccagccaugccagaccccacuggaugaaggaugaagaccccaaaucgaaagaggcagggcuugauaucuggcugcgaugaucaguaacaguggaaacaggauggaugagggcauugggauugaggguuugggcucgagggccagcaccagaaggcaagaccugcagcugugggggguuggggucucuggggggaugaauauucccucucuuggcccucuucucugggggaaagggcaggccaaagucaaaccauaguaaguugcgagcguagugguccccacgggccccaggccuguagaagccucgaggauuggccaggaaggcagccaaagauggugacuugcggaaggcugaugagguggauuuauaguaggagaaggcagagcgagccagagccgcugggucucggacaauggaaaaaaagaagcugucagaaggcaugaccugaaguaccugcagaggagggaagacagaagagagagaacugggcuggggagaagguaugcauaaguaugcacaagccauguguccgcugaccagccuccugaaaccuccuccucccagcucugcuaggaauccccagcuuccaucacuugcugaguggcaaguuacuuaacaucucugagacucaauuugcuuaucugcaaauggggauaaucauacuuucucaagugacuaugaaagauacaugagauaaaacauacaagaaaucuggagcauggagc

SEQ ID NO: 14499 - RNA, 7790 nt, Homo sapiens
cuccccgcucccauugucucggcagaugccgccugguccagcuaucgugcucgguauucaguuuuccggagcagcgcucuuucucuggcccgcggagcggucccgcggccgaguaccggauucccgaguuugggaggcucugcuuuccuccuuaggacccacuuugccguccugggguggcugcaguuauguccgcgcugcgaccucuccugcuucugcugcugccucugugucccgguccuggucccggacccgggagcgaggcaaaggucacccggaguugugcagagacccggcaggugcugggggcccggggauauagcuuaaaccuaaucccucccgcccugaucucaggugaggagaaagaggaagacuagagaauuggggguggggggcgggggcggggccuccucaucucacaauaacucucuuccuuuucagagugaccguuauacuaaucuuuucaucccacaguaaugucuguucuccuccuguaacuuccuuaccgggaucacaauaacccuccuaugcaaagaauagcgcucuuacuccauccccaccccaggaauccccuccuccuaauuaacacccccuauguguuucuuucuucacagccauguucuccucgcuguuucuauuagccccuucuaugagaauacuuuauugcucaccaaguaaccccacccuuccaagccccauucuucauccccuagaagcuguucuccaagucccucgaggucugggguguggacauuggggagggucaccugaggacacucugaccacugacuuggcccucagggcagcuguuaaauagaugaucccguggcuaaugggagugaacuugggaugggucaggagacaauaagguaggggauagguucagguagggaagagggugcagacaauagaaaagagaccaggcagguagaagagaaggcauaguccccagagauaggcgggaaauggaagggauuuuaggauaucacuucccaccauuccuucacgucuccucuguccaggugagcaccuccgggucuguccccaggaguacaccugcuguuccagugagacagagcagaggcugaucagggagacugaggccaccuuccgaggccugguggaggacagcggcuccuuucugguucacacacuggcugccaggcacagaaaauuugauggugaggaccugggguccccaaacucagcuucacagcuccucucggugcuuaggaccccagcaaggcuccuguccccacuccuuacuccaucugugaagacuccauccccucccagcccgcccaccccccagacucugucuccagggcccugcccucccccauucccugucugccccaucucugagaguuacucaguuucugauucacuugucuuuucucuucucucccaucuccuccugccucugccuguucacuuuucuccccauucuuuggccugaccugccuuccaccuguucccugcauuugcugcagaguuuuuucuggagaugcucucaguagcccagcacucucugacccagcucuucucccacuccuacggccgccuguaugcccagcacgcccucauauucaauggccuguucucucggcugcgagacuucuauggggaaucuggugagggguuggaugacacccuggcggauuucugggcacagcuccuggagagaguguucccgcugcugcacccacaguacagcuuccccccugacuaccugcucugccucucacgcuuggccucaucuaccgauggcucucugcagcccuuuggggacucaccccgccgccuccgccugcaggugagggauccugaggccugagcuucaaccacuucugaccuagugaccccugaacugugcaccacucaccuccaaacuggcgugcuccagucaccucugaccuggugaucccccauccugcauugaagccauuucugaccuggugaucccuauccugagcuuuacucaccacugcccgacccagugccccuuggucuucuugaagcagaugcccccaccccugccaccucccauucugagcccuaguuucacacaaacacucaccugcccuuagccuccagccaccuuugugccaaccccuuccuaaucguaacaccuugacuuccucugguucaacuaaacaggaauugugcauucaauacgcaaaaggcauuuucuuuuauaguaucacauuuaguugucaucauaacccugugagguagacagucaugcccuuauuuuacagaugagaaaacugaggcucccagagauuaagcuuuucagccaguaaguggcagagccguggcucacacccaggucuucuggcuucaaguucaguguuaguuccgauacacaauuucucucucucuaagcccuguacaacauaaucccuccaucucuucccaagccuuccuuuguuuuucuuuaagacuauaauuccugugggggcucuugaaccugccucucuguaccacccaacacucgacccacucugagagaaccccacacacccaacccucacugcucuugaugcagucucuuggcuccagucuugacugacccauaacaaccuugugguuuuucucaccuucuuugccuucucccagauaacccggacccugguggcugcccgagccuuugugcagggccuggagacuggaagaaauguggucagcgaagcgcuuaagguuggagggugccugaguaugggcagggcccagggagggagagguggaagugagagagaccccacaaggaagaaacagccaccagccagcaggacaggccuugggcucugucugccuccaggcccugguguccuaggaugaauuaggaaggagggggcuggagugaaaccuccaaugguccacgauccaugaucucugacccccuccuccccucuguggacccauacccuccucaguccccaagggccugcucaucuccauagcaguaggagauuggauacugcccccgcccaaccccccaggaucccucaaugacuccacuucccugcugcugaaggccagaugccuggcuuggccucucucacugcccauccucuaccugaccucccagccucaccuucugccuccugaccgccuccucccuccccagcugugaugggcucacucuuguccuugaauguucccuccaccccuaacugccucucuauuuccaccccucccacgaaucagagucagcaaccuggaaccucccuccucagaucugugacaaucucaccugcugccacguggggucaccaacccuagguguagggugggguaugugauuucugucugugcccagcaccaagccaggcugagagcagccacagcguuuguggaggacacagccccacucucugcccccaggugccggugucugaaggcugcagccaggcucugaugcgucucaucggcuguccccugugccgggggguccccucacuuaugcccugccagggcuucugccucaacgugguucguggcugucucagcagcaggggacuggagccugacuggggcaacuaucugggugaggggauucaagaaagccuggagccaggcaugguggcucacaccuguaaucacagcacuuugagaggcugaggcaggaggaucacuugaggccaggaguuggagcccagcuggggcaacauagcuagacgucaucucaagaaagaaagagagagagagaaagaaagagagagagagagacagagaaagaaagaaggaaagaaggaaggaaagaaagaaaaagaaagaaagaaagaaagaaaagaaagaaaucagccaggcaugguagcgcccgcgccuguagucccaguuacuccugaggcugaggcaggaggaucacuugaggccaggaguuggaggccagccugggcaacguagcuagaccgcaucucuaccaaaaaaaaaaaaaagaaagaaauuaucaggcaugguggcacacaugccuguugucccaguuacuccagaggcugaggcaggaggcucccuugaucccaggaguuagaggcugcaguaagcuaugaugaugccacuauacuccaaccugggcgagagaguaagacccugucuaaaaaaauccuaaaauuggccaggcacgguggcucacgcuuguaauccuagcacuuugggaggcggaggcaggcggaucacaaggacaggucaggaguucaagaccagcuuggccggcugggcaugauggcucaugccuguaaucccagcacuuugggaggccgagguggguggaucaagaggucaggaguucgagaccagccuggcuaacauggugaaaccccaucucuacuaaaaauacaaaaauuagccaggcgugguggcaugcaccuguagucccagcuacuugggacgcugaggcagaagaaucacuugaacccgggaggcagagauugcagugagccaagaucaugccauugcacuccagccugggugacagaugagacucuuuuuuuuuugagacaaagaccagcuuggccaauauggugaaaccccuucucuaccggaaaaaaauauauauauauacacguauauauauacacacauauauauacguauauauauacacacacauauauauauacacacauauauauacacacauauauauacacauauauauacguguauauauacauauauauacacguauauauauauacacacacacacacauauauauauauacacacacacauauauauauauacaaaaauuagccggcaugguggcaggcgccuguagucucagcuacuccggaggcugaggcagaagaaucgcuugaacccaggaggcagagguugcagugacccgagaucgcgccacugcacuccauccagccugggcgacagagugagacuaugucucaaaaaaaaaaaaaauccuaaaauccuaaaauuuaaauuuaaauuuuaaaaaagucugggauggaggaggguccugaguaaggcugggggugaaauggagaggggcuuuaaagccaaauuggggggauacaugagagggagcucaugugaguuucccccaaacacuuugcugcuucucuaaggcccgagugaggauuuucaggaacauccuaguucaguaucaccacucaucccauccuuucucuuucucucccucccuuaagauggucuccugauccuggcugauaagcuccagggccccuuuuccuuugagcugacggccgaguccauuggggugaagaucucggaggguuugauguaccugcaggaaaacagugcgaagguguccgcccagguacaggggagagaaggguggaggugaggcccggggcggggacggugugggugucagagaggcaguauaggggaucugggaagagacucuggggucagaguggggacgcagugugguuuccccccagggugacugugugaggucucuucccggugccgcagguguuucaggagugcggcccccccgacccggugccugcccgcaaccgucgagccccgccgccccgggaagaggcgggccggcuguggucgauggugaccgaggaggagcggcccacgacggccgcaggcaccaaccugcaccggcuggugcgugggaugaccaagaguugggggcgggggggcccggggccggggaugguugugggggucgcgcuccagcucgccccgcccccucucgcccgcccaggugugggagcuccgcgagcgucuggcccggaugcggggcuucugggcccggcugucccugacggugugcggagacucucgcauggcagcggacgccucgcuggaggcggcgcccugcuggaccggagccgggcggggccggugagccucgggggcgucggggggcagcagggggcgggaccgcggccgggaggggcggggccgcgcgcgcuagcuggcgcuucggggcugcucugcucgcagguacuugccgccaguggucgggggcuccccggccgagcaggucaacaaccccgagcucaagguggacgccucgggccccgaugucccgacacggcggcgucggcuacagcuccgggcggccacggccagaaugaaaacggccgcacugggacacgaccuggacgggcaggacgcgggugagaccccugcaucccugagccugagccccgcccacugcccugaagccucuccccucuccugguaguucccgcccgugccucugcucuuagcguucauugauuaauucacuaauucauucaacgagcauuuauugagcguugcccugaaagacuggggguaacagaucaaugagggggucuguauccuuucaggccaguaggggagacacgaaaacauucuuaaagaacagugggaagccccuuauaaugggcaaagggcagugggaaaaugggggagggggcaauuugggggaggcugggaagccaggguggugggugacauugagcuggcuccgcaggguggaguuugccaaacagagaagcaaggcacagacacucauuguuuucuucucuccuucuaucugucugucucugucucucuuugucacucuucccgcaccccucuuccuggcugcuuucugcuucuguguacuucugauuuuucuguuuuuuccuguuauccucucuccccaucugccuguuuuguuuuuuuuucucucugucucacugucucccaucaugaucucuccccccaugucugcugucggaucucucuccuuccuucucucccugccuuccugucacucauggucuuucucccuuccccaacccggcauccaccugugucucccucccuuuccucucucuuucuguuuuuaucucaauuucuuuuccucccucugucucccucugcuucucccucccauccugcucugucccucuucuuccuugcagaugaggaugccagcggcucuggagggggacagcaguaugcagaugacuggauggcuggggcuguggcucccccagcccggccuccucggccuccauacccuccuagaagggaugguucugggggcaaaggaggagguggcagugcccgcuacaaccagggccggagcaggagugggggggcaucuauugguuuucacacccaaaccauccucauucucucccucucagcccuggcccugcuuggaccucgauaacgggggaggggugcccuagcaucagaaggguucauggcccuuuccccuccuccccccucagcugggccuggggaggagucgaagggggcugcagagaggguagagaagggacuuugcaggugaauggcuggggccccaaauccaggagauuuucaucagagguggguggguguucacaauauuuauuuuuucauuugguaaugggaggggggccuggggguauuuauuuaggagggagugugguuuccuuagaagguauagucucuagcccucuaaggcuggggcuggugaucagccccaacagagaaaaugaggaguuuagaguugcagcuggggaagggguuugaaggaaguuggaaguggggaggggugggggcaucuggucucagaaauggaccagcuggaugcagggcaggggacugagggugcuugaguaggaugugagacuucaugggccuggguucuguugaguuuuuucaguaucaauuucuuaaaccaaauuuuaaaaaaaacaaggugggggggugcucaucucgugaccucugccacccacauccuucacaaacuccauguuucaguguuugaguccauguuuauucugcaaauaaaugguaauguauuggaccccaugu

SEQ ID NO: 14500 - RNA, 1674 nt, Homo sapiens
aucacauuguccaaaaguggagucccacguucuccagccgcggguaucugcccucuugugcgaggcagggcggcuugagcccagggaaggggucuggggaggacaggauguagucgaugcugaacuugaggucccgggggugcuccuuccccgggggagcggggcuggcggggggcucacggcccggggcgcccucgccagcgcuguccggggccaggcgccccugagcggcgggcggcucggacggacccgacggccccugggcgccccccgcgcgcggaccccucggccccucgcgcuuggggccgcgccgccgccgccgccgccgguaguugccguucucgaagagguccagcagcgacucgcagccgcccgcgaacguccaguaguugccuuugcccuucucguggcccucggaccgcggcaccugcgcgcgcggagggaggggcugggagcggcuccgcugcacggugcgcccgcccgccuuguccccucggggcgcccuggaccggggcgaggguggcgcacugcgcagguggaggcggccccgugggcugaggacggaccucccugaagccgccgcggugcccucccuuccccgccaccgaggcccuggcgcaggugucgccacgcugggacacccggggcccgucgggggcggcgcucaccuugacgaagcagcuguugagggacagguuguggcggauggaguucugccaggcgcgcugguuggcgcgguaauaggggaauuugcgcaugaugaagucguagaugccggacagggucacccuccccgcggggcucugcugaauggccauggcgaucaaggcgauguagcugcggagcccgggggucaggcggggucuccaccgggcagccccccguccuuccccccaucccgcaggacgccguggggcgcagaggcggaggagcgaggcgguguuggggaaaguguccccgcagcucgcgguccccggcgccacccagaccccagaagcucuuucccgaccugcggaggccccuccccgcgaggccaagaacccucccuggcucuccccaaaguagggacaaaugcguccuuucucugagcuccgccgccggagagaagaaagcucccccgcccuuccuucgucccaggcaggucccggcuaccugggacccuugcagggggugucacugucccccaaagccccagcaccgcccccgcagucaccuguacgcgggccgcgugagccucuugucuucgucggagcugccggcgggguagucgucggcgucguaauugaagcaguuguagggauacugcgagcugucaaacauccuggcgcgcucggcgcuugcugggggucccggcugcaauugccgccuccuccgcgccgcccgccggcuucgcgcagagcccucucuacgcggcccagcaacgacugcacugcgggcuucucuccgccggagcgggaaccugggcuccuggggucccccgccugcccccaccccguccucucgcauccaaucccggcgcgggggaggccccagccaccgguaaagcggccgaggggagcgguguggggcgucugggugacccucugaccgccgcggggggagggaggaggaggcggcgcgcugggugguccgacgggcggggcggcccccccuacccggcucccuuccuggggc

SEQ ID NO: 14501 - RNA, 5680 nt, Homo sapiens
aucagcuuuucuuacauuuuaugggaagguuuuuacaucaucaccgcaguuguccccagcuguuauuucuguagaaacaaauucgucagccacaggugcuggaguauuucauuguccuggcacccgacuaacccacacggcagcucgcacggucccaguccacaugagugcaauugccauguugaugucaacaagcagugacugaaccaccccggagcagacggcgggcgcuccacagaggggccuuccugcugcuccgggccgagcgcugcugcuccucgugggccuggugaggccgcacagcgccauugcugccauccuggaagauggaggacgcucaggcgugcaccagagcagcauguuuuccuucuccucuuuaacucggcggugcgcuagcuagcucagaccgugggcacagaggacacaccgcgacguccagcucagacccaccagcaccuugcaucuccagcgucaguucccccacgguggcagauuugcuuuaggguuccuguguaacugaggcgcuucacccacaguggccucuccguguggcuuuccuggucgacggugucagaaauguuuccugcagcggcaggcaggugcagcggcaggcaggguuggcggggaggagcugggugacaggcuggucaccgcuggccuuuggacccugcggggcgagcgcuuugggauuguagcaauucugugugaggagugcaaggugaccagucgugagguuuccuaagcagccccagggugaccaggcaagcgugacccucgcgaggccccgaggagccagaagccacaucugaccgcaguuuagagacaugacguggccgugccuuguguccacccaggugugugcagcucccgagucacacccuggcugggccuaugcggccaaggcugucuacacggcacugcugaaccucacauccgacugcucggugcugucuggaaugacggccuucagggcagcgugacagaagcgguucagggccggcaaauuuguuuucugcucaauguacagccucagcuugucccugaaggucuccccgagaaagcuguagaugaggggguuuaggcagcuguuggagaaggcggcgagguugacaauguggcccgugagggggugggcauggcggaaagacugcuugcagggagcggccccaggcugcguccgcugcaggaggugcacgcugaugaagacguucuccggcagccagcagacgaagaagaccagcaccaccgcgaggaucaugcggagcgccuucugccgccggggccgcagcccacggugccggugcgcccugaccagcacccggacaaugagggaguagcacaggccgaugauggcgaagggcacgaugaagcccagcgugaccucgagccacugcaccucccggacauccgcgaaacagaagcaggccucgucggugugcugcaggugcacggcggugaagggcaccagcguggcugacacggaugccauccagaugaggccacagcucagccgggcguggugcuuggugcggaacaggcugcagcgcauggcccuggccagggcgauguagcggucgaagcucauccaggugaggaagaagacgcugcuguacauguugaccugcaggaagagcgacaugaaggugcacaggacggcgaugucguaguaccgcucgugcagguugaacaccucaaugagggagucggccaccaggaugagguccgccaccgccagguugaugaaguacaggucggggauggucaucuucucgcggaagcugauguucaccaccaggaucaggauguugcccacaaagccgauggggaagaggaagaugguguagaggcacgagaggaacaggccgaucacguacugcuggugcuccgagagcucaccugucccauuggccagggcggugcccaggagcgggugggacagguugagcucgggggaggugguguugggggccgcaggcugcgcggugccuggguacaucuccaggcccacgccccgggcuugggaagucacauccaugucucugcaccgugcagcuuucaagauuugccgaaaggcucccagagcucuguuuuaaauggugaauccaucuuuagaaagaagcgugauucuccuugaagugagccuggcauuugucagacaggaaacuccccaggaggagcaccuguggugguuuggguuggguuuguuaacugcagagagugggaagaacagaugcuccucacaccggcauggugcauccguggaggcgagggcccuccgcgugcucguccggcgggcgucccugcgggugucggccaccgugcacagucccgcguggagcugcucacucucuggguaccuggagaagcaacaggagaggaugaagucucaucgaguggccccagcuuugggacaaggccuggcuccccuggccgggugucuguagagucugggugugucaggagcacuggggagggccagaaccucagcuuuaugagcucgggagguggcugugguugagcugagguggaagagucgccugugggaaguacauggccuucuuuccugcaggucccacggcugcucagcugcagcuggaggcuggacgugagucacucccacaggcagggguguuuuucccuuuauagccacagagcaggcccaggaagcaaugaagguaugggcacggccgccccaggacaacggcauuugugaggagaggggaaaaugcauuucagcagcugauggagaaguaagauaggaagggaaagccaguguuucugagagagagagaguggguccagaaagcuggacaucagagcagaaucuucucuuacgauaaaacagaaguucagcgguuuccucaugcuaguucuguguucuagguaccaaaaauaaacuuauuuucguaauauagagugaaaggggucauuguuuugggaaauaauauguacguuuuuauuucauguuuuaacaaauuauuguaaaaccuaauauguuuuugcaaugcuguuuguaaccuaggaagaaacuccagggagagagucccucccgagcuuauccucugcagagagggagaagugggcuguccgcccacggcggugcccgggcucugccgccaguggggagggucccgucacccaccccgugucacccuggcucugccgccaguggagaggucccgucacccgccccgugucaccccggcucugccgccaguggguagggucccaucaccugcccugugucaccccggcucugccgccaguggggagggucccaucacccaccccgugucacccuggcccugcugcgaguggggagguccugucaccugccccgugucaccccggcucugccgccaguggggagggucccgucaccugccccgugucacugugcuccuggaaguucucuaugcagcgggccacgggggucucagccugcagacacuggcagucucuggggaugcgggggcagucacaggggggugcugguggggccagggcugccgcucagcucccuacagugccuaggacaggugcccaagcccagcagagaauuaccuggcccagauggugcuggugcccuggaguaaacuaacacuucaaaauggguuugaguuguuuuuccuuugggaauuuucauuuuaccuuuugaaaucauuaggaguuauuguuuugaauguuuuuuuuuuuuggucacccagguuggagugcaguggcacaaucucggcucacugcaacugccgccucccggguuagagugguucuccugccucagccuccugaguaucugggauuauaggugugcaccaccacgccuggcuaauguuuuauauuuuuaguagagaugggguuuuaccauguugcccaggcuuguaucgaacuucugaccuguagugaucugcccgccuuggccucccacggugcugggauuacaggugugauccaccgcgccgggccagggguuauuguuuugaagugcugcaaaaccagacuagagauuuguugaccuauugcuugaaaauacuuacuuaaaaaaaaaaaaaaaaaaaaggcuggccuauaaucccagcacuucaggaagaugaggugggaggauugcucaaguucaggaguucgagaccagccuggguaacauggcgaaacccugucucuacuaaaaaaagacaaaaaaaguagcugggcauaguggugugcgccuguagucccagcuacucgggaggcugaggcaggaggaucgccugagccuggcagguagagguugcagugagccaagaucacaccacugcacucgagccucagccgagaucacaccacugcacucgagccucagccgagaucacaccacugcacucgagccugagcuacugcagugaggccccaucucaaaaacaggcggguggggaagacaagaugaaucacugccucugugucaguuauucuaaaaguacugaauaaccuucacuuagcuggggcuggugaauuugauuuugguuauuuugcacucuugauucaucuuuaguagauaauaccauugaacagcauaaaugccucugcucucaggcucugucgggaagguugaaagacuccgcauuucgccucuguauuuaauuucuuaaaaacggcacagaggacuuguuuugcucuuuaaauguagaaauuuuggaacguauuagaccguggcguggcaggaaguuuaaaggugggcagaacccucaacuuaacguuuauuuucuuuccuaauuuuguuaaaugaacuccaagggaaaaauaguuuaaaaacgagucauucauuucuuucccauguaaauugagucuuuugaucguugccagacaccgagaagauacgggaccuggugucugauguguccuagugucugaugugguccugggugagaggaaccuagugugccauucaccacuggccccacguccucacuggagguggccauggaguuauaaacagugcaauaccucauuucagauuuccucugcuugucauagagaaauaaagccacacuuuagucagcuguauuaagucugcaucugucaaaaggcguguggcccucccagggcuucaggguuggugagagugacuggggcaccgcagggcagggcagagugggcacccucauuuucuugaagugagacacguucuugcugggacagaacgugacggaauacuggguccugcuuucagcacgaguuagaaaggccguccaggcaaagccccugcugcggucacgcugagaccaccggagcuccgggggagaggggucugugccuugaguuugggaagcugggugcugcucucaccagggggugaggugucuggucuguguucagcuguucccauaacaggacagcggccuggguggcaccacccacccgcuccccuagucagugguauggcaccgccaggccgaggcugaguccuaccuggguugcagccccuucugugcuccuggaagccuccuuggucaggcccaucaggcuggaggugcacuuggaacccgcugcaggagguguaccucugcuggaccugccgaaugccugagcagggcuagagagaggaagagacccgcccugggagcccgcgagggaagguucccggcuggcuggcgggugcguccucccucugagccagugagucugccccuuggcacagggcuuuaua

SEQ ID NO: 14502 - RNA, 2633 nt, Homo sapiens
aggcugaggcugugugggcacauggacccagcagggaacaagacuugcccauuguucugacagacucgaagauggaucuggcccuggucccugcuuucccucugaccccaggcccacccggcaagaauggcugaagucacauagcagccuggcccuggccccucugagccuguggagagcccuaguugucugugauuggggaggggggaucaagagacccaacugcauugccugcccuccuucccaggcuuccaguccucccaguggaucccaccucugcaccuuugcccaggcugugcugagaccuggaaggccccuucucucccuacuccaucuugacaaagccuuccugcuucagcucagaggcaccucuuccaggaaguuggcccugauggccccaguggaagggaaguuccuuucaacugaguggggaggcgccccacccuagcagccccucccagaccccaagcagccuuggggcuccccaggcacucgccuggcagaacggaagcagggguggcggcugaggucugccacccucgcugagcgcccugcagccccugugguugcaguuuuacuuguuuugaaagccccauuaaugaucagaaguuugggaaagggggccuggcugggcuagacuggggggacauggagccccagggaccagccaggccccuuucugaccagaccucuaaucugaugugauggcaccacuggugggugggacacagcuguccccagaauguaccugggggaggaaugacuucaccuccccugccgggugagucaccuucuggggggugggggggcgguggauggaagaggucaggcugccucauuccccuaagacacugcugggccugcuuccccuuuugagggcagagaaacgucccucccucagcuuggaagaggaaggggccagaugcgcuguccugugcaccuuccaaaacacccccugaccuccagcacccggggacugcauuuaccuuuguucccauuugucagauggagaggucgaggccucgggaggagccgggcuuccuccccaccccacuucuugcuccucugcucuccccgaugcccacuuagcccccacucccaccccgcuccacacacagggacauaugaacauuaauggggacuccccaagcccuggcagggcccccacagcuguauccaugggucuguccgaccccuggguccagccacaccucugcccccggggccccaccagcucuguggggaggcgaugccagcugcaggcggggacagcgucggggccagggcagaaggccccaagccucugagucagccgggcaggaaggaggccagcagccucugcccgcagccuguuccgucacgacccccccgccccaccccagagucucagcuuccucguucagaagaggggccuaugccguccuaugagaagugggugggcacauggugggugcucagggaggaccacagccacccagacgggggucaggccacgugacggugagggcccuccauccucccgccauccccaucacuguccacaccccccaggcagcugcucugcugacucaggaccguccaaggccaagguggggucacagcccugccagccgcccccaaggccaggguagcccccagccaggcuuagaguaagggggucucugcaggcccauucagcacgucagcacucuucuggagggggcagcgacgggggagggcaaggcacccccccauagagaggcacuuuucacagugugucgucuccuuggagcagaguggggggugcagaggcaccaggagggggaccuggagcccuggggucgggggaagcagggucaggccagagcaggaacuugcaaggggcgcggccagggcagugccaggccaaggguguaagccccagggaaggggugggggcucauggugaagaggaagugagccgccccggggcugccaggagggugaggggagggaauccccgcagaggcugcagcacccguccccuacucagucacccucaaaggcuggauuugaggaaggaaaagcaccgcagagcugcuguauuuaaaaaacaagcgucuggaucucugcaggggcugggaccagcugcagugggggcuccggcacugcuccugcucuccaggacucuucccaccaccccugagcggggucggggccuggggccacaucacaggagagggaggugcagcauuaccagcuguggggcggccggacccacggccugccuggcuuggagucugagcgccuccccagcccaccagcauggcugcuggaccuugggcaucagcugcuccgugccucaguuuccccaccugcaaagugaggcgaugauguggacucugugagcucguggcaggagugaaguuggauaaggaggccccaggcccggucacaggagucacugucccuccugcaggggcugggcuccccaguggccagaccaggccagagccuugggguugugcuuuuggcugggaccuagagcccccagcauccuagaccuguuccuccuggaagcacagggcucacgcuccagcgaccacccugacccugggugggccgcaccuguagucaccagcaggcagcuauagugacgccagguuucguuccaa

SEQ ID NO: 14503 - RNA, 1526 nt, Homo sapiens
ccaccccucuggcugcagcggccgcggacugacuggagggagagucucccgccccggcgcagcgcccgcccggguaccguccccaccgcgccugggcagcccgucucgggaaaugguggaggccgcgggaccuucucggccaccuccuccagcagcucgaugugagacccaggguuuuccccuccgccgccugggcccugcccgacccgcucucuucuuucccccuagguucgggaccgcgaugguccgguuucggugucccugccgcaccuccgcacccucuuucgcgcuggaaaacaagggguccccgagggccggggucgccgcccuccuaccggggugcagguucccagggccgccguucucccggggaagaaaggggcaucccgcccgccccgaggccagggucccaaggcuggggucaccguacucccgcaucccccggcguacucccgcaucccccggcgcucgguaacugccagggacccggcucggcgcgagugguggagcugggaacagaacccaggagggcccacgagcgccaaaaguagcguuugccaagaaaaagauucgagcucggggagcgggugucucgcggggugcgggggccgguuuguucuuuucucgcccagauuuugaaaacuccagcccaggcucgugccgccggggccccggggauuggaaucgcccccgguggcucgggcuaccacaccggcuuucggcucacgagggccaagcacgcuacggaaaagguagccgagccgcgcgacacucuccaccgccuuggcuccgggaccaggaguuucccagcccugggagccgagucugcccgcacccccguggccgaccgaaggagagucgccgagccccggccgcgagugcacaggaggacccggccgaguggaucucccugggaagacaggaggggacgggcacggcgcggggcacuuacccgggugcggauggagauucaggccggccauguacuucccgggcggcagcgggccgggcaagcccgaggcgggcaagcguccggcaguggccgcgcccacgcgguggcuguccauggccaggccggacagcagcggcggcgggggaccgugcacggaccgcuggggcccgaagucucggccauccauccuccgcgggagugccgcgaucagccccccacccggcccgcaggccuagcucagugggaccuaaaaguucggccucggcguagucccagaguccucgggcggcgggggcuccgcggcgugcauggcggcggccagcggggcuugcgcucggcggcgggcccgcggcccggggcgcacaggcggccggcgguggggccccuccgggcggccaggcggagcugcgcgaggcggcgcacacggcgucuuggcggggaggagacaggccgcggaagaaauagaaagggggaaagaaaaaagggaaaaaaaaauaaaguaacaaguuucagaaagucgccucgcccuucaggaucggggggugccgacugaguggccagaaaugaaaucggg

SEQ ID NO: 14504 - RNA, 1526 nt, Homo sapiens
cccgauuucauuucuggccacucagucggcaccccccgauccugaagggcgaggcgacuuucugaaacuuguuacuuuauuuuuuuuucccuuuuuucuuucccccuuucuauuucuuccgcggccugucuccuccccgccaagacgccgugugcgccgccucgcgcagcuccgccuggccgcccggaggggccccaccgccggccgccugugcgccccgggccgcgggcccgccgccgagcgcaagccccgcuggccgccgccaugcacgccgcggagcccccgccgcccgaggacucugggacuacgccgaggccgaacuuuuaggucccacugagcuaggccugcgggccggguggggggcugaucgcggcacucccgcggaggauggauggccgagacuucgggccccagcgguccgugcacggucccccgccgccgcugcuguccggccuggccauggacagccaccgcgugggcgcggccacugccggacgcuugcccgccucgggcuugcccggcccgcugccgcccgggaaguacauggccggccugaaucuccauccgcacccggguaagugccccgcgccgugcccguccccuccugucuucccagggagauccacucggccggguccuccugugcacucgcggccggggcucggcgacucuccuucggucggccacgggggugcgggcagacucggcucccagggcugggaaacuccuggucccggagccaaggcgguggagagugucgcgcggcucggcuaccuuuuccguagcgugcuuggcccucgugagccgaaagccggugugguagcccgagccaccgggggcgauuccaauccccggggccccggcggcacgagccugggcuggaguuuucaaaaucugggcgagaaaagaacaaaccggcccccgcaccccgcgagacacccgcuccccgagcucgaaucuuuuucuuggcaaacgcuacuuuuggcgcucgugggcccuccuggguucuguucccagcuccaccacucgcgccgagccgggucccuggcaguuaccgagcgccgggggaugcgggaguacgccgggggaugcgggaguacggugaccccagccuugggacccuggccucggggcgggcgggaugccccuuucuuccccgggagaacggcggcccugggaaccugcaccccgguaggagggcggcgaccccggcccucggggaccccuuguuuuccagcgcgaaagagggugcggaggugcggcagggacaccgaaaccggaccaucgcggucccgaaccuagggggaaagaagagagcgggucgggcagggcccaggcggcggaggggaaaacccugggucucacaucgagcugcuggaggagguggccgagaaggucccgcggccuccaccauuucccgagacgggcugcccaggcgcgguggggacgguacccgggcgggcgcugcgccggggcgggagacucucccuccagucaguccgcggccgcugcagccagaggggugg

SEQ ID NO: 14505 - RNA, 3486 nt, Homo sapiens
uggcuuucuaaaucaaguccauuuuauuugaaauuuuccacaugccacacauguacaugaaaauucccauccagaauguaguuugcuacagugaacaccaaugucaggagcaggcaucaccgugagacgccacgggggcaggucagcgggacggggacagggagguuggucaucgaaaggcaggugaugcaugucgugucauuuagcaccuggucaugagauacggcgagacccccagguccagggaaaggucuccccuuaaaaccacguggagcucugcugucucugggcagucucacguggacagacaaugcucagaagguggcgaaggggcuggagggagauaccaccgacggcugcaggggaggggcacgcacacacacaggcacgcacaugcuugcccaugaacaccccccgggcacacacacacccuugcacacuccccacccucccuccaccccagacacaucagcacagcgguccaggcucuggcucacuccccgggaggcuucuguggccaggguucccauggcgggucugguggcaacagcuuggagaaaagccucccgggaccaacccucauucccagguccacugaucugggguaggaguagccaaguguucugacaggcgguuuucccguaaaccgaccccuucagcguuucugcuuuuuguuguuuguuuucugagacaggguauugcuccguggcccagaguggagggcaauggugcgaucuuggcucacugcaacauccaacuccugggcucaagcaauccuccugccucagccuccugaguagcugggaccacaggcacauguacaaugcccagcuaacuuuuuuuuuuauuuuauguagcgauacagucucacuauguugcccaggcuggucucgaacuccugggcucaagcgauccuccugccccagccucccaaagugcugggaugacaggcgugaaccaccacgcccggccccucccauguuucucaaaggagcuuuagagagcagaggagcccgagucacugccaccacuggguuccucagugucugugggguuuguguucaucaugcccaguagaucuagaaacuucuuuuguuuuuuuuuuuuuugagacggagucucacucugucgcccaggcuggaaugcaguggugcgaucucagcucacugcaagcuccgccucccagguucaugccauucuccugccucagccuccugaguggcugggaccacaggcgcccgccaccacacccgacuacuuuuuuguauuuuuaguagagacgggguuucacuguguuagccaggacggucucgaucuccugaccucaugauccgccugccucagccuccuaaagugcugggauuacaggcgugagccacugcgcccggccagaucuagaaacuucuaacuugaaucccacacccccaagugcaaaugagacccaugaccaucacaaagaccccccagcgucguggucaaggcuaccaggaacuggcagcagcgcucugcccacguccacaggaaguggccgacgucuccucugccuuugguuuaguggccccacacuucaucaccucacuuuguccaugaauuucacacguuuucuuacaagagcucuguaaugcgccaggcacgguggcucacaccuguuauccuagcacuuugggaggccgaggcaggagaaucacuugaggucaggaguucaaggccagccugaccaacauggugcaaccccaucucugcaaaaauacaaaaauuagccggucaugauggcaggugccuguaaucccagcuacucaggaggcugaugugggagaaucgcuugaaccugugagguggagguuguagugagugagcugagaucgugccacugcacuccagccugggggacaaagcaagacucccucucaaaaaaaaaaaaaaggcucuguaauuuucagauccuaaaaggagcagauaacaggggaagaggaggugggaggcugccacagcgcugccugcugggggaucaagguccccgcauccaggccuccagcacccuccaucccugcaggagcacugcuggcaccgccaaggccggagcacuggucuggagcuucauuggccggcaggggcccagcccucagcuguuggagcccuacggcucuaggucuggccccuccacaagcccuccaggcccacgccugagcccagccccgguccccuggguccaacggccuguggcucuggguccggacccagggugugguugagggagggcgcugcugagcuggcaggcaacccuuguguguuugcagcgcaagaggagcucagcccguccuggcugccguccugggucgaagcagcaagugucuucccgcccugugcacagacaggucccaggagggccucuuggagaagaaaccgcucaggcccauguccuggcagggccucugggggcagcagauggcaaggauagagcccgcccccucugcugcagaaggaagcggcccucacccagccccccugggcuggacgggccguugaaaacaagaaaagccuuccauagcagaaaggaguacucaaggcccagaaaggcagcuuugcucugggucaucaggcucaagugccugcucugggccaccuucggaagccugguggagccgaguguugccuggugacguggagcaggaggcggggcggaggcugcgggacacggggcugcagggccgggaagggggucaggagaauaaauagcagcuagguguggggugagcugggagcacaggcaggagggggcagccagagagguuggggcucucccuuuuaaagaacaaagggauacauacccuuuccccuccucccucccuccaaccccacagucucucccucacauacacacacggaagacgugacucacacacacaugcacacacagggcacagguacacgaaggcacacgugcacacacagggcacagguacacgcaggcacauguacacacaggcacacgugcacgcaggcacacgcaugcaggcacaugugcacacacagggcacagguacccgcaggcacacgugcacgcaggcacacgcacgcaggcacggggacaagugcugaccacgcuccuccagcaggcagcauauggucugcugcuuaacagccgagcucugccaauuggggaccauuaggguggguucuuuucccagcaucaaaugcugcagaauauaaauugcaacuaacgcuggugccaaaauagcacuuagagaaaauaagcacguuauuaacaucuggugaagcccaucucggggguagcagcagcggaaauucuugcucuaagucagaggaugguugcaggggacacuaaaaauacaagguccacuguuucaggggugcuuuccaaggcacugcaccccagccucaggaacagcccuucccccaguccugucuaugaguauaaauuaugcugcugguuaaaaccgcuugcucaugagaacaggacaccca

SEQ ID NO: 14506 - RNA, 3486 nt, Homo sapiens
uggguguccuguucucaugagcaagcgguuuuaaccagcagcauaauuuauacucauagacaggacugggggaagggcuguuccugaggcuggggugcagugccuuggaaagcaccccugaaacaguggaccuuguauuuuuaguguccccugcaaccauccucugacuuagagcaagaauuuccgcugcugcuacccccgagaugggcuucaccagauguuaauaacgugcuuauuuucucuaagugcuauuuuggcaccagcguuaguugcaauuuauauucugcagcauuugaugcugggaaaagaacccacccuaaugguccccaauuggcagagcucggcuguuaagcagcagaccauaugcugccugcuggaggagcguggucagcacuuguccccgugccugcgugcgugugccugcgugcacgugugccugcggguaccugugcccugugugugcacaugugccugcaugcgugugccugcgugcacgugugccuguguguacaugugccugcguguaccugugcccugugugugcacgugugccuucguguaccugugcccugugugugcaugugugugugagucacgucuuccguguguguaugugagggagagacugugggguuggagggagggaggaggggaaaggguauguaucccuuuguucuuuaaaagggagagccccaaccucucuggcugcccccuccugccugugcucccagcucaccccacaccuagcugcuauuuauucuccugacccccuucccggcccugcagccccgugucccgcagccuccgccccgccuccugcuccacgucaccaggcaacacucggcuccaccaggcuuccgaagguggcccagagcaggcacuugagccugaugacccagagcaaagcugccuuucugggccuugaguacuccuuucugcuauggaaggcuuuucuuguuuucaacggcccguccagcccaggggggcugggugagggccgcuuccuucugcagcagagggggcgggcucuauccuugccaucugcugcccccagaggcccugccaggacaugggccugagcgguuucuucuccaagaggcccuccugggaccugucugugcacagggcgggaagacacuugcugcuucgacccaggacggcagccaggacgggcugagcuccucuugcgcugcaaacacacaaggguugccugccagcucagcagcgcccucccucaaccacacccuggguccggacccagagccacaggccguuggacccaggggaccggggcugggcucaggcgugggccuggagggcuuguggaggggccagaccuagagccguagggcuccaacagcugagggcugggccccugccggccaaugaagcuccagaccagugcuccggccuuggcggugccagcagugcuccugcagggauggagggugcuggaggccuggaugcggggaccuugaucccccagcaggcagcgcuguggcagccucccaccuccucuuccccuguuaucugcuccuuuuaggaucugaaaauuacagagccuuuuuuuuuuuuuugagagggagucuugcuuugucccccaggcuggagugcaguggcacgaucucagcucacucacuacaaccuccaccucacagguucaagcgauucucccacaucagccuccugaguagcugggauuacaggcaccugccaucaugaccggcuaauuuuuguauuuuugcagagaugggguugcaccauguuggucaggcuggccuugaacuccugaccucaagugauucuccugccucggccucccaaagugcuaggauaacaggugugagccaccgugccuggcgcauuacagagcucuuguaagaaaacgugugaaauucauggacaaagugaggugaugaaguguggggccacuaaaccaaaggcagaggagacgucggccacuuccuguggacgugggcagagcgcugcugccaguuccugguagccuugaccacgacgcuggggggucuuugugauggucaugggucucauuugcacuugggggugugggauucaaguuagaaguuucuagaucuggccgggcgcaguggcucacgccuguaaucccagcacuuuaggaggcugaggcaggcggaucaugaggucaggagaucgagaccguccuggcuaacacagugaaaccccgucucuacuaaaaauacaaaaaaguagucgggugugguggcgggcgccuguggucccagccacucaggaggcugaggcaggagaauggcaugaaccugggaggcggagcuugcagugagcugagaucgcaccacugcauuccagccugggcgacagagugagacuccgucucaaaaaaaaaaaaaacaaaagaaguuucuagaucuacugggcaugaugaacacaaaccccacagacacugaggaacccagugguggcagugacucgggcuccucugcucucuaaagcuccuuugagaaacaugggaggggccgggcguggugguucacgccugucaucccagcacuuugggaggcuggggcaggaggaucgcuugagcccaggaguucgagaccagccugggcaacauagugagacuguaucgcuacauaaaauaaaaaaaaaaguuagcugggcauuguacaugugccuguggucccagcuacucaggaggcugaggcaggaggauugcuugagcccaggaguuggauguugcagugagccaagaucgcaccauugcccuccacucugggccacggagcaauacccugucucagaaaacaaacaacaaaaagcagaaacgcugaaggggucgguuuacgggaaaaccgccugucagaacacuuggcuacuccuaccccagaucaguggaccugggaaugaggguuggucccgggaggcuuuucuccaagcuguugccaccagacccgccaugggaacccuggccacagaagccucccggggagugagccagagccuggaccgcugugcugaugugucugggguggagggaggguggggagugugcaagggugugugugugcccgggggguguucaugggcaagcaugugcgugccugugugugugcgugccccuccccugcagccgucggugguaucucccuccagccccuucgccaccuucugagcauugucuguccacgugagacugcccagagacagcagagcuccacgugguuuuaaggggagaccuuucccuggaccugggggucucgccguaucucaugaccaggugcuaaaugacacgacaugcaucaccugccuuucgaugaccaaccucccuguccccgucccgcugaccugcccccguggcgucucacggugaugccugcuccugacauugguguucacuguagcaaacuacauucuggaugggaauuuucauguacauguguggcauguggaaaauuucaaauaaaauggacuugauuuagaaagcca

SEQ ID NO: 14507 - RNA, 3084 nt, Homo sapiens
cugggcuuccccagcaggcuccgcccccuccguggccacccauguaauccgcugaccgccugucucugguucagcuuccaggccgagcggcccgcguuaaacgucgucaucuucccucugcuccacgagggccugaccgacgucauccgggacgucccccuggugcaccuggaugagaucaccuuauuuaagagcagaguggccgaggaaccgccgaaccugugguggugagaggcggagccgccgcccaucggucucagucaccucgagaagcugcaggagccugggacgccagggacccuugguuugucacaagaggaagggggccucucucccggccagccacgccccaccuggcuccuggggcucccggcgucuccacggcucucucauggggacuguugcucugugaaguuuaggucgaggggaugcguucugggugacaugagggggcucgggggacggucgauguggggggcuggcugaaccaggcugacccuuggggccuggcugggggguuuguauacugagccgcaaucccugggggcccuguccacgggccuggagggcccgaacccccugccacuuccgaccgggaagcgugucccuuggcuguuguguuuguggucaccugccaccggggccccguggaugggcggccacaugcugucccccugaaguccagucggccgggcuggucaccguguaucugaguguccccuugcauggucaagugugacauggggaagggccugccaguuuaguggcugcagacuugggacucuccaucccauuaggacacacuugagcccacucaugucucuggggcuuuucuagccagaugaugccuguggccccagagagguccccugagguugggacugcugguuggagccucuccugugacuuuucagcccaaccagcagggcccguuucuaacgagagaggccuccucccccucccacccaccccacggccuucagcuucccugggaagguccaugcgcguuccuggggaaaucgauacacauucggcuuuguuagaauaacgcgaaacauuaaaacccagaaaggauucuuaaggcuggaguagcaaucacaugaccccauuucaaaugacuucauuuaagacuuuaaaaauacucagcugggcgcgauggcucacgccuguaaucccggcacuuugggaggcugagguggguggaucacgaggucaggaguucaagaccagccuggccaacauggugaaaccccaucucuacuaaaaauacaaaaauuagcugggcgugguggcgggcgccuguaauccuagcuacucaggaggcugaggcaggagaaucguuugaaccugggaggcggagguugcagugagccgagaucacaccauugcacuccagccuggacaacagggugagacuccgccucaaaaaaaaaaaaaaaaaaaaaaaaaaaaaaaaauauauauauauauauauauauucaacacacuuugggaggaucacuugagcccaggaguuugagaucagccugggcaacacagggauaccccaucucugaaaaagaaagagaaaaaaacaaaguuauuccaaaaaugaggacauccuccuggcaucugaguccucaccccaugugccacgguggccgcuucugccguccuccaccuccaggcgcuccuagagcugucccugggccaguggcuuccaaagggggcuguaguugggcccugcuagccuggaccgccgcccuggccgcucuuggugaagggccccuuguccagcccgccuuccuccuccuggguuuccgugugacagaugccccguccugugggguggugucucacauuugcuuugcuguuaaaaaaugggguacaccauccccaggccuccaaucaccggcccugccccugaguggggaugguuuucagcagcuccuugcucugggggccaagcuccuuguccaggaggccuuuggagaacuggggucagagcuguggggagguacagcccuccugugcaggcugccucccagcucuccaccuggcagucuugaccccacccuggcgccucugcucacuggcacagguggaucugggguuugaggucuccucccacuucacccugacuuucuuguauguauggggucaucgccuccucucugaagcccacggguccucucccagccccaggcugcacccagugcagaaccuuugccuccuggccagagggacccuucugcaggcugauuccagcagugcccgauggugggacccacaccagaccaagccuucgccucccagaggccuccuggcccuccugucauggccugugagagccacaccccuaggccccgucuccuagucugcaggccgcaggaccagcugcccacggccccagggggcaggggcuguagaugagggucucagagguggugggagcaccccccccacccacaguuccugggcauuucuuuagagcuuuaaaauggcaccuggagaccaccaggcgcggcgaucagaucgggugguguggugccuccugggacugaccacuucuugcucuccgaccaggcaggggcgaguggccugggagguucccggacccucagggggccugugucucugggcaccgcagcuccgccccacuccuuccuccagaacauuccccacucgggcuagagaauugcgucugcuccaggaaugcauccuagcguguguacgaucgcgccuggguguccuguucucaugagcaagcgguuuuaaccagcagcauaauuuauacucauagacaggacugggggaagggcuguuccugaggcuggggugcagugccuuggaaagcaccccugaaacaguggaccuuguauuuuuaguguccccugcaaccauccucugacuuagagcaagaauuuccgcugcugcuacccccgagaugggcuucaccagauguuaauaacgugcuuauuuucucuaagugcuauuuuggcaccagcguuaguugcaauuuauauucugcagcauuugaugcugggaaaagaacccacccuaaugguccccaauuggcagagcucggcuguuaagcagcagacc

SEQ ID NO: 14508 - RNA, 20575 nt, Homo sapiens
ucgcgcaugcgcgccgccgcugcacugcccucgcuuccugugcguccucaggucaccgcuugcucuaguucccaggcuuuggccuccaguggacgagaaucgcggagccugcggggcuggagguugagcgcccgggccagcaccuaggcgggcgcgggggugugcaggccaggguucgcgcgggccggguggaggcuugagcggggacccccgagcuugagccccggagccggcggcgcuggggccagaggggccggacgggagguggcggagguggcggcggaggcgaaggggcggcgggacgcgggccuggcccguguguguccuggcggccuggcccaggcugccgcuguacggugagcccgagggaggcggaucugggucccgggaaggacacccgccuggauuugccccuuaggcccggcccgggccccucgggagcagaacaaccuuagugagguggacaggaggggaccucgcgagcagacgcgcgccagcgacagcagccccgccccggccucucgggagccguggggcagaggcugcggagccccagaaggguaggucuuggguuuucgggcccggagcgagaagggccugagugaagucaccguguguuggggaccuuagaguguggggcagggggagggucucgaucgcuugcaggagagacguguguuuggguuugagggcaggguccggcugcaccgaacaggcgcugcaugggaaaucugggaggacgaggcuuaugggggccuggagggugucaccagccucagcugcggacgucgucuccacuccccgcuaaccccuaacagcccuuccuccuccuuuccgugcuccagauuucgaccuccucuaaacguccgucagcgccucuguucucucauuuaagugucugcugauuccccccuuagaucugcccuggagacugguaguaaugcaggaacagucugcagggauucucucuugcugccucaguugcuaggggaagagacugggccuuagcaggugggugacuugaccgggucacuggcuuuguggguagaguugcucauaguagaacucaggagucuuaucucccaggccaguguucuuucucccguauccuaguuuucuuaauagaagauuauuaggugcagcaauaaccaaguucaguuagauaauuuagaaacaaaaccauauuuuauacacauucauuucauuucugagagcucacauacucaauuccuauggcuucuuugauuuuaagcaguuuaaagagacaauaagaaaaugcgggccggaugcaguggcucacaccuguaaucccagcacuuugcgggggcuaaggcaagaguaucccuugagaccaggaguuagagaccagccuaggcaacauagggagacccugacucuacaaaaaauacaaaaguagccaggcaugcugggaugcaccuguggucccagcuacucaggaggcugaggugggaggaucaauggaggccaggaggucgaggcugcagugagcugugaaugcaccacugcacuccagccuggguggcagauugagacccugucucaacaaacagacaaaccacaaaaaacaugagcuguauaaugggaauuuuuuuuuucuuuuugcagguuguauuugaugauggcagacuauuuguaaaaggagucauguuacccaugagagucucacucaucugauuacuaccugauuaucuuagaguuacaaaguuacaagugcaugcuucgccuaucacucuuuuucacucucuuuuuuuuuuuuuuuuuuuuuuuuuugagacagugucucucacccagucuggagugcagcaguguggucucggcucacugcaaccuccaccucccagguucaaaggauucuugugccucagccuccugaguagcugggacuacaggcaugugacacuaugccuggcuaauuuuuuuguuauuuuuaaguagagaugggguuucgccauauuggccaaggaaggcggaucacuugaggccagaauucgagaccagccuggccaacauggcgaaacccuguaucacucuuuuaggcccuucugaguguuugcaggcugaguguucacaggguguuagccuauugagcuuucuuuugugguucuuacgcaggagauuccugccuuugcaggccagagcacucaugacuucagugaccugcuucucccccucuaggucuaccagccacagucucugcacguuuccaagagcagcagaaaaugaacacauugcaggugaguuuucaugcuuguguauauguuccucaacuuuauuuuaugaugcauuuuaagagguuuguaaggauucuuaccuuuuuuuuuuucuuuuuuuuugagauggagucuugcucuguugcccaggcuggagugcaguggcaugaucucgcuucacugcaaccuccaccuccuggguucaagcgauucuccugccucagccucccgaguagcugggauuacaggcgugcgccaccaugcccaacuaauuuuuuguauuuuuagaagagacaggguuucaccauguuggccaggcuggucucaaacuccugaccucaggugauccuccugccucagccucccaaagugcugggauuacaggcaugagccaccgcgcccagccaggauucauacuuuaaaaugggaauguggaaauagacauuguccuguaaaauauaguuaguguggcagaucagcaccaaaaaugauuugugaagcuuguauguguggauaguagauuuuaaggcuguugaaauugagccgcacccaggacugauauucuuggcagucaucacaaaaggaaaaugccaucuguauuaguccauucucacacugcuauagagaaauaaccaagacugggucauuuauaaagaaaagagguuuaauuggcucacgccugcaggcucuaucauaggaagcauggcuggggaggcuucaggaaacuuacagucaugguggaaggcaaagggaaagcggguacaucuuccaucaccagagcaggaggaagagggagggggaggcgcuacacacuuuuaaacaaccacgucuugugauaagucacugagugucaggagaacagcaccaaaagggaaauugcccccaugauccaaucaccucccaccaggccccaccuccaacauuggggauuacaauugaacaugagauuugguuggcgacacaaagcgaaaccauaucaccauccaugacaucauuugcauucauuauaaggagaaaccaacuuuguuacuuguggauuuaaaagauuuucuaggacuuggaaaaauuucuucauucaaguugauauaauugcggauagcuuuccuaauaacaaccauuaaguuaccauaacuuauggcuuauucuuggugcuuauguaagcagagggccugccugcugcccaaggagaacuuggugcauauaauuuuuccagggaaggaaacauugugaucccaguagacagaauucuguuuuuacuguugaguccuagaucauggggggaaugaaugacaugaucauccuucaaauauuuguucgucuuucaguuuggguugcacagcaaacaauacaguuacucucuugugaagauuuccucauuucuguuucucauuucaguucucaguguuuuaguuuuguccuuuucacguugcugagucagucuguaaagauuaccagugauuucauugcagucaaauccagaggggauuuccuagccccuaccucccaggacccuuugucugccuuugacaucuguuacuuccaaacugauacuuucuccauggagucucucuuuucuuggcuuuuaaaaagauucgucuguaaguauuucugcuugucuuuaaaugaugaagucuguuuuguuuuguuuuguucuguuucuuuuuuucuuuuuuugagauagggucuugcugugucacccaggcuggaguguagagacgugaucacaacucacugcaaccucagucuccugggcucacacgauccuccugccucagccuccugcauagcuacaggcgcaagcugccacacccgacuaauuuuuuuauauuuuaguagagacuggguuucaccaugucacccaggcuggucuugaacuccugagcucaggcagucugcccgccucggccucccaaaaugcuaggauuacaggcgugagccacugcucccagccuagagauguauucccacuguauugcucagacuggucucaaacuccugaccucaagcaauccuuucacuuuggccucccaaagugcuaggauuacagguguaagccaccacaccuggcuaauaaggaaucuuuuugaaaggggcuaggaauaacccauaauacucucuuaauacauguggcaauuggguuaaaucuuuuaauaguuccuauauuaugucucuugcgugcucauuguuuugaagaaacuggguugguuauccucaguuuggauuguguuacccuuguuucaccuuuagcacauuuaaaaaauauaucuuuuaugccuuguuaaauugguaguuugaucuggaagucuaaucagguuuauguucaauucuuuucacacagcuguaccguacguggcauuugucuacuucuggaggcauguguuaccuucuuuguuuuugugaacuuaagaacuauugacuguugauuauugcugugauuuacuaguucauuaggggaggcaaaauggugaugugcuaauucuaccauuucuucuuuauuuacuagccaaaauaccuuucuuuucuuuucuuuuuuuggaaacagagucucacucugucacccaggcugucguguuuacggcucacugcagccucaaacuccugugcucaagugauccucccacuucagccucccaaguagcugggaguauagucaugugccacaaugcccagcgaauuuuuuaauuuuuaguagagacagguuuugcuauguugcccaggcuggucuugaacuccugggcucaagugauccucuucuuugaccucccaguguuggcauuacaggcaugagucaccacagcuggccuagaauacuuuucuaaagauaaauuucuguucucuauuugguuauguaauucaugcaggaaagacaguuucuaaaauguugaguaggcuucuaagcaggaagguuuuuuuguuuuguuaccauuaugagcucguggguuuaaacagauaguaaauauuucaguacaucaaaguugugauucuuuuugaaaauuaaauggcuccaucuuuggccagacaaaaucccuuuaaguugguuucugaguccuuuugaaauauauuugauauauuugauagcaaaucuauacauacaauauauauuugauagcauuauuuucuguucagcauuuuauuuugaaaucauuucaaauuuucagaaaaauugcacggauuuuacaaagaaaucccagcuacuuccuuuuguucagauacuucauucuuaacauuuucccacauuaaucauuuauaugcauauauacauauauguguguacauauuuuuauauauuuuuuuucugaacuguuugagaguggguaugauuugucaugccucuuuaccuuauaaaguuuuagauuauaucucauaaaaucaagaacuuucuauuaaauacccauagcacaguaauugaauucaggaaauuuaucauugauuuaauacuuuuaucuaaacuguaguucauuuuccaguuuugccaauuucccaauaauuuccuuuauagcaauuuuuaauuuuugguagaagauucagucuaggacugucaauugccuuuaguuuucaugcuuuuuaaggcuguuuaauacggauuuguuccucagugccauuauaauauuugcagaauacaggccaaugauauuauagaagucuuuaaauuuagguuucccugaucuuucuucaugauuagauuuaguuggugaauuuuugucuggaacacuacaugggaccucuuaaauuuauggcucagaauaggaucugucuugggaaacuucugugcaugcuugagaagauggcuuguucugcucugguuggguggaguguuugauaaauguuaaugagaucaaguugguugguuguguuguucagguguauuauauccuuguugauugugugccuacuuguaucaauuguuggggagaggggauugaaaucugcugcauuugugguucucuuucucuuugcaauuuuaccacuuuuugcuuuauguauuauauuagauacauaaauguucaagguuauuacauccuguugauuaauuaaccacuuuguaaaauggccuuccuuaucccugcuaguauuccaggcugaaauguacuuuguuauuuauguagcauucuuuugaguaaugcaugcaugguauaucuuauuccauccuuuuacuuauaacguauuugcaucuuuauaucuaaaguauuauuucuuguaggcagcaagauuuggaucuugcuuguuuucaucagucuauuucugccucauaauuggggauguauagacuguuuacauguaauguaauuauugauaaaacuaguuagguuauaguccauugccuuugcuuucuuuuagucucaucuucuuuguuucuuuuuaaaaugucuuuguuugucuuccuuccucuugauuaauugauaauuuuuuaugauucuacuuuauaucuuuuguugaguuuuuagcuaucacacuguuuuguuauuuuagugaguuagaauuuauaguaugcaacuuuaauuaucauaguuuauucuuaagugauauaccauuuuucuuagaguaagagaagcuuacaauaggauacuuucauuucucuccucuuggucuuuacaccguuguucauuuuauuuuuacaggugguaucagugccacacagaaucuauuacguuguuguuaauuaaacaguuaucuuugauugauugauugauugauugauugauugauuuugaguuggagucucacucugucccccaggcuggagugcaggggugcgaucuuggcucacugcaaccucugccucccagguucaagugauucuccugccucagccucccggguagcugggauuacagacacccaccaccacacccggcuaauuuugguauuuuuaguagagaugagguuucaccauguuggccaggcuggucucaaacuccugaccucaggugaccugucugccucagccucccaaagugcugggauuacagguguaagccaccacacccagcccaguuaucuuuuaaaaagauuuaaguaaugagagaaaauacacaguuaccauuucugguacucuucauuccuuuguguaaaucuaaauuuuuauuugcugucauuuuacuucugccucaaggacuuucuuuaacauuucuucuaguugaugaauucuuguacgucugcaaaugucuucauugugucuuagcuuuuaaagguguuucugcuggauauuucuccacagugcuuuaaauauguuucucuauugucuuccugcuuacauuuuuuucuaagagaaaucugaucucauauucaucuuuguuccccuguauauaacaugucuuuuuuucuuuccccccuuauguuguaaacuuuuuaucacuaguuuuggguaauuugauugcaauaugucaugguaucauuuuuuucauguuucuguuuuggggaucacugaacuucuuggaucuuggguuuauggugucaucacuuugggaacauuuuuaucauuauuucuucacauacccaccaccuccccuccauugauucuuguugccuguauauuaggccacuugaaauuuucccacaacacacuguugcucuuuauuugcuuuuaauucuuuuuucucuguuucauuuuauguaacuucuguugcugucuuuauauucacuaaucucuuuuuuccacgaugcuguuaaucuuguccaguauaauuuucaucucagauauuguaguuucuaucuguagaagguuagcgugggucuuuuuuacaucuugccugucucaauuuuuuugaacauguggaauagaaugaugaacucucucagugcucuguguggguuguaaacucugucaauucugggccaguuuugauggacugauucuuuucuuccuuaugguuguaauuuccugcccauuuucccaucucgcaacucuuacaccucacaucugucucuguucuucuucccugcucuguggccuggaaacacucaaggcagaaguugauugguucaccuuguuuauuucccaucacucauagauaacucuacugccugauaaucagugccuugaaaaccauugcuucagcccgggcgugguggcucauaccuguaaucacagcacuuugggaggccaaggagggcagaucacaaggucaggaguuugagaccagccuggccaacauagugaaaccccuucuauacuaaaaauacaaaaauuagccaggcaugcugguacacgccuguaaucccagcuacuugggagacugaggcaggagaaucgcuggaacccgggagacggagguugcagugagccaagauugugccauugcacuccagccuagaagacaagagugagacuuugccucaaaaaaaaaaaaaaaaaccauugcuucauauauguucuccguuuuauuuuucuuucuguuuuugauuuuguuguugcugcuguucuuuguuaugugccauuucagguuggaggguauauccaguaccuguuaguuuaucacaacugagggcagaaguccucaugucucucucuauauauauuuuuucuaauauauauauuuuuuucuuuguagagacagggucuugcuauguugccaaggcuggucucaaacuccuggccucaagcaguccuucugccucaguuuccugagugcugggauuacaggcaugagccacugcaccuggccuggauccaguuuuguccauguccaaaugguguuuuucccugagcuguuuuugauuuucuuccaccucauaugaacuguagugucagcuuaucuaguuccaggaaaaagcuuuuugguauuuuuacugggguugcauauuuauaaaguaauuuaggguaacugacuuacccuagguaggguaaguugaccuuaauaauacaacuaauuuuuuuuguuuguuuguuuuuuaguagagauggggguuucaccauguugaccaggcuggucuugaacuccugaccucgggugaucugcccgccucggccucccaaaguguugagauuacaggcgugagccaccgugcccgagcacuuuuacuuuuucuuaguuauauuccucuaauuguuuuaucuucucuaauuguagauaaugagcauuuuauuaauaccuuguucuugaucuuaguaggaagguauguaguuuuucccuguuaaguaaaauccugacuuuuggaccgagaagacugaggcauaaaugugugugugugugugugugugugugugugugugcgugcguguauauacacacaaacuguauauauaugugcuuguguguaauugaaauacauaugucacauauauaucauacauacuauugcauauuagggugcaauauuuauauuuguguauauacauguuauugauguuaaugaaguauccaucaguuucuauuuucuuuaguuuguuuuuuuaaaucagcuuuuucugucaagcuuuuucagguaucuucacggauacaagauuuuucuucuuugcuguguuauaguggcuuaucauauuaauagauuuccaaauauuaaacuagucuauauuauuggaauaagucccauuuggcuauuguauauuauguuuuuaaucugguacuggauuuuguuugauuauguuucauuuuggguuuuuguauugauguaagugguauuggcauguaauuuuauguuauuuauugguugaucagucuucuaaccccuacuaccuccuugccuucuggacuaacuuaacccagaagguuauuacucucucucggugauuuuaucagcuccuguggccugacuguggauaagcuuggauguucugcuuuaguuucucagcccacagccuagcggcccugccucugcuaucucuugggaucuacaugguccuagcuguaucacuggauuugaaccccuuguugauauguucuuuauaaauaauaggauaaugcagccugcuuacugggcacuuccuuuuucuaaacuacaaguuugggcagggcgugcuggcucaagccuguaaucccaacacuuugggaggccaaggcagguggauugcuggagcccaggaguuuugcauuuuucuuuuuuuuuuuuuuuuuuuuugagacaaggucucacucuguugccuaggcuggagugcaguguugcauucacagcucacugcagccuugaccucccaggcucaagugauccuccugccuuagccucccaaguagcuagaacuacaggcgugugccaugaugcccagccaauuuuuuuuuuuuaauuuauuuuuagcagagaugaggucuuacuauguugcccaagcuggucucgaacuccugagcucaaacgaucuucccaucuuggccucccaaagugcuaggauuauaggcaugagccaccaugcccagccccaaccacuuaaaaauugaagcugcuucccguuugccauugguacuuuguacaccucaucauauucuucuuccccuucaucccauagaaugcacaauucaucuuuaaagacuucaaguuaacugagucugugaagccuaaucugauggcauaaaauuaaaauaauuugauccucuuuuguuaaaucauucugcaccuugucugcauuacucuaauaacagcuuugggcauucauucauuuaacgaauauuuauugcuccaagauugagauguuugagauaaaacucagccaugcagauagccagaggccacuggcuaugagaauaaaagagccaaaagaacaaggagcugaaacuaggugagagccccagagcagugaguuaggaggaagaggaccaggagcugaguggugggcacuccaacaugaagagguccagggcaaggggagggccuggcagcaaggaagacuaaaagaagugacaaggaguaaaaugcuuguguuuguuuacauguuuaucuccuuuuuagguuguucacuuugggagcaggcaugguguuucacucaucucauguccccaaagcucagcuaguucacuugcaaaauaggagcucaguuguguuuuggguuuuuauuuuuguggggcaauauauauauauuuuuuauauauauuauauauauuuauauauauuauauauuuuauauauuauguauuauaaccccaaaggauauguguuuccaauaugauuucccuuccauaaucuguaacauaaaauaagguauacaauguuuaugguuaacuuuaccggugggcuuuguaaaacguuaucccccuaucccuuuuccguaucucccaauucugaucauguugccauuacaggggccagugucauucaaagauguggcuguggauuucacccaggaggaguggcagcagcuggacccugaugagaagauaacuuacagggaugugauguuggagaacuauagccaucuaguuucugugggugagaauagcuugcuuucugaaugcucucaguugaaugggguuuuauccuugaguuugaagaaauaagugaugacaccauuuaauuccuugugggcacuagcuggaguguuuauauuauuauucauugaaagguucuaacuuugauaagguaaaaaauggagcacuucuguuaugcagcuuaugagguggcaacaucuuguacuucagagauucugaagccaagcagcuuccccaaguccuccuucuuuucccauuaacaggauaugauaccaccaagccaaacgucaucauuaaguuggagcagggagaggagccguggauaaugggaggugaauuuccaugucaacauaguccagguaaguuaguagcguaucaaagguuaaaaaaugcucaucccagaccuuugggagagacuaaagaguuguuuauauguauucaguacccucaguaacaccucccaacccccaaauaucacuuuccuucccgcacacauacaugaacucuuuuguugauuuuacauuugauuuacauugguagggauuuuuucauucuaaccgguacuggagacccauucacuuccucuuucuccagcauuauugguaacuuauuuacucccuugccauuacagaauuguuuuggguuuguuuguuuguuuguuuguuuguuuuggagacagaaucuuguucugucacccaagcuggugugcagugguaugaucucagcucacugcaaccaccaccucacagguucaagcgauucuccuuccucagccucccaaguagcugggauuacaggcacaugccaccacgccuggcuaauuuuuauauuuuuaguagacacaggguuucaccauguugaccacacuggucuugaacuccuggccucaagugaucugcccaccucagccucccaaagugcugagauuacaguccugaggcucccggccuuacagaauuguuuuguuuuggggcauucagaagucugacauaaaaaucaacuugagacuuuuauguucauuccuuuuaucuuccauuuucuuuccuuccuugcuuuaaaaauaccuuggacuuauuuucugcccucgauuuuauuuacuucuuuaggcauucagauaccaaaaccucauccuccaccuaugcuugugaacugagucacagcuuguggugucuguuauuucccaaaguccaugcucaguugaugugacgcuauagcacucccucagccuucgucucuuuccccacugcucaugacccgucuguguguucauuuccccuuccccauaacuggaaucaugcucuguccauaguagacauucaggaagugugaauuucauaagugaaugucgguuccuuuucuugccuuuucaggacugucccccuaggaccuguuuuccacuuuuuugguuuucuuuguaucccuuaaaagaguuuaucuaaucucaccuucuaagaccuuuuuuccuguguauuuuugcagcuugccuccaaauugauacgucugacacuuuuaaccuggagucuaguugaauauuuuacuugacaacauagcaguuaccagggagauaguucacuuccuucuuucucagaaugucugaugauaaacugugcacauuccaaaaucaugaauucugucuaccuuccucaccucccaguauuugauugugcuagucuugucuccaugguuuguguucuuugucuucugugaaaugccuggcagagcgucagcacauucuguuucuuucgacauucguguucaguauucucccauaccuggauuucaguggauccaucuuccauucaaaugaucauuguccuuuuccuucaucugcauuuuacuugcccacauaauacauauuuucccucccuuucuuccucuccucccucucucccuuccuucauuccuuccuuccauuuugagacagagucucacucuugucgcccaggcuggagugcaauggcaugaucucggcucacugcagccucccccucccagguucaagcgauuccccugccucagccucccaaaguagcugggauuacaggcgcacgccaccaugccuggcuaauuuuuauauuuuuauuaaaaaaaaaaccacacauaacauacaauuuaccaucauaaccauuuuuaaguauacaguaauguuaacuguauuugcauuguugagcaauaaacuuuagaacuuuaugcuuuacauuugaacugaaaagguuagcuccuugaaguuuccuucaugguucauugaccacuccagucuuuccuucucuuaauaucuauuccagucagcgauuguuaccucaaaaaguuagauaugauuuuacaguccgauaggauuauaugcucuaagaucauauucucugauaggaguguaugcucuaugaauauaagcucuaagauugugugcucugugauuauaugcucugauaggauuauauauucuaagauuauaugcucugauaggaguguaugcucuaugaguauaaacucugaugggauuauauauucaaagauuauauguucugauaggauuauaugcugugauaggaguguaugcucuaugaguauaugcucuguuaggauuauaugcucugaguauaagcucugauaggaguauaugcucugugauucuaugcuuugauaggaauauauacucuaaaugauuauaugcucugagagguaggugcauauauuuguugcuugagcuucuucuaccgaauuauaguccuccaaagaggaaagaccuuuuuacucuucuugcuuuuauaaugcaacauacaguaggcauucaguagguuuuuauugacuuaccaaggagcuagguaaaagaaagaucuuuaucauuaauccaucaagagaucauuuauucugaaccacagauucugauaaaacagauagggguuagauuagaaccuguaagcacccaucagauuaggaacuacuuuaauuucuauucagagagauucaaagaaaauaugaauauuuuccaagggcauagguuuugguuaggaaauaagauaaaagcugcaugaauuacuuuaaaauucagcuuucacauggauaauuuauacuccaaugcacauugugcaacuuuaagaagcuauuuuaaaauguaagggaaagagauucaaugaacugggaagagauuugauaaaugucuucaaguuucccccaaaguauagauagauuuugaguauagccaacaccaggagucaaauugaaugaggaagaucacgaguacagacuuguggcugagaauaagcaaggcauagccuaggcuuccaggagcagaagauguugacagauuaguggaaugcuagcuuggauauauauugugaguccaaguagugaaaaaucccguuaauaaccuuucuguuucuucuguugguguuuggggugcuggagcucagagauguuguagauuucugagcagaguaccaucaggguugcauugaaugugggugauagcagcuaaaaauaguuugugcauccaaaaauuuguaagauacauaaaaauaaaaguacaucauaggggcagcuuuaggaaucugagauauaagauuuuacaccaaaugaaacccaggaguuugggaacucuuguuuguauucagaauuaaguaaaagaauuauacagagacaugacugguuuuaggaaauuuaagucagcaaauugaaagaaaauuaauggcucaacuuaaugagcauuuguuuuauguuauaaacuguucuaagcaguuuacauguacuaauucaguccuuugacaacccuaugauuuaggcacucauauucacauuucagaugagugaaacugcaucacaguuacacagcuugaccaaaugcccuaguuaguaaauuguuggggguuugaacugaggugaccugcucugguggucaugcucuuaaccacugugcuauauugugcaagcagggaaagcagaauuuaauggcuaggaagguuagcuaguauuaaauaugacuuucaaaacacuucaaagaucugaucuuggguuuuuuguuuuguuuuucuuuuucuuuuuuuuuuuuuuuuauaguagagacaggguuuugcauguugcccaggcuggucuuaaacuccugagcucaggcgauccauccaccuuggccucccaaagugcuaggauuacaggcaugagccaccaugcccggcaugaucuuguuuuuaagauauucccuggccggccacgguggcucguguuuguaaucccagcacuuugggaggcugagguggguggaucaccugaggucaagaguucaagaccagucugggcaacauggugaagcccuaucucuacuaaaaauacaaaaauuagcugggugcgguggcgugugccuguaaucccagcuacuugggaggcugaggcaggagauucgcuugagccugagaaguggagguugcagugagccaaaauggugccauuguauuccagccugggugauagagcgagacuccaucuacaaaaaaaaaaacagauaccuugucuucuggucuaucuuauguuucuuuuggacauucacaugccuggaucucuccuccagaugaaugugaauccucucuguaaacgugaggaaaucaaagcauucagaaugcuuauuugcauuuauaugcagacuaguaaggcauggauuuuggaagggaugccaccaucguagucuugauaugaagugauaucuugcaguuuaauauaaauuguaauagaugucucccacauguaauccauaauggagucuuuccuuugcacggacaccuagcaccuguuuuuguuccuccugaucccauuuguaucggggaaccugccccgauagucacguagguucuuuucuauuuucccuaagcaucggcugguuugagaaauaaaggaacagaguacagaagagagaaauuuuaaagcugggcguccgggggagacaucacaugucgguagguucugugaugcuccacaagcugcaaaaccagcaaguuuuuauuagggacuuucaaaaggggagggaguguacaaacaggugugggucacagagaucacauacuucacaagguaauagaauaucacaaggcaaauggaggcagggcaagaucacaggaccacaggaccggggcaaaauuaaaauugcuaaugaaguuucaggcaccauugucauugauaacaucuuaucaggagacaggguuucgagagcaaccggucugaccaaaauuuauuaggcaguaauuuccucuuccuaauaagccugggagcacuaugggagacugggauuuauuucauccuuacagucucgaccauagacgacggccacaccuaagggggccaucuauaggcccaccccuaggcgcauauucucuuucccagggauguucuuugcugagaaaaagaauucagcaauauaucucccauuugcuuuugaaagaagagaaauauggcucuguuccacccggcucaccggcagucagaguuuaagguuaucucucuuguucccuaaacauugcuguuuuccuguucuuuuuucaaggugcccagauuucauauuguucaaacacacgugcucuacaauuugugcaguuaacgcaauuaucacaggguccugaggcgacauacauccuccucagcugauuaagagauuaaaguaaagacaggcauaggaaaucacaaggguauugauuggggaagugauaaguguccgugaaaucuucacaauuuauguucagagauugcaguaaagacaggcauaagaaauuaugaaaguauuaauuuggggaacuaauaaauguccaugaaaucuuaacaauccauguucuucugccauggcuucagccagucccuccguuuggggucccugacuucccacaacacauuugaucuaaguccucccaucuuugccuggaucugacguacuuucaaccacuucucugcucaucauuugguuuuauuucaccuuuucuaccaaaguuugaaacauaauauuuguaaagcaacaaaguuaccuguauucaauaugaauuuacucuucuauuuucuaccacugucucaccuuaauucuuucacuguguguguguguguguguguguguguguguguguguuucuguuuuguauuccaaaccaaaggaaaaagagaacuaugcauuuguaauuauuuuuauuuauggagauuggcucuaaagccagagucaaccccacaaugggggcucuugaauaccaguaccuuuccauagcuaguguguucagauuuacaaaguuuguuuacuauuuuuccuuuuuagaagccuggagaguugaugaccugauagagagaauccaagaaaacgaagacaaacauucaaggcaagcugcuuguaucaauagcaaaacccugacugaagagaaagagaauacauuuagucaaauuuacauggaaacaagccuuguuccuucaagcauaauagcucauaauugugucucauguggaaagaauuuagaaucuauuucgcaauuaauuaguagugauggaagcuaugcuaggacaaaaccugaugaguguaaugaaugugggaaaacauaucauggagagaaaaugugugaauuuaaucaaaauggggauaccuauucucacaaugaagaaaauauucuucagaaaauuaguauuuuggagaaacccuuugaauauaaugaaugcauggaagccuuagacaaugaggcuguuuuuauugcucauaagagagcuuacauaggggagaagcccuaugaguggaaugauucuggaccagacuucauacagaugucaaauuuuaaugcauaucagagaucacaaauggaaaugaagcccuuugaaugcagugaauguggaaaauccuucuguaaaaagucaaaauucaucauccaccagagggcucacacaggagagaaaccuuaugaauguaauguaugugggaaauccuucagccaaaagggaacccucacuguacaucggagaucacacuuagaggagaagcccuauaaauguaaugaaugugggaaaaccuuuugucagaaguuacaccucacucaacaccuaagaacucauucaggagagaaacccuacgaauguagcgaaugugggaaaaccuucugccaaaagacacaucucacccugcaccagaggaaucauucaggagagaggcccuauccauguaacgaaugugggaaauccuucucccgcaagucugcucucagugaccaucagagaacucacacgggagagaagcuuuauaaauguaaugaaugugggaaauccuacuaccgaaagucuacucugauuacacaucagagaacacacacgggagagaagcccuaucaguguagcgagugugggaaauucuuuucucgggugucauaccucacuauacauuauagaagucauuuagaagagaaacccuaugaauguaaugaauguggcaaaaccuucaauuuaaauucagccuucauuagacaucggaaaguacacacagaagagaaaucccaugaauguagugaauguggaaaguucucucaguuguaucucaccgaccaucauacagcucauuuagaagagaaacccuaugaauguaaugaaugugggaaaaccuuccuuguaaauucagccuucgaugggcaccagccacuuccaaaaggggagaaauccuaugaauguaauguauguggaaaguuauucaaugaguugucauacuauacugaacauuauagaagucauucagaagagaaaccuuauggauguagcgaaugugggaaaaccuuuucccauaauucaucccucuucagacaucaaagaguacacacaggcgagaaacccuaugaauguuacgaauguggaaaauucuucucucagaaaucauaucucacuauacaucaucgaauucauucaggagagaaacccuaugaauguaguaaauguggaaaagucuucucucggaugucaaaccucacuguccacuacagaagccauucaggagagaaacccuaugaauguaaugaaugugggaaagucuuuucucagaagucauaccucacuguacacuauagaacucauucaggagagaaacccuaugaauguaacgagugugggaaaaaauuccaccacagaucagccuucaauagccaucagagaauucauagaagaggaaauaugaacguacuugauguggaaaaucucugaagucagaucucaauuuuuagaaaacucucugaauauaaugaauauggggaauccaauaggaagucaaagcguuuaucugagaguucguguuccugaacggugagaagcauuuaggcauuagagucauuuuaauccaaauuuucacagagaagaaucccgaagaauguaacaagaagcaaagccuucagcaagaucauacgacucaucggacacuaauuuauauaggagugaaguuuuauaaauauuuaauauuuauuuuggauucaaauuguauuuacauaucagggaaucauacaaaggcaaaaucugucaauauggugaauguggaaaauauauugucuuggaaauuuguuguaaaagccauauuucuaauggaaaaucagguguuuacaggaaagaucucagaggcuaugagcucugaauaaaucuucauuguauaaaaugaaguuuuuaaauugucaggaguugaucaugaggacaguagcauuaaauaaguauauggccguuuuuuaucaugucuuaaaaaugcaaucuaaugguaauucuaugcaaguuuggaauuggaugacuugugaagaggcaguuuucuuauuugaguauuaggauggcaaaauguauuaagacaggacauauuguuggugagauaauauuuaauagguauaaaaugguaaaauaccuaguuuucuauuuagaggaauuuacaaauggguuuuuaacaaaugccucauuaguacaggaggcagucguuuuguaaaguuuucaacugcaucugaguaagauaagauuuucuaaaagacuauuuugauaaac

SEQ ID NO: 14509 - RNA, 6205 nt, Homo sapiens
gauggaaguggggccagccaccgagaccuucgugcuggaacuucaaugucuugaggaugggggcccagggccugacacccucucaggugagggccucgggggaucccuugacagagccucaugccugccugcuguggcagaaagaggcucaaggguggcgggcagccugcacagacucacaccagccaaccucagcugcauugaguaacaccagcagcucucccuugagauuuuccaagguggcugugucaggcaggcugaggccaggcuggugaggggcuccccgcuccccacaugggugcugacuggacuuaacacucacacgcgcugcuggcuggaacucauugcuguguuuccuggcagccagagggccuccaccauccucccaccuggccccagcuccugagucaauuuccacucaauuucccggauccgauucagguacuaauaggcucucuuccucugccccuccugccccagauguuggcucccuggcuucuucuccccuguggccucguaaccuuuuccacuuuagcuugaccucugcuugcaucuguuuuucucuaccugaugcccaggggcagaugugguacugcagaaccuuccaagaccucuuccucugggacccacucugggcaaaccuucucugguggccacacucaugagagccaguuuccauucugugcuuuaagggugcugagugagggccuggggcagggcgggacagagcuugaaaaggaccaagggaauuggagggggugggauggggauguguggagucaagaaggaccguucugaccgagcaugauggcucauuccuguaaucccagcacuuugggaggccgaggcgggcagaucaguugaggccaggaguuugagaccagccuggccaacauggugaaacacugucuuuacuacaaauacaaaaaugagcuggguguggugggcaccuguaaucucagcuacucgggaggcugaggcagaagaaucacuugaacccaggaggcagagguugcagugagccaggaucaugccacugcacuccagccuuggugacagagugagaguccgucucaaaaaaaagaagaagaggaaaagaagacccuucugacuuguaaauuuaccugacaaaacuuugggaggguauacacgucagacaacacuggacuagauguucacuaaaaugccuuuguuaaaaaugcugaggucaggcacaauggcucacaccuguaaucccagcacuuugggaaaccgaggcagguggaucgcuugagcucaggaguucgagaccagccugugaaacauggcaaaaccccaucucuacaaaaaguuuaaaaaauuagcuaggcgugguguuguguaccuauagucccagccacuugagaggcugagaugggaggaucgcuugagcuugagagguugaggcuacagugagcugagauugcgccacuacacuccagccugggugacaagagugagauccuguuuaaaacaaacaaacaaacaaaaacugaaauugcugccccagggagucagaguggccuguggucaagacugugccagaaaagaggagacucaacacagaggcaugaucugucucauuccucccagaagaggugggagaaaggaggguccaugagacauuggacuugcuggggggacaguuuucacccugucuucuaccaugugcuuccccccagccaaugucagugucuaugaaaagcacgcucacggaucuguuagccuaaccaaagguuauuaggaauauuuuacuagaggaaauuauaugcauacagaucucccuugguggauuuuuuuuuuuuuuuuuuuuuuuuugagacagagucucacucuguugcccaggcuggauugcgguggcucaaucuugacucacugcaaccuccaccuccuggguucaagcaguucuccugcugcagccucccgaguagcugggacuauaggugccugccaccaugcccggcuaauuuuuguauuuuuaguagagacaggguuucacuaugucccuuggguuguuguuuuuguuuguuuguuuguuuguuuguuuuuuugauaaggagucuugcucugucgcugggcuggagugcacuggcgugaucucagcucacugcaaccucugccuuucagguucaagugauuccccagccucagccucccgaguagaugggacuacaggcgcacaccaccacgcccgacuaauuuuuuguauuuuaguagagauaggauuucgucauguuggccaggauggucucaaucuccugaccucgugauccaucugccucggccucccaaagugcugggauuauaggcgugagccaccgcgcccggccaucccuugguuuuauuaaaucaauauauucuuggaaaaauggccagaaagcaaacuuuuauaaaucaaagcauugucuuccauuacaaaauggaaaacauaugauguuauagggagaagagauguugaaaucagaguugggaacggagaaagccuccucaagucacauguagaaagaaggauugggauuuuccaguagcacaauaguaauacucaaaacgagaaucucaugguguacacggugcggaaagagaagcguaguaacggaguggugcuguuuuugcagggccucccagguuuaugccucccaaaguguugcgauuacaagcaugagccaccacgcccagccuaguuaguccuuuguauuccugaaugacaaucucaaacagucccagucuccuugguauuuuuuuguuacuuugcaaaccaauccuaaccuucagagagagggaauuuucaagcaccuaccaggcuccagguacuaugccagggcucuccuuguuguacuguuuaagcagaugguguggguaucacugagcuauuuuguagacaggacugugagccugcaggagguuguauaccugccgacugguagaguuagguucugaacugagaacuuccugucugaaaccuaguggucucucugacacuuuggugauuuugggaaacuacuugugguaacaccuccgggcagcuuuauauaaauucuuuauuauuuacagagaaggauaauuucauuuauuuaagguguggcuguaaggucggaguucagcaugggguugauggcuuggccguugggacagccaguucagugguuucuacuggagggugauuaagcgcaagagacuucucaggauggucagggagcccccagcaucccugcuagugccagugccgagaucagagcauggggccuguguaaagggaagcuccaaggagggaucagggagcugggguccagagggaggucaccagcagucccuuggccaccuaccuuccuuccuucccuuccuucccuuucuucccuucuuccuuucuuucucucucucucuuucucucucucucucuuuugagauggacucucccucugucacccaggcuggagcacaguggugugaucucggcucacugcauccuccaccuccugaguucaagugauucuccugccucagccuccuuaguagcugggacuacaggcaccuggcagcuaauuuuuuguauuuuuaguagagacaggcuuucgccauguugcccaggcugguuucgaacuccugagcucuggcaaucugcccaccucggccucucaaagugcugggauuacaggcgugagccacugugcccggccaccugggcacauuuccaagccaccccugccccugcagcauuucaguuucugcugggcugcuauuguuacucgauccagcacuuucgggcuccugcuaagagcguguuaguguaucuuugagggcaggguaaggggcagguccuggggucugcaccagagagcuuccuguagaucuuucucucuuggcuuccugccauuucuuccacagguggcagcggugggagcgagagucaggaggaggaagagccucaggagaggaacagcaguccacagcggccagcagucucggccccagugggggccagugaaaucgcugaggaaacccggccgggacaacgagaguugcaacugcagcaguuagaacagcagcccgagccgcagcaacagccgcaacacgagcagcugcaacagccgcagccacaccuagaacugcaacagcagccgcagcaagaugggcaacaacagcuaucucaacuacaacaggaaaaacaccaauccgugcaccaucaggaacugaaaccagaacugcagcuaaugcaccagcagcaacaguuacagccacagcaagugcaagagcaacagcgguugcagcagcagcaggagcaguuacagacgcagcaagcacaagagcaacagguauugcagcagcaggaacagcuacagcagcaagugcaagagcaacagcuguuacagcaacagcaggaacaguuacagcagcagcagcugcuacaacagcaggaacaguuacagcagcaacaguuucaacagcagcaggaacaguuacagcagcagcagcagcuacuauugcugcagcagcagggacaguuacagcagcaacuguugcagcagcagcaggcacaguuacaacagcagcugcuggaacagcagcaggcacaguuacagcagcagcuacugcugcagcagcaggaacaguuacagcagcagcagcaacagcagcuguugcaacagcagcaggaacaauugcagcagcaacaacugcagccuccuccccuggagcccgaggaggaggaagagguggagcuggagcucaugccgguggaccuggggucagagcaggagcuggagcagcagcggcaggaguuggagcggcagcaggagcuggaacggcagcaggagcagcggcagcugcagcucaaacugcaggaggagcugcagcagcuggagcaacagcuggagcagcagcagcagcagcuggagcagcaggaggugcagcuggagcugaccccgguggagcuaggcgcccagcagcaggaggugcagcuggagcugacccccgugcagccggagcugcagcuggaacuggugccagccgcagggggcggcggagcggcggucccgggggcuccggccgcggucgugguggcucccccgggcuacgugguggugcaggagcucauggugcugcccgccguggcagcgccggccgugguggccaucccgggcccggcaggcagcgcggcguugaccccugcacggcagcggcggcggcggcgcgcucgggaccggccgaccaucugcggggagugcggcaagggcuucagccgcagcacggaccuggugcgccaccaggccacgcacacgggugagcggccacaccgcugcggcgagugcggcaagggcuucucgcagcacucgaaucuggugacgcaccaacgcauccacacgggcgagaaacccuacgccugcuccuacugcgccaagcgcuucagcgagagcucggcgcucgugcagcaccagcgcacgcacaccggggagcgacccuacgccugcggggacuguggcaagcgcuucagcgucuccuccaaccugcugcgccaccggcgcacgcacucgggcgagcggcccuacgugugcgaggacuguggcgagcgcuuccgacacaaggugcagauccgccgccacgagcgccagcugcacggcgcgggccgcuccaggggccucggccugcugcgcgccucgcggccggcggcccucgguggcccagcccgcgcggagcaggccgcuacagccacugcgcccgcagacaaggcgcugugagggccgugaucggggcugccuggccgggaggggaccccccacccgccuccaccugaaaagcuccuugacccggguucaugggcgcuggaggcguccuggaauaucccuggaguaaaaggcuuccaccaucaucaucaucaucaucuuccggauucccugagaaaauaccagguucacagauuucaccgccagaaaaauccauccgccaaaagagaaguggaccggggcugaaacagcacacgggacacguuugucugcccuuugaggggucugccaaagguuuucccuccgggaaaacuggacuuacuacgaacgaggaaaaacccccaguggcgagacgauuaaugacacuggccgaggacuggacacccaccagggaaucaagacguggugagacacacguggaaaaucuucgauccuggugaaaaugaucgcaaggagaaauucggggagga

SEQ ID NO: 14510 - RNA, 56664 nt, Homo sapiens
cggcggcggcggugcccggauggaggcacgucauugucccccgccgggcggcugggcugugugcggcggcggcggcggcggccgagggggauggagcgagcgccgagccgggucagguaagcucccgccuccuucccgcccgccgcaggccggcauggggcccgcgcagcggcccgcucgccugggccgccgcuggcucggccgccccucagccggcgcggcccgccgggggcuggugcggccccucgcccgccucccccuacacagccgcgggccgcccgggaccccgccgcucugggggcugcggcgccaccgcccgcccgggccaggccgcuggggagggggcggcggccgcggcgggcgggcaccgggguagccgggcugcgcggcgaggccgggccccccugguugccauggacacugcgcucccacccccacccggccccagcccgccccuucggccugggggccgggcaggcaggcgggaggcucggggcggccggggugggcgugugcuggccgcugaccgcggaguccggcguccccggcccgcccgccgccccccgcguggcugccaccucccgccccggagcccccucagagccccgggccggccuccccgcccccacugcaucccuaacagaggcaaaguuuucccaccuugggcgcccccuccccaggccuagccaccuggcugcuccguggagaguccgaggugcccacgccgggcggagcggccaccccgaagggagaggagaagccggguggcgcguccccaaaagcaugugugccucucuagcguuuuuuauuuucggggcaggaagagccagcuuaccuggaacgggggauccguugcagauguuggaaaugaaaauuggacggaacaaguuuucccaucuaggacuuuaaccccucucacaugcaugcaguggagaugacuuuuguuaaugacucuuaggaggccguggggucacuuguuuaugggaaaacauguugguuauguaaagucaauacccugacagcaaaacuguuugagaaacuaguuaacgccuccuuuucaagguaaccacagaauccuagguucucguuuugguggccucucaaaacguuucgaagaguuguacauuuuaaaccuaauucuuuuuacuuugucacucauucaaauugccuaggggauaugaaugaucaguuucacuuauuuguuuuaaauuagggucaguuucacuuucucuucuguaucuuugaaucaagucuacaguaaguauuugguuuauaaaguuuaaggccagucguuugguuuacuuaaguauaauuaagacgaagguuuugucuuuuuaaagcguguguguuuucucuuauaacggaaaugcuaugagaacguggauuacauuguuuacgaagaagcagagcguaacaguuucucuuuaaacgugcuaauauuauuaccucaauguaugcagagugccacagugucuaaauagugaaacuccacaaaugaagaaagaauaaugcauucuagcauuugauaacaagggagacauaccauauaagagacugggaauuuuaaagcuuugaguaagacuaguauuuaaagcaaaggaaacacuugugaagucucauuccuccacacagauccaaccucgauucauguucauguuguuuuuuugaggcaagaucucccucugcugccuaggcuggagugcaguggcgcaguuguagcucacuguagccucaaucuccugagcuccagcaguccucccaccucagccuccuaaguagguaggacuacaggcacaugccaccacacccagcuaauuuuuuuuuuuuuucuuaaagagacagggucucacuguugcccaggcuggucugcaacuccugggcucaagccauccugcugccuuggccucccaaaguguugggauuacaggcuugguccaccaugccccaccuguagguuguuguuuuaaugcucuuguaacuuuuauauaucaucagaagcuguugcuuacaaguucugauauuuguaacaguaauauuuagaagcuuuacugaaagugaggaacaugcaaguauaugaaucuuaaguccuacauaacauuguuuagcuucaagaaagguuauguguguagcagauggaguuuaguuugaugccugaugguuuuaggucaagacuucauuggcugaauauacaaaugaaggcgaauggauagcuuugguugguuuuuccacaguuacaaugcuguaugguuaaugaugacuugaauugugcuuucguuaaauuuuuuuucacuuaagaggcuuuugucccuuuuaaaagguaauuggagcaaauaaaaugguuuuauuuggucauuuguuagugauuguucugaagguauguuuauccccugaaaauuaagguuuuuguugcuguuuaguguuacuguaaauaaggcuggauuaaccuuuucuuauauuucuuacaacucuauuugggcuuucuucuuccuuuucuuuuuuuuuuuuuuuuugagacggaguuucacucuuacugcccaggcuggagggcaauggcgcgaucucggcucaccacaaccucugccuccuggguucaagggauucuccugccucagccucccgaguagcugggauuacaggcaugcgccaccacgccuggcuaauuuuguauuuuuaguagagacgggauuucuccauguuggucaggcuggucuugaacuccugauuucaggugaucugcccgccucguccucccaaagugcugggauuacaggugugagcaccugcgcccggccucuucuuucuuuuuuuccugcauuuuuuucuucuguccccacacuguuucauaauuucuuuuaacuauuagaugaggaaaaauguaaacuguauuuggaggauaaggcucaagcuuucuuccugauugagggucagcuaccuuugauugauuuaaauuuucaauucaguuuucuuaguucauugaaauugacaaacaucuuuucuauuucuacuugaguucagaaacuuuaagauuguauuuuuuugggugauaaucuuacccuaguuaaaaauuacaccagccuggccaacauagugaaacccggcuccacuaaaaauacaaaaauuagccgggugugguggcacgcaccuguagucccagcuacccuggaggcugaggcaagagaaucacuugaagccaggagguggagaagguugcagugagcugugacagcgccauugcauuccagccuggguggcagagcuagacuuugucucaaaacauaacaaaacaaacaaacaaaaaaauuacaaguaacaaaauugaugcuuuuaaaaaacaaauuuggccagguucuguggcucaugccuguaauuccagcauuuugggaggcagaggcaggaggaucguuugaggccaggaguucaagaccagccugggcaacguagugagacccugucucuacaaaaaagaaaaaccccagaaaguuauugugagcagccaguuuggaaaguacauggguauuuuauuaucccuacuucauagcauggguaguacuuuuuuguacuuuuacaguauccuuuucuuuuaaagacagagucucgcucugucgccaggcuggagugcaguggcgcgaucucagcucacugcaaccuccaccucccggguucaagcgauucuccuaccucagcuucccgaguagcugggauuacagacacgcaccaccaugcccagcuaauuuuuguauuuucaguagagacaggguuucaccauguuggucaggauggucucaaucuccugaccucgugauccacccgccuuggccucccaaagugcugggauuacaggcgugagccacugcgcccagccucaauauuaaaaaaaaaauuuuuuaaggccauuucuacuccagaguuuuuuaaggaucaaaugauauacuguauguuaaucauucagcacaagcuggugcuaaaagcaaacgcuaguuguuuucuguucccagacuuuguucauuaaguuguucuccacauguauggaaagcuuucucuacaccaggucagaggaugugaauaagaacaugguagagaacagcaaguaaaacagcuguggaguagaugccagcacaguaccguagaaaucagcacagggugcugugggggccuugaggagggguuucuaaccccgucuugggggaauggugaugucaaggaaagugucccagagaaaguaaagucuaaacugagaaguggaagugugaacuggcuggagguggaagguuggaaaagagucggagaaaagaacagcaugugcagagcccagagacagcagggacaaaagaaaaaaaaacaagacuucagcauggugggaacgugacggagaggguguuuggcgagguuauuaggucagacaaugugaaguccagacauuaagauguugugcugugggcaguugggccacuccugaaagguguucuuucuuccuuuccuuuucuuucuuucuuuucuugaggcagagucucucuaugucagucuggagugcaguggcaugaucucggcucacugcaaucucugccuuccagguucaagcaauuuuccuugccucagccucccaaguagcugggaauacaggcgugcgccaccaugccugguuaauuuuuuuauuuuuaguagagaugggguuuccccauguuggccaggcuggucucgaacuccuggacucaagugauccacccacuuuggccucccaaagugcugggauuacaggggugugagccacugcgccccgcccggccuuuuuuuuuuuuuuuuuugagacuuaaucuugcucugucaccaaggcuggauaucaguggcacgguuuuggcucucugcaacuucugucucccagguucaagcgauuuuccugacucagccucccaaguaguugagauuacagguacgugccaccacgcccggcuaauuuuuguauuuuuaguagagaugagguuucacuauguuggccagacuggucucaaacgccugaccucaggugauucaccugccucggccucccaaaaugcugggauuacaggugugcaccaccaugccuggguaauuuuuguuuuucguagagacagggucucaccauguuggccaggcuggucucaaacuccugaccucaagcgaucugcccaccuuggccucccaaggugcugcaauuauaggcaugagccaccgcgcccggccuccugaaagguuuucuacauaggaguggcaugucuagauguggcuacuguugggcgauuuuagaaauaucccuaaaagccuucuguugacaggguggcauaaccagaaggaagccuggcugggaacgcuggaccuggcucucagucccaguugcugacugguugcuucauuuuauaggcccuggggauucugucugaucucucauacguucuuuauaaaaauuaaguuaauguauguccagcaguugaugcaaugcccaguacauagaaaaugcucaauuagugguagcccuaauauuuuaaaauaggacucagaaagaaaauuauaaucaaguccuuucauaacagauauuuguguuugaguuugauaucaguaauggcuuacggguuuuauuuaaaaagucauacauuccauauaaaugagccucuucagaaaaaugguuuuaaaggugagaucucuauaauuauaauuuuaaaaaauauaauguauuucacuuggugccauuugcacuuuaagcacaaaauuaagucuagauuuuuucuguguaguugaugcuuuucucugaggaauuauacucaaauugaagauguagucaaauguauuacuguguauaauuuuucuaguuuuaagcaguauagaaggaaaauauagguacuuaguaaauaaacagaacugagaauugaaauguccaauuauaaacugaaaugccagacuuuuagggggcaugaaaugaaaaugagaaguucuuuuaaucaaauacuucacugaagauuuuaaaauaaagauuguugacauucagauuaucaugaugcuaaaugucccaaggggauuauuacagaaauguuagaaaguacuauuguuuuuauauuugagugauguguuugaaaaucacuuuaaaauggcuggaaugaucuuccaagaucuaacgguaggguaaggagauugcuuuucucaccugaugaaacaaauacauacuuuucaucuuuugcagaguugaacaaugaccauaguugacaaagcuucugaaucuucagacccaucagccuaucagaaucagccuggcagcuccgaggcagucucaccuggagacauggaugcagguucugccagcuggggugcugugucuucauugaaugaugugucaaaucacacacuuucuuuaggaccaguaccuggugcuguaguuuauucgaguucaucuguaccugauaaaucaaaaccaucaccacaaaaggaucaagguacuguuuuucaaaagagagaauuaccgccagaaacuccuguguaaaugcugcuggggcuuggugguuucagagaggggcuuauuuugcaaggcgugaggccaccugaguggccagcagaguuguauuacuugaugggcuuuguuuuccuguuacuuguucgucauugacugacaacaggguagauuguuuuuaguugcuagaauauuauuaguuucuuuuauuccaauuuuuuuuuuuuuuuuugagacggagucucgcucugucacccaggcuggagugcaguggcgcgaucuugacucacugcaagcucugccucccggguucaggacauuuuccugccucagccuccagaguagcugggacuacaggcgccugccaccaagcccggcuaauuuuuuuuuuuuuuuuuguauuuuuaguagagacggggguucaccauguuagccaggauggucucgaucuucugaccucaugauccacccaccucagcguccugaagugcugggauuacaggcaugaaccaccacgccaggcccuuuuauuccaguuuuuuuuaagaauaaacuuuaucuuggugagaauugagaugggcaagcauuauaauaacuuguuaaccaguaguuauucuaguuuccuaaguagaugacuuuuacaaauuuaaagguguuuuguaaaaugguugucuuuugacaaaugagcuuuacccaguuuuuuuuguuuuuguuuuuguuuuuuuccuggcaguuaaaaaucauucguaguaauaaagcucuuugaaagagagcagauaggcuaggcaugguggcuccaccuguuaucccagcacuuugggaggccaaggcagguggaucaccugaggucaggaguuugagaccagucuggcuaauauggugaaaccccaucuccacuaaaaauacaaaaauuagcugggcaugguggugugugccuauaaucccagcuacuugggaggcugaggcaggagaaucgcaugaaccugggaggcagagguugcagugagcccaagaucgcaccauugcauuucagccugggcaacagagugagacucugucucaaaaagaaaaaagaaaaaaaaaagagagcauguaacacaaauguuacauuuguuauaaugauacaaaugugguuacauucguuaaaacucauccagauaaaugagacaguaacacuuuaaguugguacuucaagacuuuugcauuugaggacaugaagauuugaaauacaauagaauuuccuaguuagauuguuguuuggcuuagagcaugcagcccagacagcuuugaaugcagcccaacacaaauccguaaacuuucuuaaaacauugaguuuuuuugagauuuuuuuuuaagcucauuagcugucguuaguguuaguguuaguguauuuuacguguggcccaagacaauuugucuuccaguguggcccagggaagccaaaagauuggacacccccuggcuucgaguaguuugaucgccauguuguuuuugaguccuuuaguaaguuucuuuuuuuuuuuuuuuuuuuuugagacagagucucgcucugucgcccauucuggaaugcaguggcgcgaucucggcucacugcaaucucugccugcuggguucaagcaauucuccugccucagccucccgaguagcugggacuacaggugcgcgccaccaugcccagcuacauuuuuguauuuuuaguagagacgggguuucaccaugcuggccaggcugguuucaaacuuauaauccacccgccucggccucccagagugcugggauuacagguguaggccacugcacccggacaacaguaaguuucauauugugauguggggguggguguugcaguuuggcuugcugaagguguuuuggguaggggaaguuuauaucaugaaacacaaccuaaucgaauguugcacauggagguggaaaguccuuuggcuucucuccagcaggacuuucccacaggaccucuuucuccacggccuucaaccuccugucauguugcuggggcuucucucucuucuuaggacugaacucacaucuccccacucuccccuuuucuggggcucucaucucauucuccacagaauccuuucuuuuguccuaauuuugcucuccuuuccccaccaagcuguagccugccuacgccugccuaaauaaccacuaauaagucucuucagauggagaaugauucuacauggcaucucagccuuuugguuuuuuuuguuuuuguuuuuguuuuuuuuuugagacgaagucucucucugucgcccaggcuggagagcaguguugcaaucucggcucacugcaaccuccgccucccggguucacaccauucuccugccucagccuccugaguagcugggacuacaggugccugccaccacaccuggcuaauuuuuuguauuuuuaguagagacaggguuucacuguguuagccugaauagucucgaucuccugaccuugugauccgcccgccucggccucccaaagugcugggauuacaggcaugagccacugugcccgacccaaucucagccuucuguuagagcacugggggacugccaaagccuuugaaaaauuagucuugccauugaugauuuucagcuuuccuaaauaaguuguuucuugagcuucaucuugaguuccauuaucauacuuaguuauuaguaaucuguugauaaucuucaaaauuuuuaggucauagguagucuccucacaaguguguacagugguaccugauagccugaguucaaaaccugcuuccuuagugguaaaaugggaaugacaucagcaccagccauuagaauugcagccauuuggccuaguaagggcucccuacaugagaugguaaggacggcagugaugguggcaaugaauuagcauccauggcagauguuacaaggaaucaaauguaucucauuuuuucuauugauuguauuauuuauuuuuuaaauguucaaaguggauauaaaagaguaauuauaaugaacucucauguagccgucaaccaacuuugacauuuaucaacuuacgggcagugauaccagcaccuccuuaucuccccacgacauuaucucaaauccaauacuucaucuuucacuuguauuuuaguguauacaucuaaagaguuuuuucuaaaaaucaaaaauguauuuacaugaaacagucauucaguguucauauuucucugguuguuguuuuauguauauauaaaauauauauacauaaaauacguguguguguauauauguauguguguguguauauauauauauauauauauauuuuuuuuuuuuuuuuuuuuuuuuuuuugagacggagucucucgcucugucucccaggcuggagugcaguggcacuaucucagcucacugcaagcucugccucccggguucacgccauucuccugucuuagccucccuaguagcuaggacuacaggugcccgucaccgcgccuggcuaauuuuuuguauuuuuaguagagacgggguuucaccuuguuagccaggauggucucgaucuccugaccucauaauccgccugccucagccucccaaagugcugggauuauaggcgugagccacugugcccggcccuauauauauauuuuuuuaagcaguuguucagagcagcauccaaaugaagucuacacuuugcauuugguagauauuucucucaaguuucuuuaaaucuguaacccucuccccuuucuguccuugcaguuuguuuacuggagaaaccagaucauugaaaauuucucauguucugguuucugucuuuuaaaaugucccucuucccccuguauuucagguaggcuggucaugagauuucggaucuuguaaagauugagguuugaccagguguuacuauuuauuuagcuucaguaugcaaagcuugguuucugacucuuucuuguuuauuuuucuagcccuaggugauggcaucgcuccuccacagaaaguucuuuucccaucugagaagauuugucuuaaguggcaacaaacucauagaguuggagcugggcuccagaauuugggcaauaccuguuuugccaaugcagcacugcaguguuuaaccuacacaccaccucuugccaauuacaugcuaucacaugaacacuccaaaacauguaaguguuccguguuguguuuguaguauuguagugcgcuaaccuacuuucauuuuuuccucugaaaugaaagugaagaauuaauccaagagugcuaugauuacuaagaaguugguuuauucuuuuagaaaccaaggaggaggacucaggauugggauucagguugcaugaaaaacauuuugcaccuaauuagaccugugaagguauuuaaaaagaaacauuuuaucagcuuuuggcauuucugaacuccuuguugguuuucuacacuuacuaaaaaaaugugacagaaauaucugacauuagcugggcucacaccuguaaucccagcacuuugagagaccgaggagaaaggaucacucgagcccaagaguuggagaccaaccuggacaacauaguaagaccccaucucuacuaaaaauaaaaauaaaaauuagucuagcauggcagcacacaccucuagucccagcauacucaggagggugagacaggaaggucaccugagucuggaagguugagacugcagugagcugugaucgcacugcuguacuucagccuagacaacagaaagagacccugucucaaaaaaaaaaaaaaaaaacgucugaugccagcaacuugggacaggcgagguuaagaaauccugccucuccuggcauuuauaucauguuggaaggcucaaucauuuacaugcuuauaagccuuagaggagagggacucucuugucacugcccgcaaccuccuggaauucagacuagacuuucccuuuagcauuugagaacuucaucuucaaccuacauggcaggaaaucaguuaaagcuuauuaaaaugucuuuaauuagauggaagccaacucagugguugacuaucaaccuucagaauuuggaacauccguuuuugagguuuuggccuucuccauauguuguaaauauccuucauucuuuauaaaugcagucucccuguucuuugaucuaaauuaauggcucagauucauguguguauguucuggggcuauuaguuacuaggauuuaaaaaaaaaaauccuugguuucuuuuugaauaguucuuuacuuaauggagaauuuaaauugguucuuuuaaaacugauuuuuuuuucccuccaaagagccaaguaaugcuuguaaagaauuuggaaaguacagaaaaacuuaaagaaaccaaagaaaaaucaccuagaaucucaccaccuaccuagggguguuuguuaugccagaauuaacguucuguuugcccucauuuucucccuuucucaguccauaauucauuccccacagacagcuuuccuaucacuuuugcgcuuaaugaaaguaggguguggaugaaaacccagcacuagcaccuggacagcaagagagaggaccaagacaaaauucagaagcucccgauguccagaauuaggugccuaucuuuuaugcuacugguaguuuuugugcuugcuuccucccucccucccuuccucccucucuuucucucucucuuuucccagcuuuacugaaguauaauugauauauaccaaauuacacauauuuaaaauacauaauuugaugcauuuugacauuuguauacacccguggaacuagcaucaagauuaagauaaugaacauguucaucacccucaaaaguuccccgaugccccuuugaaaucacccuuuccauccuuuccccacccuccugcccggcaaccacugaucugcuuuccgucacuauagaugaauuaguuuagauuuucuagaguguugcuuauguggaauuguacaguauauauucucauauuaucucgcuucuuucacucagcauaauccugucaacauuauuccauuugugccauguagcaucacuugaucguauuguugaguaggauuccauuuuauggcuagaucacaauuuguuucuccauuugucuauugaugggcaucugggucauuuuucacuuugugccguuacaaauuaagcugcuaugaacauuagcaaacaagccuuuguuaggacauguuuucauuucucuuagguaaauaucuaggaguaaaauggcuugguccugggguggguguguacuuuaacauuuuaagagacuuccagacuuuccagaagggauugcaguguuuuauagucccaccacuggugaaugaaucuuccauuugcuccacauccuucccaauacuugguggggucagucuucuucaguuuuagccaucuccauagguguguagugugguaguauuuuguugugguuuuaauuuguacuuucauaaugaauaaugcugaaccucuuuucuuuuuuguuuuguuuuuguuuugaacaucuuuucaugugguuauuugccauccguauauuuccuuugcuaaaaugccuguugaaaucuuuugcccguuugaaaacugguaguuuucuuauuguugagcuuagagaguucuuuauauauccucgauauaagucuuuuauuauguaggcugggauuugucuuuugauucuuuucagugucuuuuaaagagugcauuuuuuguuuugggaaauuucauuucuuuuuuuuucuuuuuauucguugugcuguagguguuuuaagaaaucuuggcuggguauguggcucaugccuguaaucccagcacuuugggagaacgaggcagguagaucacuugagcccaggauuucaagacuagccugggcaacguagggagaacucaucucuauauauaaaaaaaaucaaaaauuaggccagguguggugguucauguguuuugggaggcugaggcggguggcucacuugaguucaguaguuugagaccaguuugggcaacauggugaaacccugucucuauaaaaaauacaaaaauuaucugggcuuggcggugugcgccuauagucccagcuacuugggagacugaggugggaggaucacaugagcccaggagguugaggcugcagugagccaugauugugccacuuuauuccagucugggugacaguaagaccaugucucaaggaaaaaagaaaagacaagaaaaaaaaaaaacuuugccuaccuacaggucacaaauauuuuuccuauacuuucuucuagaagucuuaaaguuuuagcuuuuguuuuugggucagugguccauuuugaguuaauuuuuguuugugaugugaagauggagcaaguuuauuuuuuugcauauggauguucgguuguucuagcaccauuuguuggaaacauaauccuuuugucacuaaauugucuuugcaccuuuaucaaaaaucaggugauugaagcacuuuagacagaagaaaaaaaaucaguaagccauaucaauacgaucuauuucuggacucuauuauguuguacugaucacuuguuugucuugacaccguaacacaauguuuugauuacuauauauuuuaaaguuuuguggccaacugcaguggcucaugucuguaaucucaguguuuugggaggcugaggcaggaggacuguuugaacccaggaguuugagaccagccugggcaacaugucaagacccugucucuccaaaaaaaaaaaaaauuagcugcaucugggaacucaugccuauaguccuaguuacuucggaggcugaggcaggaggauugcuugagccugggaguuugaggcugccgugagcuaugauugcaccacuguauuacagccugagugauagagugagaugcugucucaaaaaaaaaguuuuggaaccagguaaguccuccaacuuuguucuuucuccgaguuaugcuguagccugggcaacauugugagaccucgucuuuacaaaaaauaaaaaaaauucucuggguguggcggcaagcgcuaguccuggcuacuugggagacugaggugagaggcucgcuucagcucaggagguggugacugcagugagccauuauugugcagguacgcugcagccugggcagcagagugagaucuuacgucaaccaaaauaaaaaaguuguucuggcucuucaugguugcuuggccauuuguauuuucaaaugaauuuuagaaucacuuugugaauuucuacaaauaaucuuccugguauuuugauugggacugugcugaauauuuaaaucaauuugaugugaauugacaccuaaacaguauuauuuucugacucacaagcaagguauaccuauucauuuaggccuuguuuuuuguuguuguuguuguuuuguuuuuuuuuagugacauucuugcucuguugcccaggcuagaguacaguggugcacagucagagcucacugcagccuugaccuccuuggcucaagggauccccuugccucagccucaugaauagccaggacuacaggcaugugcuacaacaccuagcuaauuuuuuguuuuuuuguagagacagucucaccauguugcccaggcuggucuugaacuccuacgcuuaagcgguucucuugccucagccuuuuuuuguuuuuguuuuuguuuuuugagacggagucucgcucugccgcccgggcuggagugcaguggcgcugucucggcucacugcaaccuacgcccccggguucacgccauucuucugccucagcuuccugagugguugggacuacaggugccugccaccacgccggcuaauuuuuuuguauuuuuaguagagaugggguuucacuguguuagccaggauggucuugaucuccugaccucaugaucugccugccucggccucucagaguguugggauuacaggcgugagccacugcgcccggcccuuuuuauuugcucugucacuccagguagagugcagugccacuaucuccacucacuguaaccuccaccucuucgguuuaagugauucuccugccucagccucccagguaacugggauuacaggcacgcaccaucacuucuagcuaauuuuuguauuuuuaguagagaugggguuucacaguguuggccaggcuggucucaaacuccugaccucaagugaucugcccgacucggccucccaaagugcugggauuacaggcaugagacacugugcccagccucuugccucagccuuucaaaguguugggauuucaggcaugagccacuaugccuggccuaggccaucuuuaguuucucguugcccaggcuggagugcaguggcacaaucucggcucacugcacccucugccuucuggguucaagcaauucuucugcuucagccucauggguagcugagauuacaggugcccaccaucaugcccggcuaauuuuuguauuuuuaguagagaugggguuucacccuguuggccaagcuggucucgaacuccuggccucaaaugauccaccugccucggccucccaaagugcugggauuacaggggugagccacugcacccggcuggaauaaauauuuucauuaacuauuacaaaggguauuuuauuuuuaaaauuucaacuuacugauuguuuauugcuagcauauagaaauacauuuuucagauuuugaucuuauaucuuggaaccuuaagucacuuauuaauucuaguagguuuuuuuuuuuaagaucccuuaagauuuuauagacgcaacuaugugauacgugaauaaagauaauuuuacuucuccauuuccagucuguguagguucuuuauuaauuuuucuugcuguuuuuuucuaguaaagagaccuccauuacauuguuaaauagaggugauaagaguaaaaauccaugucucuuucucagccuuagaggaaaagcauucagucuuuuaccauuaaguaugguguuguagguuuuucauagaugccuuuuaccagguugaguuguuugaugcuugaauguuaaaccaaccuugcauuccugagaugacucacacuuggucaugaugcauuauucuauguauuacuggcuuugauuugcuaaaauuguaaaacaguuuugucuucguaaguauuauuagccuauaguuucuuauaaugccuuuuuuuuuucuuguuuuggcauuaggguaauguuggcaucauggcauguguugggauauguuuucuucgcaucuguuuccuggaagaguuuguacagaauugauguuauuucuucuuuaaauguuugcuagauuucagcagugaagccaucuggaccuugcaguuucucaugggcagguuuuaaacuacauucuucuuuucuuuguuuuguuuuuagaagacaggaucuugcucuuuugcccaggcuggaguacaguggcaagaucauaccucacugcagccuccaccuccugggcucaagcagugcucccaccucagcuuccugaguagcuagaggugugcaucaccacacacagcuaauuuuuaaauuauuuuuguagagacgaggucucacuauguugcccaggguagucuugaacuccuggcuucaaaugauccuccccgcuuggccuccaaaagugcuaggauuauaccaccauacccagcuuucugucuccuuuuucguuugaucaaucugaccagaaguuuuuuaauguuacugaucuucucaaagaacgagcucuugguuucauuguuacaguuuucuguuucauuacaguuuuguguuuuauugauguuuguuguuauugucauuauuccauuucuucugcuuacuuuggauuuaaugugcucuguuccagugucuuaagguggagucuuaggucauuugauuugagaucuuucuucuuuuccaauguaagugucaaaugcuauaaauuucccuaugagugguacuuuaguuguaucccagauauguugauaugucaugugucaguuuuuuuuuuuuuuuuuuuaaagacagggucucacucacucuguugccuaggcuggagugcaguggugucaucauagcucacugcacccucaaccuucuggguucaagugaucuucccaccucaccuucccaaguagcugagacuacagacaugcaccaccaugccuuuuguuuuguuuuguuuuuuuguuuguuuguuuguuuguuuugagacagagucuugcucuguugccacgcuggagugcaguagugugaucucggcucaacugcaaccugcgccucauggguucaagcgauucuccugccucggccuccugaguagcugggauuacaggcacaugccaccacacccagcuaauuuuuauauuuuuaguagagaugggguuucaacauguuggccaggauggucucuuaucuccuggccuugugauccacccgccucagccucccaaagugcugggauuacaggcgugagucacuguguccagccuaauuuuuuuuuuaaauagagauagggucucacuaaguugcucaggcucaucucaaacuccuggcuucaagacaguugucuugaacugcuggcgcccaggcuagagugcagugguaugaucuugguucgccgcagccuccaccuuucaaguucaagugauucucauaccucagccuccugagcagcugggauuacaggcaugcgccaccacaccugacugauuuuuguauuuuuuaguagugaugggguuucgcccguguuggcuaggcuggucucaaacuccugaccucaggugauccaccugccucggccucccaaagugcugggauuauaggucugagccacugcaccuggccuguuaugcccucuugaugaacucauuucguuaccauuuaugaaaugacccucuucaucccaaauaauauucuuugcucugaaaucuacuucaucugagauaaauuuagccaccccaagcugggcaugauggcucaugccuguaaucccaacacuuugggaggcugaggcaggaggauggguuaagcuaggaguucuagaccagccugagcuacauagugagacccucucuguauaauauaaaauauuaaaaaauugggcugggugcgguggcucacgccuguaaucccagcacuuugggaggccaaggcgagcagaucacgagcucaggagaucgagaccauccuggcuaacacggugaaaccccgucucuacuaaaaauacaaauauuagccaggcgagguggcgggcgccuguagucccagcuacucgggaggcugaggcaggagaauggcauaaaccccgggaggcagagccugcagugagccgagaucgcgccacugcacuccagccugggcgacagcgagacuccaucucaaaaaauaaaaaauaaauaaaaauaaaauauuaaaaaauuagcuaggcguggugguguucuucuauagucuuagcuacucgggaggccgagguaggagaaucacuugagccagggaguugaaggauuaugccacuguacuccaaccagggcaacgaaaggagacccugucucaaaaaaaaaaaaaaaaaaagccacuccaguuuucuuuuucguaucguuucucuuuuuuuuugagguggagucucacuuugucaccuaugcuggagugcacuggcaugaucuuggcucacuggaaacucugccuccuggguucaacucugccuccugccucggucuccuaaguagcugggauuacagacaugcgccgccgugcccggcuaacuuuuguauuuuuaguagugaugggguuucaccauguuggccaggcuggucuugaaaucuuaaccucaggucaucugccugccucagucucccuaagugcugggauuacaggcgugagcuaccaugcccagcccacuccaguuuucuuaugauucauguuagcaugauauauuuuuuccaucuuuuuaucuuuaacuuauuuuugucuguauauuuaaaguagauucccuuuuuucuuuuuuugagacggauucucgcucugucacccaggcuggagugcaguggcgcgaucucggcucacugcaaccuucacuucccagguucaagugauucuucugccucagccucccauguagcugggacuacgggugcaccaccacacccggcuaauuuuuguauuuuuaguagagaugggguuucaccauauuggccaggcuggucucaaacuccugaccucgugaucugccugccucggccucccaaagugcugggauuacaggagugagcccccgugcccagcuuuaaaguggauuucuuauaaauagcuuauuaauuugaucuugcuuuuuauccaauaguagccucugccuuuuauuuugaggcauuauaccuuuuacauuuaaugagauuauugguaugaauggguuuaaaucuaccaucuugcuauuuuuuuuccuauuugucccauuuauucuugguugucuuuuaaaaucuuuuuccugccuucuuuuggauugauauaugauuuuauuuaaucugcuucauuggcauauuuuugauauuuuuuuucauggugguuacuuuagguuauaucuuuaacguaucaguuuaccuucaaauaacauuccacuucucaggccggugccaguggcucaugccuguagucucagcacuuugggaggcugaggugggcagaucacuuguggucaggaauucgagaccagccuggccaauauagcaaaaccccgucucuacugaaaauacaaaaauuagccgggugugguggcucaugcuuguaauuccaguuauucaggaggcugaggcaggagaaucgcuugaucccgggaguuggagguuucagugagccgagauugcaccacugcacuccagccugggcaacagagcgagacucugucucaacaaaaaaaaaaaaaaaaaaaaacaggcaggaugcaguggcucaugccuguaaucccagcacuuugagaggcugaggcuggaggaucaccugaggaugggaguuugagaccagccuggucaauauggugaaacuuugucucuacuaaaaauacaaaaaauuagccugacaugguggcagaugccuguaaucucagcuacuucggagacugaggugggagaaucgcuugaaccuuggaagcggggguugcagugagccaagaacacaccacugcacuccagccuaggcaacaagagcgaaacucugucacaaaacaaaacacaacaauauucugcuucucgugaaguauaagaacauuuugguaauauacuccaucuuuccuuucccaucuuugugcuauuguugucaugcguuguuguauuauuuuuuucuuuaaauucauuuuaaaaguuuuguuuuagauaguuuaaagcuuuuaagaaaucauuucuguuuaccuacuuguuuacuguuuucacugcuuuucauuccuuuuuauguauucagauuuccauuugguauuuuuccuuacuuuuguuuuguuuuguuuuuugaugcucagggguuguuuauuuuacuuuguuguugauuuuaguuuuuguuuuuuuuuugguuugaaaugucuuuauuuugcuuuuuuuaaaaaacucaacuuuuuauuugugguaacuagauucacaugcacuuguaagaaauaauauagagaaaucccauguacccuuacugaaccucccccagugauaacacuguaauggaauaucacaagcacaguagugacauugauauagucaagauacagagcauuuccaucaccuacagaacccagcauguuucccuuuccaagcccacuugugucccugccuuccccuuaaccucuggugaccacugauucuccauuucuaugauuuugucauuucaacaguguuacgugaauuauauaguauguaaccuuuuggaauuggcuuuuucaccuagcauaauucucucaagauugauccaggucguugcauguauuaauaauucuuucauugguagguaguauuucaugguauggauacgccacaguuucuuuuuuuuuuuuuugagaggaagucuugcucuguuguccaggcuggagugcaguggcacgaucucagcucacugcaggcuucgccuccuggcuucacgccauucuccugccucagccucccgaguagcugggacuacaggugcccaccaccacgccuggcuaauuuuuuuuguauuuuuaguagagacggguuucaccguguuagccaggauggucucuaucuccugaccucgugaucugcccgccucagccucccaaagugcugggauuacaggcaugagccacugugccggccugauaacgccacaguuucuuuaacuacuuuuccauuaaaggauauccgguuguuucuaguuuugggauaucgugaguggagcugcgguaaacacaucuagguuguuucuaguuuugggauaucgugaguagagcugcaguaaacacauccggguuguuucugguuuugggggauugugaguggagcugcgguaaacauccagguuguuacuaguuuugggauauggugaguggagcugcuauaaacgugaguguauauagcucuuuuugucagcaugucuucauuucucugggauaaaugcccaggacugcaaaugcuggguuauaugguaguugcauauuugauuuuauaagaaacugccaaagcaauauaugagaguuccagcuuccuugcaucuuugccaacauuugcuguugucacuaguguucauuuuaccuguacugauagguguguagugguaacucaguguggcuuucauuugcauuucccuaaugcuuaaagguauugaacaucuuuucaugugcuuauuugccaucuguuuguguucuuuggugaaacgugccuguaucuuucccucauuuucuaucauguucuuuguuguuguacugucaaguuuugaggauaugugguuuccaaauguuuucuccccaucuguagcaugucuucauccacuuagugguuguuuuacagacagagguuuuuaauuuuggugaaguucaauuggucagccuuuaguggauugugcuuuuagugucaaguuuaauaucucuuugccuagcucuugauccugcagauuuuuuccuauguuaauuuuuuccuguaaguuguauuguuuaauguguuacauuuaagucugugauccauuuugaguuuuuuuuuuuagaaacugagauuugagcugaguuuuuuugucuggaugucauuugcuccagcgucauuuucuugaagaagcugucuuuguugaauugcuuuuguaucuuuguaauuaaaaaaaauuauuugggcauauuugugugucugucuccagguuucuguucuguugugaugauguauguguccaccacucuacacaaguccuuguuacuguaguuauguaguaagucuugucaucgguuagaaugauuccuuccacuuuauucuucacaauaguuucggcuauucuaguuacauugcuuuucguuacaaauuauaaaauaaucuauauaaaauauuuugcugggauuuugauaggaaguacacuaaacuugugucuuaauuuggggggauuaacaucuuuacuaugucccugaagucugcuuuacucuuuauuaauguaaccauuccugcuuuuuuuguuguuguugguuucuuuguuuuugagacagaaucuuguucugugacccaggcuuugugcauuggugugaucauagcucacugcauccucaaaauccucaaaauccuacaucaucaaaauuuuggucucaagcuauccuccugccucagccuuccugcuagcuuuggacuacaggcgugucccaccaugaccagcuaauuuuuuuauuuuuacuuuuguagagauuuggucucgcuguguuacccaggcuggucucgaacuccuagccucaagugauccuccugccuuggccucugaaaguguuggaauuacaggugugagccacugugccuggcccugcuuuuuuuuuuuuuuuuuccuccuugagaugaggucucacucugucaccuggucuggagugcaguggugcgaucauggcucacugcacccuccaacuccugggcucuaggaauccuccaucucagccuuuggagcaguugggaccacaggcaugcaccaccaugcccagauaaaauuuuuucccugcuuuguuuugauuaaugcuugcaugacauaucuuuuuuauccuuuuacuuucagccugccugugucauuacauuugaagugaguuuuucuguaaacagcguaucguuggguugugcuguucaauccauuuugugagucugugucuuuuaacucucugcugcucuaggcuggguguccuucacccucauuuauuuagaacauugacuuuuaaggugauuauugauauuuuaagacuuaaggcuuauucugccauuuaauguuuuguuuuuuguucuguucuuuuuuauaugucuguguuuucuugcuucucuguggguuauuugaauacuugaaaguguuuuucaaaauuacaucauuuugcuuuacuugagucuuucuuucuuuuuugggggugggucguggacagggucucucugucaccuaggcuggagugugguugcaccaucucagcucacuacagccucagucucccaaccucaaaugauccuccugccucagccccgcaaguggcuuggacuacagcugugcgcgaccaugccuggcuaauuuuuguagagacaggguuucaccauguugcccaggcuggucucaaacuccugggcucaggccauccgcccaccucaggcucacacaaugcugggauuacaggcgugugccacugggccuguagccuuuuuaguggucacuuuuagggaccacauuuacacacacauaacuuuuaccacgguuuacugguauugucauuuuacuaguuugagggacguauagaaacauuacuucccuauguccuuuacucuccacuaguuauaauuguuauaaaauguuucuucuaggccaggcgugguggcucaugccuguaaucccagcauuuugggaagccgaggcagguggaucaccugaggucaggaguuugagaccagccuggccaacauggcgaaaccccaucucuacuaaaaauacaaaagauuagccaggcaugguggcgggcgccuguaaucccagcuauucgggaggcugaggaaggagaauuguuugaauccaggagguggaaguuguggugagccaagauugugcuacugcacuccaggcugggugacaaagugaggcucugccucaggaaaaaaaaaaaaaaaaaaggacgaggcgcgguggcucaugccuguaaucccagcacuuugggaggccgaggcgggcggauuaccugaggucagggauucaagaccagccuggccaacauggugaaacccugucucuacuaaaaauacaaaaauuagccaggugugguggugcacaccucuaauccuagcuacuugggaggcugaggcaagagaaucacuugaacccaggaggcagagguuucagugagccaagaucaugccauuguacuccagccugggugacagagugagacucugucucaaaaaaaaaaaaaaaagguuucuuuuauauacauuuagaaccauaucagacaauguuauaauuuuuguuugagaaauucuuaguucucaguaugaugagugauuuucaguugaaagcuggauuuuaaaacaauuuuguuuuuugagucagggucuuacuuuguuguccaggcuggagugcagugguguaaucauggcucacugcagcucccaccuccugggcucaagcaguccucuugcgucgaccuccgaaagugcuagaauuguaggcaugagcccccgcgccuggccauggauauuuugguguuaucuuauaagacacugagucuuaucuaaccuuuguuuuagccaacuugcucugacacugcucuggcagaggaagugaugucagauggaguagaagcccacauuccccacucagccuccguuggcaccccaggugggaauuggggaucguugucccugcuggguggaaguggaaguuccugcuccccacauggucuccacggacacugcagugggagugguuuuguuaccacugagugauggugacaguccugccucugacccucaccgggggcuggggaggccauagugguggcagaguuuagagguggcuuuuuacuacuggguggguggaaaucugggcuccccacaugauugucacaacguggggugggacaggguuuguucauccaguaugguugcaagucccagcuccuagucagccuucuccaccguuaacccaguauggguuagggugccuugcuacagccuguugaguguaagucaaggcuguuuacuugccuuuucugguguggguggaggugaggccauaguucuucugugauguuuuaaugucuuuuguauucuuuuaugagaugguugcucaggggcagccacaagaggagacacaagagaggcucaggaagacaaagauuuuaugcucacagggcacaccaugcagggccauguggugaggaagcagaagacaggagcaaggggaaggcauuauuggccagagccuucguugagguuuccgugggaaaagcaggguagggcagggggaagaauuugggauuggcugguuugaauaauuuuugugggcucugagccacaggugugguccagaguugccuggcaccuggcccugagaugauuagggcagaggaguuuugccuccuggggugcacaggcagguggauggagaaggaagggcucuggauugguuaguguguauagcaaaggcuugcacgaacgcugagcccuuugcuaccucuaagaauuggcuagccugaggggcagccucuccccagccagaaagaucuuuaggaugucaaaacaucauaauaauucuuacaauuccagcaguuugggaggcagaggaggguggaucacuugagcccaggaguccgagaccagccuggccaacauggugaaacccugucucuacugaaauacaaacauuagccggguaugguggugcaugccuguaaucccagcuacucgagagacggguggggagaucaccugagccuugggagguagaggcugcagugagccgugaucccgccacugcacuccagccugggugacagagugagaugcugucucaaaaaaaacaaaccaaacaaaaacaaacaucauaauauacagaaaaaaauacacacagaagcugaaguagagcaaugauuucuaaagguuucugucacacgaggcugccccuuccucauccuuuggcuggagagagugggagcgggauuuugcugggcuugguugccugcaguuguuggggcuuccagguugcugacuuuagcucuaagucuggacuagaagaagcacaaagaaaccccaggaaacucaccaccaugucuuccuugggucuugagguccguagcaugucucuuucucuuucuaccuuucacagccuuuuaagguucauuuuauacacaauggucaggauuuguuguacuuggcaggaggaauagaaaacuaccucuauuccgucucccagaagugcaagucucauguuuguuuuugaaugauauucucaugggguguagaauucuauguuaacauuauuugucuuuuuugagacaggcugucacucucacccaggcuagagugcaguggugugauuauagcucauugcagccucaaccucuugggcucaaguaauccucccaccucaacuuccugaauagcugggacuacaggcguucaccaccaugccuggcuaauuuuuuguagagacaggauuuuggccauuuuggccaggcuggucucgaacuccuaggcucaagcgauccacccgccuuggcuucccaaagugcugagauuacagggcagccaccacaccuggcccguucuuuuucuuuuaauacuugaaagauauuauuccacugucuucuggccugugcugugccugauaagaagucuguugucguuuuuaccuuuguuccuauauacauaaugauuuuuugcuuuuguuuuuguuuuguuucuuguguuuuuuugagacugaguuucacuccguggcccaggcuggagugcaguguugcgaucucagcucacugcaaccucugccucccagguucaagugauucuccugucucagccuccugaguagcugggguuacaggcgcacaccaccaugcccagguaauuuuuuggauuuuuaguagagacaggguuucaccauguuagccaggcuggucucaaacuccugaccucaagugaucuacccgccucagccucacagaaugcugggauuacaggcaugagccaccaagccagccuauguaauguuuuguuuguuuguuuguuuuuugagacggaguuuugcucuguugcccaggcuggagugcagcgucgagaucucggcucacugcaaccuccgccucccggguucacgccauucuccugccucagccuccugaguagcugggaccacaggugcgugccaccacacccggcuaauuuuuuuguauuuuuaguagagacgggguuucaccguguuagccaggauggucucgaucuucuaccuugugaucugcccaucuuggucucccaaagugcugggauuacaggcgugagccacugcgcccggcccagcacuguuuuuaucuccagugcuuuuaagauuuuuaucacugguuguaaguagggguccuuuguguaguuuucuucauguuucuacuccuggaauuuguugagguucuuagaucuguacauguauuauuucugucaaauuuggacaacuuucagugacuuuugaaaacuuaauaacuuuuuugguguaagaucuuuugaauauuaauauagacucaugugaacugacagcucagucaggguacgaaaccaugccucuucccaaaaaccuccuuugugcuuuucguuuguagauaauuguuauuucuugaaauauuuaugcuguccuuuuaccuucagacucuaaugauguauaucaggggcaacuuaaaauugucccauagcuuacugguaugcuguguuguuguuguuauuuugagauuuucucucucuguguuuuauuauggauauuuucuacccauaaugaauaucuucaaguucacuaaucuuuucuucuguggugucuaaucuguuauuaauuacaucugguguuuuuguuauuguuguuuguuuuuauuuuuuugagacaggaucuuacucugucacccaggcuggagugcaguggugcuaucauagcuuacugcagccuccaacugcugggcucaggugguccucccaucccacaucagccucuggaguagcugagacuacaagcacgugccaccacaccuggcuaauuuuuguauuuuuaguagagaugggguuuuucuguguugcccaggcuggugucaaacuccugggcucaagugguccgccugccucagccucccgaagcacugggaugacaggcguaagccaccgcaccuggugcauuuuucaucccagagauuguacucuucauguguauaagcagauuugcaucuauuuccauguuucuucuucuuuuuuuuuuuuuuuuugagacagcgucuugcucugucgcccaggcuggagugcaguggugccaucucagcucacugcaagcucugcuuccuggguucacgccauucucuugccucagccucccgaguagcugggacuacaggugcccaccaccacgcccagcuaauuuuuuuguaucuuuaguagagacgggguuucacuguguuagccaggaucgucucgaucuccugaccucgugaucugcccuccuuagcuucccaaagugcugggauuacagguaugagccaccaggcucagccaccauguuucuucuuaauguauucuuccauuuuucauuuccuugaacauaggaauauauuuguaauauccuuuuuaaaguuauugucuucugauuauauuuucuguguuauuucugggucuuuuucuguuuauuuucuccuuguuaccggucauuucugcaucuuugcgugccuuguacuguuugauuggaugccagacagaaugaauuuuauguuauugggugcugggauuuuuguauuucuuuaaaaaauauuuuugagcuuuauugcaagacagaguuaauugggaauagcuugauccuuuuguuuuaagcguuauuaggugcgucuggguagccuuuagucaggcagcuccucagccucggugcugccaacacuuugggugacucuuugcugggaggggcuguccggugcauucgaggcuguugagcggcaucccuggcuucuccccacuagaugcugcagcaucacuuagcaugcgcuaagaaugauuuuuacauuuuuagaaaguugucaaaaaagauaugccauagagaccaccaucuguggccagcaacgccagaguauuuacacagagauuauuuucuuuuuucuuuucuuucuuuguuuuuuugagacagggucucgcucuguugcccaggcuguagugcaguggugugaucacagcuuacugcagccucagccucccugggaucaggugauccuccugccucggccuccuggguagcugagauuacaggcuugugccaccacacugggcuaauuuucuuuuuauuuuuuguagagacaggguuugaccauguugcccaggcuagucucaaacucuuggccccaagagaugcacccaccucagcuucccagagugcugagaugauaggcaugagccauggcgccuggcuuccacagugaugucucaucccugcugugggagacuuucuuuuaguguuugagauaaauaguggugugaggggaaaaaccuugcuuuuccuguauagagaguagcuaggagcacuggcuuucaaauuugaaagaguaugauuugaauccaauuaugugucugucccauaauaacucuuugacauugggcaaacuuuuaaacucucugagcuuuuuuccuuucuugugaaagagagcuaauauauacuuaucacuuagguuuguuagaaaaguaaaugaggcuggggugguggcuuacaccuauaaucccagcacuuugggaggccaagguggguggauugccugaggucaggauuucgaggccagccuggcuaacauggugaaaccccaucucuacuaaaaauacaaaaaaaaauuagccaggcaugguggcgcauguaguagucccagcuacuugggaggcugaggcaggcaaauggcuuggacccggggaggccgagguugcagugagccagggucacaccacugcacuccagccugggugacagagugagacuccaucucaaaaaaaaaaaaaaaaaaaaaaaaaagaacaaaaaaaaguaaaugaaaaugcauaaaaguagauagcucaaggcaugcauauagcagcuauuauuucauuucaggugugugccccugauuuguaauuagccuugauguguguauaugguuguauuuugcuaauuuggaggauuaucaucuaucuuucaggucaugcagaaggcuuuuguaugauguguacaaugcaagcacauauuacccaggcacucaguaauccuggggacguuauuaaaccaauguuugucaucaaugagaugcggcguaaguauuaacuauuguaguuuuauauuuguauuuauuaccuaguuauacuuuuuuuuuuuuuuuuuuucgagacagagucuugcucugucgccuaggcuggaauguaguggcgcuauuucggcucacugcagcuuccaccucccagguucaaacgauuguccugucucagccucucgaguagcugagaucacaggcguguaccacuaugccaggcuaauuuuguacuuuuaguacagaugggguuucuccauguuggucaggcuggucucaaacuccugaccucaguugauccaccugccuccgccucccaaagugcugggauuacaggcgugagccaccaugccuggccuauuaccuaguuauucuuaauguccaacuggugaaaaaaaccgaacccgucauguauuagaaaacaaauacauuuugucguacguggcuaugucuuugauaacaaauuuuuaguaaaacauuugcuauauaaacacauuuugaaacuuuaaagcaaaagaugacaauauauuaaagacuauucaauuuaauauaacaaauuuuaaacuauuaaaaaucaauauguuaaaauaauugguaaguuuuauagugucuuugcucugaaacuuggauuucuaugcugaguaauacuaauucugauauugucucacagguuuuuguaaacaguuuuuaauuaguuucaguuuggugaaugaauacuuuacuauacgcagugacagaaauugucaaaauaaaguuaauuaggcuacucuggacacacugccuguggauuagcccugcucugcaagcagcaguaaaaauaaaauaagaaauaaauaagguuaauucucuuuuuucgguucuucuuuuuuuuuuuuuucaagugagacugugucucacuguuuugcccaggcuagucuugaacuccuggcucaagugauccucuugccccaguugaguagcugggauuacagaugugcaccacuaugcccaacuuaauuacagucuuaaaagaauauauacucagagcuuagcaaauugguggauaaauuuuacuuuuuucuauuuaauuuuugaauuuuaaauggguaagugcaugaaauuuucuuacauucuguguguuuuugcaguaaacuuuugcaucuuguuaauugaguuggaauaaaaaaugcauacaaacaaaacuauaacucuuaaucuggcaucuaacuggguaauuauagggauguguaauuauacaguaacaaacuguaaucuuuuugccuagaaagccacugaagauuaaagaggucuuauauuggcccuuggcauuauugauagaccacaacagacaagccaaaaaccuuugaaauauuguugaagccuggcaaaauuuagccaggcagguuuggauuguuuacacaugcaugcaugcauucauucauccauucauuugagauggagucucgcucuguccccaagccuggagugcaguggcacgaucuuggcucacuacaaccucugccucucagguucaagugauucuucugccucagccucccaaguagcugggauuacagacguguaccaccacaccuggcuaauuuuguaguuuuaguagagacgggguuucaccauguuggccaggcuggccuugaacuccugaccucaggugauccacccgucuuggccucccaaagugcagagauuacagacgugagccaccaugccuggcuauuuauacauguauuuauuuguuuuuauucauuuauuuuugagauggagucucacucugucgccuaggcuggagugcaguggugcagucuuggcucacugcaaccuccgccucucggauuccagcgauuucuccugcgucagccuccugaguagcugggacuacaggugcuugccacuaccccuggcuaauuuuuguauuuuuaguagagaugggguuucaccauguuagccaggauggccucgauauccugaccucaugauccacccgccucugccucccaaaguguuggaauuacaggugugagccaccacgcccgaccacauauauuuauuuuuauacauauuuauauagcagacaugacuaacauuuuuaaaccuagucuuuuaagaaaaugucauugcucuguguguguguguauccacugauacacacaugguucagucaugaaguugucacguuuguaggucuaaacugguggaguguuggcaguuucaugugauuuaagcuagaacauuuuuauacauucauacacauguaaaauucaguauauauguuuuagugugauauugcuuauacuuuuguguuaauuuuuuauuguaauuuaaaaaauaauuuggucuuuuagcuguuuaaucaauuagaaacaggacugaaauguuucugugcaccugcaaauauaauuucuucuguaggucauugggauagaauuagauagguugggagauuuauauuuugaauggauucuguauuauagagauguagcaccaauuuaaaaucaccagcauagcauuuuggacaaacuugagacaaaacagccaguuuauucaaguguaacuuuauuaacuugcuagaaacaugagucacucuguagcuacucucuagacucucagaaacucuagcugcuguggacuuuuaaugguguaaagcaggggucccuaaccccugggccguagacugguacccaauguggccuguuaggaacugggcugcacagcaggaggugagcagcaggugagcauccccaccugagcuccgccuccugucagaucaauggcagcauuagauucucauagcagcgccaacccuauugugaacugugugugcaugggauccagguuccaugcuccuuaggagaaucucaugccugaugaucugagcuggaacaauuucaucccaacccccucuucuggucuguggaaaaauggucuuccgugaaaccagucccuggugcccaaacgguuggggauucuagucuaaagggccugauccugcuuauagcuuauauuaguggcuuauguuagugcuauuuccucauaaaguaaguauuugggaguuuuccaaccaacauauuauuauaagauauauuuugggggguacaacuuaggcuuauuacguguaaugauaaagccuugucuuuaccgaaauuuuacagguauagcuaggcacuuccguuuuggaaaccaagaagaugcccaugaauuccuucaauacacuguugaugcuaugcagaaagcaugcuugaauggcagcaauaaguaaguacaacagagcgccagccaugucuucauuggggaucucugguuguaguuuauucuuaucagaauucauuuucaccuuuuuuguuggaagcacacagaacaguguucacuuuaccuuuuggcuuugcucugccucuuccuuaggugaugugcauuauuuuaaaaugguugaaauuuacacgugugucuuacguaacaguuugaguuggcucaaucauagaugucaggaaauaaacauuggucuugcagcuauuuaauuucucauuaucagcagacgucugcagaucucaaacuagcugcuucuccuuucuaguugugccugacauuuucuuuucucugcugcccuccagccuguguuuauuuccugaacccccaccccaaucaguuacugauucuuguagcuaguuccuuaaaaucuaaaugcagacucaagaggaagaacgaggggacagauaaugcaucccaagccgcuuggugcugucugagacaccugguagaucucccucugcauucucccugcccuggcaccgcccugucuaggacuucauuguccgggugaugacauacuugggucggaggaagacucucugccuuuuccgccuccgcucccuuuccucccacacaggccgcagugcccggaggcugccaucuuccugcuucaggaccagacuccugccuugcuucccgagucccuuccugacagacacagcucccacagcucugcgucuccucccgccacucccagaccucccuguguucuggccaggaagggaugcucuugggcugccacacgugccauccuuuuauuuuccauggcuguccuguuugaauucuugaucuuuugugagcucccauguguuugaaaucuggucacagcaucuggaguuuuugcaaagcucuucucucaugucacuguucaacguuuuucagauuagacagacacacccaggccaccacucuuguuugucagauauuuggaggauaccuaagaucuagagguaagcuuuugcuuauaaguugauaaaaugauacacacaugugguuaaaaaaugguaauaguaggacaggguuaguccuacuaggaaggaaggaaaagugcuucucuccagcccagauucucauuccuuuuacccagaggcagccucggugccagguuguaguaaauccuccugguaguuuccugugcaugaauaaacugggagcauacugugugcacugcuuccauuugucucuucguauuagcagucuuuuacauuucagcacacaggccuaacagccuucgacaguuggaguaguguuccauuuauuuuaguccccuaucgaugggauuuagguuguuuguguuuuguuguuguucauggagcauccgugcacacaugcuuuaugucuggguaaaaauguauauguaggaugaauucuuaguauuagaauuucuggaucacagggaguguguauuguaaauuuuaauucugucagguugucuucuaagaggguauaccaguuuugauucuaaucaauaguauaugaggggccaaauucauuacacuuuucacccauauuaugaguaguauuaauuuaaaacuuuuuuuguucaauugauagaaaaauuacaguuaaaaaauuuuaaauuucaaaauuguauuuugucauuucaguaguugauguugcuguaaugauuauacuuugcucaucuuuugcauuuuauuuuuauuucagucaaauguuuaaauugcaagggcguuucagauacuuuugauccauaucuugauauaacauuggagauaaagguaaauuucauaauuaugggaguaauuacauuuuuaaaauaagucauuuuauguaacuguaguucauuuauaauuuagacuacuuguuagagaauauaaauugaaaaauucaauaugcuaagauuucauuuggaggaauuauucaagcuuuguaguaagcaucauaaaaaagcuuuuaaaguuuuuuuauuacucuuugaauuuucuuuuucuuuucuuuuuuuuuuuuuuuuuuugagauggaauugcacucugucacccaggcuggcaugcaguggcgugaucucggcucacugcaaccuccaccucccgaguucaagcaauucuucugccucagccucccgaguaggugggacuauaggugcaugugccaccaugcccagcuaauuuuuguauuuuuaguagagaugggguuucaccuaucggccaggauggucuugaacucuugaccucgugaucugcccaccucccaaagugcugggauuacaggcgugagccaccgcgcccggccugaauuuucauuuaauaucuuaauaaaacuagauuuucuauauuagccaaguacaguugguuauuauuauuuuuuuuuuuugagauggagucuugcuccauugcccaggcuggagugcaguggcgcaauaucagcucacugcauccuccaccuccaggguucaagcauuuccccugucucagccucccuaguagcugggacuacagcgacugugcccagccugccucuugcauuuucugaauuccuaauuuuuuuguuguuuuugagcuugcauuuuucugauuacagauguaauacaugcuuaugauaaaaaugaguaacguugcagauauauguaaaauccuuuccuuuugaaugcauuauuuuuaacaguuugauauguacugcuccagaauguauuguucacuuuuuauauaaaugagauugugucugaugucugucuggccacucacuguuccguguaauucuguugagaccuuucugugugagcgugcucucugggcaguguguggugcagugaauggauagacuguaauuccugugccgaauuccuugcugguggauauuugguuugcuuccaguuuuauguauugcugcagugagcauccucuauauuuuuguucacuuuaauucugcucauuuuuaaaugggagaggauauaauuugguauguagauuuauaaaagugaacaucauacuacuaaaugaaaauuuuguuucuuuuuucuuuuuuuuuuuuugagacggaguccugcucugucacccaggcuagagugcaguggcucgaucucggcucacugcaaccuccaccuccuggguucaggcgauucuucugccucaaccucccaaguagcugggacuacaggcgcgugccacugugcccugcuaauuuuuuguauuuuuaguagagacgggguuuuaccauguuagccaggauggucuggaucuccugaccucaugaucugccugccuuggccucccaacgugcugggauuacaggcgugagccaccacgcccgcccggaaaauuuucuuuuuacauaaaaauuuucauuugcuguuauaucuuugagucuucuguuccuucuuuuaaaaaauaaggggcacggcugggcaugacagcucauaccuguaauccuaacaguuugggaggucgaggugggaggaucgcuugagcccaggaguuugagaccagccugggggaauauagugagaccccugucucuacaaaaaaaugaaaaauuuagcugggcaugguggccaugccugugguuuagcugcucgggaggcugaggugagaggauugcuugagcccaggaggucgaggcugcagugagcugugauugugccacugcacuccagccuggguggcagggcaagacccaaacacaagugacggugugcggugaugugguguuugugccucuucucuucccaggcugcucagagugucaacaaggcauuggagcaguuugugaagccggaacagcuugauggagaaaacucguacaagugcagcaaguacguuggguggugacuugauucuugaugccggcuucuccaguggggauggccggcaggcuugguuugagagaguuuggugugucuagguugcuugaguuucugauacccucugggaagacacugcgucccugucguccaaaggcgagagcccggagugucuugauguguguguuucugcaagaugcgcagcucugugccugugaaagccuggggcaugacauuauugggcagauucggugggaggagagagguaaaauugucuuugcaccccaugguagugcugcuucagguguggcugggcacgcacugucugccaaauagcauuuucauugacuuucuuaugauaagagggcugccgucggguggggagucacuuucuucugggauagggaggcuccuucucucuuaggguggguucccaggguuugggauagcauuugcugaaaaacucuaauuuugaucauucauuaauauguuuccacaugaagucaagagugccuauuuuaagaaagcucuuuuguauguuuuuaaguagauuuccacuuuguggucagguaauagaaguaauuuuuuuauugucaaaucuucaagaccagagggauuuugccuuuguuuuaaauuccacagacauuucuaauauuuauuuuuauuccuuuuguuucugguuagggcucucuuuucauauaauaauuauuauuauuuuuaaauuagaugaauuuaagacauauuuucacauaauuauaccagucugaacauguucguuuuucaguuucuuuugaauugagaggaaguuguguuaaccuaauuuuaacauuauugguggcuugcguggcuugguuuuucagaauuguccuaacuuccuuuccuuucaugcuaauuaagcaguuucccccuguauuuuuaauguuaauauuuucacuguugguugaaggcuggugguucucauccaguguccuuuuuggaaccuuaauauguaauguuugagaauaguaacaagaaagaccaaaauaccacaaauuguguguauauauucgucuucuuauacuuuuguuucuguuuguuucaagguguaaaaagaugguuccagcuucaaagagguucacuauccauagauccucuaauguucuuacacuuucucugaaacguuuugcaaauuuuaccgguggaaaaauugcuaagguauguggaugaugucauuaaucauguuuuaugucgagccuuucgaagcuuaacgugucuguagcuauuaaggauuaaggacucgacuuucucaugacaaaauugcuaacuauuaccuacauuugggcuucauugucuguuuuguugguacccgugguugugaggggauacagggagagccuguauaaucugaaauccaaagaggacuuccugcuagacuuugccaguuuucaccaaaguucauuuugucuuguuuguuuguuuucugauugguaguacacugaauuuucccauuuucuucccacuuucugaagauugaaaguggucaaaaacuaaauagcaugcaagagaaauaaacgauccauuccugaauuauuaaaauuaaauaaucggccgagugugguggcucacgcccguaaucccagcacuuuagaaggccuaguugggcauaucacuucaagccgggaguuugagaccacucuggcgaacguggcaaagcccuguuucuacuaaaaauacuaaaauuagcugggugugguggcaggcacuuguaauccuagcuacucgggaggcugaggcaggagaaucgcuugaaccuaggaggcagagguugcagugagccgagauugugccacugcacuccagccugggcaacagagucagauucugucucaaaaaaaaaaaaauuauguucagaguugucauuuuguuagucuguccuuugauggguuugaagaauucacuuaauauagauccugacuuguuaaaagaaaauaauaaaugcagcaggauggccuuaaauacacuuagauuccgcuauccucccgguuaaccaugcccuuugaaagguggcuaggccaggugcaguggcucaugccuauaauucuagcacuuugggaggccaagcuggguggaucacgaggucaggcguucaagaccagccuagccaagauggugaaaccccugucucuacuaaaaauacaaaaauuagcugggcgugguggcgcaccuguaaucccggcuacucgggaggcugaggcaggacaaucacuugaacccgggaggcggagcuuccagugagcugagaucgugucacugcacuccagccugggugauagaguggcacgccaucucaaaaaaaaaaaaaagauggcuaaaugcacuagguuuuuuaaaugcauuagguuuuugcuagaauaucacagggcucagguguucugugggucuccccuccuaggaagcucuaaguacccucuaccugaauauguggaaugaucugugcccucggaaauguuucuccuguuuccauuuccuucuaggaugugaaauacccugaguaucuugauauucggccauauaugucucaacccaacggagagccaauugucuacgucuuguaugcagugcugguccacacugguuuuaauugccaugcuggccauuacuucugcuacauaaaaguaagcugugcagauuugcuauuaacuauuguuacauacaugcuauaagacagcaguagcauucuugggguagggagagguggaacuuuuacaguuaaaaugugaauacccgagguaaaaauauuucucuuggccgggcgcaguggcuuacuccuguaaucccuacacuuugggagacugaggcugggggaucacuugaggucaggaguucaagaccaaccuggccaacagggugaaaccccgccucuauuaaaaauacaaaaauuaucugcgugugguggcaccugccaguaaucccagcagcuccggaggcugaggcaggagaaucgcuugaacccaggagguggagauugcaagaucacgccacugcacuccagccugggugacagagugagacuccaucucaaaaaaaaagaaagaaauauuucucuugacuauguuccauguuuaauuaaaucuaaucucucucuuuuauuggcucucauuuauaggcuagcaauggccucugguaucaaaugaaugacuccauuguaucuaccagugauauuagaucgguacucagccaacaagccuaugugcucuuuuauaucagguauugucaugaaaacaaauugccagauuuucugguaugucauuucuucuugucuuaucaacauguuugaauucaauauucaguguuuuaaaaaaaaaaaaaaacccagcagcuuaaagaucaacucuagccugggcauggugccucacgccuauaauccuagcacuuugggcggccaagauggaaggaucacuugagcccaggaguucgagaccgaccagccugggcaacauagugagaccacaugucuacaaaauacgaaaaaauuagccaggugugguguugugggccuguggucuuaucugcuccgaaaguugaggugggaggauuaccugagccuggggaggccgaggcugcaguaagccaugauugagccacugcauuccagccugagugacagagcaagacugucucaaaaaaaaaccaaaaaccaucaacucugccaugugccuggagaguaagaaagguagugucugagcgggaugaugaguuugcuccgcaucgcacucuguggccaugagcacugaaggugcagcugcagggagaggugguggcugacaagggugggcuucugcugcgggcaguaauggagugggccaggagccacaggacaaugaguggagaccucaggaagggaccucugagcaccuggcguggucacagccagcaccucccaaccuggagcacaggucaguugccuuccaggccaaggccagcacccgcacccagcucuguccuguuguggcugcauacgcuuuucacucacucacucgcuccauuuuuggaaaaaauguuugauagcugaaaaucaagaauauucucaaauguccaacuggcagaaugcucaugucugcacauugaaauauuaaacacuggcauuggauuucggcaguugggcugaagcacagaugaugaucagaggaggccucaggccaaguugagggguaggauuuuguuucuaacuuuuuuggacacuagauuuuccacaguggcauauauuuauaauuagaaaaauauaagccugggcaacaaagcgagaccccauuucuacagaaaauaaaaaaaugagccaggcgugguggugcaugucuguggucccagcuacucaggaggcugaggcaggagggcaaggccacagugagcaauggcuguuccucugcaguccagccugggcgacgcagcaagacccugucucaaaaaaaggaaaauauaaauaaacagaaaagaaauaccuuucagaugaaacagcaucuucagaaaacacaguuuaaagaacgucauuuacccaguuauccuuguugucuccugaucugagugccugacauuagccugaaggaggggauguguauagcuccauacuguguagcauaaacaugcuauuuuuuucaucagguuuccgccugagggguuaaaugcuguugacuuuguaaaugaaucucuccuaaggagguguccugugucacccuaaguaucgcucuccuuguuuccaggucccaugaugugaaaaauggaggugaacuuacucaucccacccauagccccggccaguccucuccccgccccgucaucagucagcggguugucaccaacaaacaggcugcgccaggcuuuaucggaccacagcuucccucucacaugauaaagguaacaguccuuagggagaagaacauuuuuauguuaauuuuuaaaauguaacuucaaacucucaaguugaauuguagugguugcuguguccucaaauacaucugaauuucuucucacaguuuaaucaaacccucuuacacaguauuucaaauauacagaaaacggccgagcgcaguggcucaagcuuguaaucccagcacuuugggaggccgagacagguggaucauuugagcucaguuguuugagaccacccuggguaccagggugaaaccccgucuccacaaaaaauacaaguaucagccggguaugguggugugugcuguggucccagcugcucaggaggcugaggcaggaggaucacuugagcccaggaggcagagguugcagugagcugagauugcaccacugcacuccagccugggcaacagagugagaccccgucuccaaaauaaccccccaaaaaaacaaaaaccccaaaauauacagcaaaccucaccaauggggaggaaagaggaaagccugggugucagcaccuuuaaauuuuagguccccucuggacuuccauucuucucaaaggguuaaacacuuggagauucuuuaauuccugucggauugcaggaaagcgaucuguuuacaagaacacguuuguuagguccauuuagucguuucaggggugugguguuucugucugcucucccccuggguuugauuuuacucccuguugguccugucggggcgaacaguagugagcuagugucacaaggaacacaggauucuagagugggggccucaucugagcuguggcaucuucacagcuuuucgacuugaguuuguuuuggaugaucacacacacggucuagcugcaugcuuuauuuuauggacaucaggcaguauauuugagguauaacagagucacacaucaaaugcccagcgggcuccccuuuugggcucugcuccagagugacaucaggacucuggcaaacaggagggcaugugcccuguaggaaggggugguuggcauugcuuuuccaaagccuguuuuuguuuuuaccaugaagcuuuccaguguuaggauggcagcuaauucagguaugugaggagacgcugggaaggccacacgugaucuguuaacugacuuucacgccugcgccuccacgggggugcagcagccaugggggaaccugcagcgagucucacugcgugaggagaauguggagacguuguggggcagugguggggucauggcugagugaguggcggcugaagcagccccuacucuccgcccacgugaccgucuccuuugcuccgaggcgagggugauuccuccuuccuggcacucugcaucagcgagcucccaggaaacccaaccagguagcaagugugugacuccaugccacagguccugcugauuucgaucagaucugggacagaacgaguuuggucggaggauuguuuucugugaaacauguauguccuguuuguugauuuauugccagaaaacuagggccuguggaaaguaugcgcggguaggagggauugagaaaaacagagaacauuuccagguguaugaaacuuguuaguccugaaaaaaaaaaaaagcaaaaugggaaggacccaucagccaaaauggguucuguuugugugaccauguuucuggagcucugaccaggugcgcucugcuuacuuccagaauccaccucacuuaaaugggacuggaccauugaaagacacgccaagcaguuccaugucgaguccuaacgggaauuccagugucaacagggcuaguccuguuaaugcuucagcuucuguccaaaacuggucaguuaauagguccucagugaucccagaacauccuaagaaacaaaaaauuacaaucaguauucacaacaaguugccuguucgccagugucagucucaaccuaaccuucauaguaauucuuuggagaacccuaccaagcccguucccucuucuaccauuaccaauucugcaguacagucuaccucgaacgcaucuacgaugucaguuucuaguaaaguaacaaaaccgaucccccgcagugaauccugcucccagcccgugaugaauggcaaauccaagcugaacuccagcgugcuggugcccuauggcgccgaguccucugaggacucugacgaggagucaaaggggcugggcaaggagaaugggauugguacgauugugagcucccacucucccggccaagaugccgaagaugaggaggccacuccgcacgagcuucaagaacccaugacccuaaacggugcuaauagugcagacagcgacagugacccgaaagaaaacggccuagcgccugauggugccagcugccaaggccagccugcccugcacucagaaaaucccuuugcuaaggcaaacggucuuccuggaaaggugagugcacgucagggucuucagccucguuuguggcgguucccuuggcuggauuucaggaggcauggagcuggcgacugaagcugaaauauuuuuguuuuuauugcaguugaugccugcuccuuugcugucucucccagaagacaaaaucuuagagaccuucaggcuuagcaacaaacugaaaggcucgacggaugaaaugagguaacguaagaguacaucugaggcacguguggcagcauaguaggaaauccaguagccuccagaugugucaguauuugaaugcuguagaaauuuuauaaugaacauuuugaauccuagaaugauuugaauuauaauguauaggauuuauuaacuugccuuuuagaagaguaaagaaaaaauguggcauacaggacugaguccacggaaacuugauguacucaccaugcuauuucuccuccugcguggccaccucucucugguuagcgguguuacuggcacgccuucaagugccaucucauuucaucuuucucaugagaaaugaugaugugagggugugcugagggucuaggccagggcucucaguccugugaagaagcacauacagacauccguccguccacaacagggaugccuucugagaaaugcaucguuuggggaugugguugucaugccagcaccacagugugucacacagaccuagaugguguguccugcggcuccuaggccacaaaccugcacagccugugacugcacuggaucccguaggcagcuguaauacagugguauuuguguaucuaaacauagaaaagggacaguaaaaauaugguauaagaggaaaacuggcacaccugcacagggcacuuaccaugaauggagcuggcaggacuggagggugcucugggugagccagugagugagugcugagugaauguggaggccugggacgguacacuacuguagacucuggaaacacugcacacuucagccgcacucaauuuguuaaaaaaauugauuucuucaauaguaaacacaccuuagcuuacuguaacuuuuuuacuuuauagacuuuuaauuuuaaacuguuugacucuuuuguaauaacacuuagcuuaaaacacaaacauacagcuguacaaaaauaacuucuuuuuuuguuuguuuuuuuguuugagacggagucucgcugugucaccaggcuggaguacaguggugcgaucucagcucacugcagccuccgccucccaaguucaagcaauucuccugacucagccuccugaguagcugggacuacaggcaugcgccaccccacccagcuaauuuuuuuuuuguauuuuuaguagagacaggguuuuaccauguuggucaggcuggucucaaacuccugaccucaacucauccacccgcuguggccucccaaagggcugggauuccagacgugagccaccgugcccggccagcagagucguuuauugccauugucauguauuauguacuaaucguaugugcuagacuuccaugggacuggcagugcaguggguuuguuuacaccagcaucaccacacucacgaggcacgcguugcccuuggacuguuacagugacgggaguuuucagcuauguugugaucuuauggaccgccaucauauguggucuguuguugaccguauguaugagguacaugacuguacuuuguaaaggcccuucaaggauucugaaauuauagauaauaaaaccugccccacaauuuaaaaaaaaaaucaugucauguuagugaagaaugugaauguaacguuggucaggagugagaggaagggaauuugucaugcagcgucaguggcuucaccucgcaaagcagcagcaggacggccccguggcgagaggcugugcaggcggugcuugcaucucugcacagguuggcugugagugacagcucagagugcggccggaugucaccauacucggugccaggcgcggguucaucaucaggaagucguguucucauggcgaacaacuucuggugaaguucugaucaaaucacagcaugagcgacucuagauuuauauacugggugccuuccuggaaacgucagugucagugaaaaccgugccagugacacacccguaguuuuuacccgcacgguuguuggcacucaccugugggggugcuguucaugcuggcggggcucccaucacuguggcaaccccagaauggcccccggcgggugggagugcccucacugaggcccucuguuaggagggcguagauauuaaaccggaauggggcgaacccugugggcagggaacacucauucccaaccuaaggauaggccagcuuggacacucgcucccucggccaggggacucuggccucaccuaggccagguagcgugagggugagguagguggcugugcagacaagcccaggccacagcagcuuucauuauuaaccccgaggauauaucgaaagcucugcgggaaucaaaggacaaaguuaauuuacuacagaacguuuugcuaaagccucugauuccucauaauuugucaguaauuggaggagcugcuggcuguguuuggagguggccccucuaccuuugaggguccaagagaaaucagagaaagggagucgagaggaaaggaggaggcccugucaucacuggacuuuuuuucuuuagucuuaguuauuaggaagaacuagaggaauugcggccaggcgcgguggcucacgccuguaaucccagcacuuugggaggcugaggcgggcggaucaccugaggucaggaguucgagaccagcuuggccaagguauagugaaaccccaucucuacuaaaaacacaaauaucagcugggcaugguggugggcaccuguaaucccagcuacccgggaagcugggucaggagaaucgcuugcacccaggagauggagguugcagggagcugagaucacaccacugcgcuccagccugggcaacagagugggacucuguccuucaaaaaaacaaaacaaaaugaaacaaaacaaaaaaaaaaaauagaggaauuggaagaacuagagggauauccagaaacaggaagagccuagaacucuaggauuauuguuuugaaaaauaggcuaggagcugggcuugaugauauaacauuuuauuuuuauuuaauaagggaaagagaaaauugggaguuuccagagauaguaguacuagccuaauauugggcuucggcgagauguauuuaaagagacgaaauagcugcuaaaugacgaguuaaugggugcagcacaccagcauggcacacguauacauauguaacuaaccugcacauugugcacauguagccugaaacuuaaaguauaauaauaauaaaauaaagagacgaaauagcaaaugaacguuuugaaguauuuguccuuguaaugcaaugacaugagccugucaagcccacgcuaacgggcguguuuguuuguuugggggcugcagugcaccuggagcagagaggggcccucccgaggaccgcgacgccgagccucagccuggcagccccgccgccgaaucccuggaggagccagaugcggccgccggccucagcagcaccaagaaggcuccgccgccccgcgaucccggcacccccgcuaccaaagaaggcgccugggaggccauggccgucgcccccgaggagccuccgcccagcgccggcgaggacaucgugggggacacagcacccccugaccugugugaucccgggagcuuaacaggcgaugcgagcccguugucccaggacgcaaaggggaugaucgcggagggcccgcgggacucggcguuggcggaagccccggaaggguugaguccggcuccgccugcgcggucggaggagcccugcgagcagccacuccuuguucaccccagcggggaccacgcccgggacgcucaggacccaucccagagcuugggcgcacccgaggccgcagagcggccgccagcuccugugcuggacauggccccggccggucacccggaaggggacgcugagccuagccccggcgagagggucgaggacgccgcggcgccgaaagccccaggcccuuccccagcgaaggagaaaaucggcagccucagaaagguggaccgaggccacuaccgcagccggagagagcgcucguccagcggggagcccgccagagagagcaggagcaagacugagggccaccgucaccggcggcgccgcaccugcccccgggagcgcgaccgccaggaccgccacgccccggagcaccaccccggccacggcgacaggcucagcccuggcgagcgccgcucucugggcaggugcagucaccaccacucccgacaccggagcgggguggagcuggacugggucagacaccacuacaccgagggcgagcguggcuggggccgggagaaguucuaccccgacaggccgcgcugggacaggugccgguacuaccaugacagguacgcccuguacgcugcccgggacuggaagcccuuccacggcggccgcgagcacgagcgggccgggcugcacgagcggccgcacaaggaccacaaccggggccguaggggcugcgagccggcccgggagagggagcggcaccgccccagcagcccccgcgcaggcgcgccccacgcccucgccccgcaccccgaccgcuucucccacgacagaacugcacuuguagccggagacaacuguaaccucucugaucgguuucacgaacacgaaaauggaaagucccggaaacggagacacgacaguguggagaacagugacagucauguugaaaagaaagcccggaggagcgaacagaaggauccucuagaagagccuaaagcaaagaagcacaaaaaaucaaagaagaaaaagaaauccaaagacaaacaccgagaccgcgacuccaggugagccuggggccuugugcuccccgaggcgcuggcgcugcugucagcaguggggccugucccuucucacucgacucaggaacaagugaccagccaggccacaguuguauccgucugauuugugucuuucauuucuguggguuuugagaguucacuauuuuuacagauuuguaaaaauuugcccugcuuugaagcuguaucuuuauucuucauggugucguuaaaugccuaacaaccuucuuuuucaaaaugauagugccauuuuuggugaaugcuuuauaacucuuccaggaguaagcaugcaguguuccaucaaugaacaauugggagucuuugaccuuagaauugguguuaauauucuuacuugucagauguaguuauguuuucauaucuguuauauuuuccugaaauucaguggcugugagggaggcagacaacaggaggcacacuuuuccugugccugcccgccugcccagcguaggcaucggagacaccuucguuuccucggccuuuguuuuugucuccauuuuucaacuugaaauccaauugggaaauuugcuucuguauuuuuuaagagacaggguguugcucugucacccaggcuggagugcagugaugccaucauaacucacugcagccuugaccuccugggcucaaaugauauuucugcuucagcccucagccucuggaguagccgggacugcaggcgugugcuaccauccucagcuaauuuuuuauuuuuguaaagacaggaucucacuaugccgcgcacgcuguucucaaaccccuagacucaagcgaucccaaagcacugggaucacaggcaugagccaccucaccuggccuguuuuuguauuuuuaaaaagcuaaauugguuggugauugucuugaaaaugacguauccaugaugagauggaugagcaggagcagaauuaguaauuuuaguugacaucucuugaaacugaaacccugggaaagauuaccaaaagccauauggaaaauaggcagugguuauuggagggaaaaauaauauugcugccaggugucucaggcacaugggagggaaggaggcuuaguauuuccuuucccuucaaguaacuacugguuucgggaaaaguuagcagaauccucccugcaguguuuguccaacagccuuaguuccugagaaagcugaagcagagaugggacuguucaggauggagcuaaaguuggugaauuuauggcccuggacugaaacagucauuacagugaaggcaaacuuguuaaauuuuugagacagggucuugcucuguugcccaggcuggagugcgguguugcagucguagcucacugcagccucaaucuccugggcucaagugauccuccugcuucagccucccgaguagcugggacuacaggugugcgccaccauaccuggccuacguggcuaauuagauaagaauugugcgugucugcacagugaauguucucggugaauggguggaaaggccaagcuccagggucugcugcuggugguuuuguguuuuaggguuuugaauucuggcuuuuccuucugcaggcaucagcaggacucagaccucucagcagcgugcucugacgcugaccuccacagacacaaaaaaaagaagaagaaaaagaagagacauucaagaaaaucagaggacuuuguuaaagauucagaacugcacuuacccagggucaccagcuuggagacugucgcccaguuccggagagcccaggguggcuuuccucucucugguggcccgccucuggaaggcgucggaccuuuccgugagaaaacgaaacacuuacggauggaaagcagggaugacaggugucgucucuuugaguauggccaggguaagaggagauacuuggaauuaggaagauagaaacuauuucuuaauacauuuucuuugcaaaggugauuaacauguagaaagaaaaccucagguggcaucaaagggcacaguuacucagagcaccccugcccugccuggucuggccucagugcucaucccugcagugugguuccguugcacaguuaagcccuuagcguuuauugaaggccuaagugacacaggacugagggcagcacuaccugugucaccaaagcccuggaacguacagcucuaggcaucugacuuugccuugcaaaggaccagaacucuugguuugguuugguuuuauuuuauuuuauuuuauuuauuuuauuuuuugagacggagucuugcucuauugcccaggcuggagugcaguggcggcgaucucagcucacugcaaccucugccucccagguucaugcuguucuccugccucagccuccugaguagccgggacuacaggcgcccgccaccacgcccggcuaaauuuuguguuuuuaguagagacgguguuucaccguguuagccaggauggucucgagaacucuugguuuuaaagcauuuuugauagaaauacuuuugcagcguauacguuacucucccgaauccuuaaaccuguagcauucugagugcacccugaugcucgguacugauuugcucgcuugguuccuuagaagcgugggcaccagccucugcuugagugacacugcagaggccuccauguggcagagcgcuggcugccccugccagguguccuggauucucuucugcccuguggggcugugucuccguccuguggccacacgcugugcucuuacugcacuugaggcagccccccacuuccucucccguugguguccggugaccgcucacccucgagaggagcugugagccuguuagaagcggaugucacucgagucaguggaccuagagcggaggcuggcaaacugcagcccuggggccaacuucggccagucaccagacuuuguaugaacuuggaguuaagaaugguuuuaaccuuuuuaagugguuggaaauaaucccaaagaacaaugcguuucacaugaaaaugaugugaaauucagaccucagugucuguggcuugauuggggcgcagccaggugcguucccacgcugucuggcggcuucgcugucacugccuggcagaggugaguggcugcggcagggcagggaccguguggcucgcaaagcggaaaauguuuauuauugccccuugacagaaaggguuugucaccccugccuggacgcccauuguuuguguucacgugugaagcgcauccccuccucccaggggcuuuugacgaaucuucagggcugcccugaggccuuuugcuucucggcugaguuguggguuagguggagcuguguguucuggggaaggccugucccucccagcagcccagagccagcaugcauuguugauugagggguaaacgguccuuagagugugugagagagagcuggggguugcggggugagccccaugggggacauuugcccauggagugcuggggaaacagccggagaugaggacaggcaccagcacugccggugaggacggguugccugcgggccuuguagacguucuggacauuucagaauugguuuugcguucccauuucagcgaaucggggaaggagauucgugagggcugcuugguacccgaggauccgaggaugcaguggaugggcucauucugaguguggugcaggcucccaggaucaugggcuuccagcuggggcuacugggagacagugauggcccccgaggcagcugguccagcgggagggagguugaacgugaucuuguuugccucgugucucgggugcuguggucaggcguugucugugugguggcccuguguuuccguccccgucccacugcaccgaugacaggguuugcagcuggcgcuucugcugcgagcagacugaggagccuuucuuguccuucugagaaggccgcugcccggccccgccucacccagcguccugugguccugcgggucccccucuacccuggacuucggccccuugucuuucucuuucaaacuccuccucuggcucuguuccgcccaguucaguucuugggccugauaucuguucuaacaucaggcugcguguggguuggauggagcccucagucaucacguaaacccuuugacaucaguaaaacccugggagcagccgcugagcgcugggacaucccugcucaccucacuggggaguggccucaggcgcucacagggaaccgcagugacucugaccauagccacuuaacgcacacacacagcagaggcccuggcgauuuugcaaccaucauuaaaaucucuuuccugaccuuugcuuucuaggugauugaaaacucagccucaaaacaaaaaauucacuaguuaugguaagcuguuuuccugucuguuuccucauuguuugugguggcgcugaggggacgcaggcagaggaguuuuaauucugcggcucugccugggggcugggcucauaggaguuggcagagccauggagaggccccggcagguucccagccagcccagacccaggccacgcgcuuggggacagaccuagacccuccaccucaucacguuugcauuacuggcuggggaagacccgcauccuucacgcaggcagagucgcccuguucccuugugccucacuugggaaaagccaacccggcucacagcggcagagcccacgggccuuugauaaacaucugggaagggagaggcccgguccccagcacaggcaccucacucaggagagcggagccuugcucccucguccgucccguccccugugcugcugucugcgccccgagguggcacugagcuggagccagcacccccccagcagccaccguacaaaaccauaggaagguggcccagggccgggcggcagaucaggaccucggagcuguggggcuuuguuggaucacuucacacagcgguccugggagagucacugguuuuauaccugacccuuguggagcuagaggggacagugaaccauuuuucccuugaaaggaaacuuuguccaaaugugucugucacauguagucagcaagaggaauuuaaaaugaauugccaagugaagagucuguggauuaauuggccguuaauuaacaggcuuuaucaauguguccucaagggagaggcccaacccuaauuaaggagcuaaacuuccugagugaggggcugugaggauggagguggaggaggcaucuggggcgggugguggccgggcccagcagauggcgccucccuggcugagcugcccgcaccgccaguucccucauuuccacucaggaaggcagagaaggcagagugaucuccucaaggaagagcuuccccagccuucgggagcagcuggcagggcguccgggaauaagcccuacacgccgccgccugccuccaacucacuaacccugcgccucuugucuuucagauucaacgcguucaacagaagccauccccagcccagcuuaaauuauaaagauagacaauaacucuguuccaaucugcguggugcuucuuuaguaaauacuguacagauuuuaccauggagaacuuuuuuuuuaguuuuuaccuuuucuuaauuacccuuauuccgaauggacgaacacuuucuaccacugcugaccauuguaaaauaccguguauauaaaucccauugaaauaaugcccuggaauagaacaucucaaaugcugcuuaauuacagacucaggucgauuacuuguauuucauguaauguuccuccaaguuagacaucuggugcaagaccaaccgggagaccauggaauugucaaaaguacaaacugacaguguguauauuuaauuuaaagacuuauuuaaaaacucacaagcucucaccuagacuuuggagagcagucuguuuucuguaaugucugauacuagaaacuaauuugcuuauuuuaguuguauucaagauuugaagauguauuuuauagacaaguucuguuuuugaacuuuguggaacuguuccaaucaaucaauuucccaguuaugaugaguauuuacauuaugaauguauaacccagacaugauuuguaaagccgacaguauguuucuauuacacaacacuuuuugauacagcgucucuugucuucacugauacuggagucuccguugucugcuuggucccuucgaguuucuaguuacagacacaaucauacugugauuuuauuuuuaauauggauaugcuaucaaacugugauacacuuauaauucacugguccugcaucaggagauggaguggggaaaacuguauuuaauacaguuuguaucugaauaaucuguaugguuuauacaguuuguguuguucagagauguuuaaaguuugaucuuuguuuuucuaaagauuaaaaaagcacuugccccacuguaaauauacagcauguaaaauuucuauaguauauaaauggcagcaaaucacacacuuggcgucuuuuu

SEQ ID NO: 14511 - RNA, 12588 nt, Homo sapiens
cagagugccgagcagcgcggugggugcggcugugagacggcaggagacuucugccccgcggugcacgcgacccucgagacgacagcgcggcuacugccagcagcgaaggcgccucccgcggagcgccccgacggcgcccgcucgcccaugccgagcugagcgcggcagcggcggcgggaugcuggcgcugcuggccgccagcguggcgcucgccguggccgcuggggcccaggacagcccggcgcccgguagccgcuucgugugcacggcacugcccccagaggcggugcacgccggcugcccgcugcccgcgaugcccaugcagggcggcgcgcagagucccgaggaggagcugagggccgcggugcugcagcugcgcgagaccgucgugcagcagaaggagacgcugggcgcgcagcgcgaggccauccgcgagcucacgggcaagcuagcgcgcugcgaggggcuggcgggcggcaaggcgcgcggcgcgggggccacgggcaaggacacuaugggcgaccugccgcgggaccccggccacgucguggagcagcucagccgcucgcugcagacccucaaggaccgccuggagagccucgagguagcggcccgcggggagcgcgggggaccuggaauggggacgcucccgagucgggggcggaagacucgggaggauggggaaagggggccuggcccuggggagggugugaucguccgugggggugagcuggacuugagggugaaaggcggggaucuagauccugcucgggaacuccccugcgugguaucccuucccacaccgcugcucuugcuggaaggaaacguuuaaauuccacccccgcgcgucgggacugccagcgggauccgccgagcacuucccgagguccgggcuagcgaacccagacggccaagccgcgggcgccaaauacccggggacgcgguagccucuauccucuugcaaaucuccaaaucuccgcgagccgggaugcgcucccgcaggccgugcggguugcugcgaggcugccgcgggaggucagcugccccgggcaugugguguuucuuucuuuaaaucaggucaggcugagcuagagggggcggaagucugggggcggaggucgcagggaggcgagcgcagggggucaccggcgaccccagagcgcgcauuagaggggcaaccucugguuaacuucaaagacucccgugucugcaaguuggaccauuuuaaggugcucuuccggauugcuucaggggaagggaccucauucccuucucucucucucucucccccccucccccccucccccuccgucccccccccccgccccccgcucccgccuccgucucaucucuaucucugaaaaugcgugcaguuuggaacuuugagagaaaaaucuucaauuauuuuucaucuuuaggcuccacccuuuuuaagaaguguggacacugcuguuaauagccuuugugaaaauacuucucagcaaaacuagguuuaaauuacaggugguaauuauugcaaaaaugacucuaggguuucuuuuggcgugagggcugaauacaguauuuccagcaucuguauauccccugauucauugugauugcuaacagcuaacauuucuggagcacuaaauaugagucaggcacaucauuuaauuuuuuaauccuuggaacaaugaauggcaugaggcaggucccauuaugugcauuucacaauuuggaacacuuuguggagaaagguaaauagcuugccaugaacucauggguaggcagccugccacagccuccagaaccacaugaugguaggggagaaagagaaauaggaagugaggauuuagaaacagcauuaaaaacaaagauugcuggaguucagaauagcaacguuuuagaucugucauuuuccagaaacaucucugcaugcauaguuauuuaccuuggugccagaccggaacuugggggcuguuuucauuucuaggugaaagcuccuuggcuuuguguaaccaucgauuuacucuuaaaaaagaaaaaaaauccuggagcugaguuuuggucucuacccaacauagaauucuaggcguugguuagaauauugacuuuuuaguaagaggagaaaaacggcuuuuugagaagggaaaauuagauucacaaguuucaaauauugcagcaaaguaauucuuaucugacuuugaaaucuuuuccauaccaaaaaagcaucagugagaugcuccccugccugccaguggcaagauucagggcuugcguuuuggaagcuucucccuguguggucgggccaucacagccacauuucacaauuucuuuuuaacucuuucugugccccucccuccuccccgguggcugaaagcaccagcucagagcaaacguguccaaugcugggcugcccggcgacuuccgcgaggugcuccagcagcggcugggggagcuggagaggcagcuucugcgcaagguggcagagcuggaggacgagaagucccugcugcacaaugagaccucggcucaccggcagaagaccgagagcacccugaacgcgcugcugcagagggucaccgagcuggagcgaggugugugccuggccuguuucucugucuggcaguggccugauuuucaccacuuguggucagacaugcgauucugguugauggacagcagggauugugacaccacaugggccugguucccgagugugugagcaaauaauaaaggcgacugaacaaggucaucucaggaaugagcugccagccccacuggcauuauccagggaaaagugaaaguguccaggaccagcuucgauaagcaaccacacgggcguuucaguccuuuguuaacuaguccuggcagcggauucuguguaucuuucucuucucugcucacacuguggugaguaaguuucucccacaggagacagagugggagggaucaggggauaauucagauugcgucaucaacccccaaaccacuggguggcuuggguuugaaguuguagguuugcccguaguggguguuuauaagacuggaauuuucccagaugcacuaagcugaugaagccacuuccccaugacuccguuucaugcauugauaggaggaugcccaauagcagaacauccaaugacuuuggccgagguggggcagauggagaaggggcugguguuacuguuccauuuuacagccagcauccacaagccacaggucucuuucaucccuuuccuagucucuuccuacagaaaaaccuauccuuucuuccuggcccuucucagaaaaaggugaguauggcuuaccuguuagaucuguuagauucuugaguuuccaaaaaaucuuccuuucugucuccccucuguugcuggguggccucaggagccaucccugaagguaaagcagccguugcuguggcccuccucccaugacaggaggagggaacgucuaggcacaggugagcguggcuccguggacccagccugagccacaguggauccucgggacacccagggcuauggaguuggcacacuaaagguaguuugccucucgaaaggggaacuguggaacgagaggagggcuccaugagagaccuugguggcuguaaaccucccucugcacaguggccaaguugccaugaggagguggguaaauagcagaauagugagccagagcuucagucaugccaggcgggagcucagacuccugguaugcccguuucauagaugagaaaaagacuccguucucagugggacauguaucuuuuggggagggggcccaaaguggguccugggccacuagcuggcaaacagugacagucacaucaaccugcaccuccuccuucucuuucucucacucaaggccaaugucauuucacugggcuuacuccuaagguaagccaucaucauggcuuuggccacccagaagcugccacuuugugacugucccuuucauccccagccuguccauuaccagccagaaagaaacagucaggacucagaccccgccagccugacuccugacccuuuaguuucccagcaagcccucaaagcucaucuggcacagaggggaagcucaccucuacgagggcaaagacgcugcuggccauuuaugcaccccagagaggcagcccagccucucuucaucccaccgugggaacucuagaauccuucugugagcuccaccaacucagcucugggaugugcuuuaaggaaagugaucauuugcagaccaguuugucuucugggcaauucugaguguccuguuugugacaauuguagagagaugaguaaacgcccagcccuccacauguacuaugauuggaaacgaugccaaguuucuuagacacauccagcugaacccagaguagcuagaccuuaaccucacuacaggcagggggccuuggugggggaacucuggccuuuggucugucagccuccaccccuuagggaccagaugcuuggcugugaguuccacacuuggcauucuguaaucccugacaugaccuugcaagguagggauuaguucagacgagggacucaagucagagaacuaaagugaugccugcauucacauugccagcagauugcagagcugggagugaaguugguggggccccagaggagugauggaggcugcagccuggagcggugugugggccccagcccugcugcgucggaggcuccuuggagcccccagcaagcgccugaccccuggcauauggaugccccugccacccggggcccaggguugcuugcuuuucuuugcugcaagaccuguuccucugcaagggccuccagaguccaggccagcuguccaggcacugcccagcucaguguugaaauaaauguugcugcugagaaaaccaaagcugccucucuuccagccccaggcugcccacccccugcugagccucuccgccaccugcagugucugauuuauuggucaggccuuuuaauuccuuaauugguuuuaaccaaguuuccuccaaaccgccaagcuguuuuauuuaaauaaaagacacuggcucucaggguacaggcccccuccucugccccucggcucuuccagcucuaauuaaaccuaucuguugucaccaagcuaacaauauuacccacacggagucguaucagauuggcaaggcugcccucccgcaaguauagcagccauuucucuuuauuagacaaugaugccuucauuaaggacauggucauuugccacuugaagauuaagugugaguggcuaagugucguggaaagagggacuuccggccccuggccugucauucacuagcugugugaccuuggauacgucaccucacuucgcugagccuccgagccucaacugugcaaccugcaaaaaugggggaguagggacacucugguucucucucucaguuuugcuuuucagccuaaugagagacuagucccagccuucacucuggccuggccccuugacuucuucggggagcaggucuucccagcccucgccaggugcccagcagcucugcaguggcaucgagaggugcccauccuuaggaggucaggagcaaucgggaggccaccauuggcagauaugaguacaugcaacacgugaagcccagauucuagaauguacacacugccuguuccagagagguuagaaaggggauaggggguucuucugugccccuuugcagaaacccuccuuagauagaugugaacugcggcccccaagagccuuucguguguauuauucacucugagggacaaugaguuugggggauugugguggagaaagguuuaucuauucuggcucauguugugcaguagggacugauuuaacuccacagugacacaggcaguucuggcuccagagagcccgccugucucugauggccucggagacugucugagcccuuguggaugcuuaaccgacacuuguugaaugagugaagggcguuuagauuccuucaacggcagggucugguucucaaauaagagggccgccuuugccaugacagcuggcacaaucaaaugguguccugcaaacuuuggaauccacgaugccuggacaagggcugccgcugugguuuacuuaauuuugaacuucaaccaaggcugccuuggaaauauuguaaacccauucuagaguuuguuuucaaggauuuuagaagugccaaugacauagggguggcggguggauucucaccaauuccaggaaggucuggaagggccaaggcugugaccagguguguuccccuaaaugaggagagacaccugcgguugcccugccucccacuggcuccagacuacaggaaaugaucaauaaacucagucuucucuugaggaggaaaagagcaaagugcuuuuugucagggauuuagaccaaaaagccacuuuugaguuaaguuauggagucaagacccgggagccugacugcuucaccucggcagugguaauucuuucaugugaggagugacacagacucauucacuugacaaguguuuauugggugccugggucccuguaagacuuccuucuucuaagcccaagucuccaggguuccuagauccugcgaagauuucaaggaaauaucugaaguuauaagauguggcuaaggacgcaguuucuggcuuaacacaagaaaauuaaaucuaccuuucuucugcuccuuccucaagcuuucuagucaccuaauaugacuuaugaaaagagaguauuaacuagaaggaaccagacagagccucugucacccaggugggagugcagugaugcaaucauagcucacugcagccuggaccuccuaggcucaagcgauccaccucagccuccugaguagguggaaccacaggugugugccacccuacccagcuaauuuuuauauuuuuuguagagaugaagucuugcuguauugcccaggcuguucuugaacuccugggcucaagcagucuucccaccucagccucccaaagcacugggauuacaggcaugagccacugcacuuggcuaauuuuuuaaauuuuuuguagagacagggucuugcuauguugcacaggcuggucucgaacucuuggccucaagcaauccuccugccucggccucccaaaaugcugguauuauaggugugagccacugcacccauccaagagcuuuuuuucuucuagauuucaagaggccucuuuuccuguccuaaaagauggagcuaaauucucuaacgugccccaugcagugcccacaaaaucuuccuuuucuuuccuuuucugggcguccuuggggcccuguacuugcugucaccugugucugggguucucuucugcaggucuuuccaggccuucccugcauccucugccuucccucccccggccacuccccgucuuagcaggagccacugccuggacuucccucgcguaccugcugcugguuucaugucaccuucccugccugaauguaagcucccuaaggacaaggacuccaucuuguguccugaauccugccagacuucagccuuuuaucaguggcugguguggagcggucuuuggucgcuugcuggaggguccaucaaggcugugugagggaccuucuugugggucuagcaagauguggcucugggccgugcugguggguggugggguggccuaacgcacuccuggccucucuuccucccaacccccaggcaauagcgccuuuaagucaccagaugcguucaaggugucccucccacuccgcacaaacuaccuauacggcaagaucaagaagacgcugccugagcuguacgccuucaccaucugccuguggcugcgguccagcgccucaccaggcauuggcacccccuucuccuaugcggugccagggcaggccaacgagaucgugcugaucgaguggggcaacaaccccaucgagcugcucaucaacgacaaggugaggcccgccugcaccgccacccuccccagaacccaucaugugguggagggagccacagcccccaccccagccguccucgcccuccucgggccacacagcagugucccagacaugggacugcggggcuguccuccucgagguggggauagcuuugcacacgccgggcggcucacaggggcgggguggggaggggccgagcugugaguccaaccaccaagcugcagaagguccaggcaccuaggccauggaagggcagaaggaacagaucuccgugugcagccuggauugagagaggaccucaggccggucagugagggcuguuccccagggccacacugauuaagggggugugugugucucaguguaagagacuccccacaagcauauuuuggugggggucagguuucuagagauauaauuuacauacagcaaaguguacccauuuuaauguacaauucaggaaguuuuaacaaaugcacacaguuguguaaccaccaccacgaugaaaaaauauaaaacaguuccaucaccccccaaaacccccucauaccccuucauaguuaacucugaucccagccccagcccauggccauugcugaccuguuauguauacccauggucuugccuuuuccagagcaaaugccccuucuuaauagacugcuugguuuuggcauucaggaguggucuucucaagggcugggcaugguagcucaugccuguaaucccaguguguugggaggccgaggcaggaggauugcuugagcccaggaguucaagagcagccugggcaacauagcaagaccccuucucuacaaaaaauuagaaaguuagcuaggugugguggugugcaccuguaguuccagcuacucgggaggcugaggcaggaagauggcuuugagcccaggaugucgaggcugcaaugaacuaugaucgcaccacuguacuccagccugggugacagagcgauacccugucucaaaaaaaaaaaaaaaaaaaaaaaggccacuuugggccuccuggggaccucucacagcccugcuuccaaacuuucauucuaauggcagacuccauauaacaaaaagaacauucucagaaccuguccggauuugggcauuugaguggcuacgcaaacucccugccacccgggccaccccugguggaggcgggggcaguucagccccucacucuguuuguccucacugaacugcccuggguggagucugucgagguuuaaaaaacgcuguggcaucagccugcugggcuccuccuagauagacccccuugccugagccagggguuaaauaauuguucuaaauaacacccuaugacacaguggggcuaagagccuuguuguccucuggguuuggacggcuuguaaacaucgaauuccugggagggaggcuucggguugcuaggagaccagcagcaacaacgcggugguucauaggcgagccugcauagaaagugcuugcaggaccgccagggacccggccaguggcagcguccuccccccaguuccucacgcuguccgugaguucccugcucacacagauacucacacacgugccgcugcgcagggaggacggggcacacccgcagcacacagaucccugcgugccaucauggagguuugggacuuggcaugaggaaugaggaucucucgucuguuuuccaaggagacuggccccauggaacgcugacuucccgaguuucucuggcauggagagcucagggccagcguggggguguugacccucacaucuguucgguccucagccacgccaggcaccaagggugucccauuaaugugagggcugcucuggggucaggguuuccaccaaggcugcccccuugcauguucuccacgcaugaccccggugacaggaggagcaguguggcccagggggacugugggguguccuuccugcuuccugcccugggggacccugagggcgugggcccagcagguccuuaccugcacauugcugcucacagguugcgcagcugccccuguuugucagugacggcaaguggcaccacaucugugucaccuggacgacacgggauggcaugugggaggcauuccaggacggagagaagcugggcacuggggagaaccuggcccccuggcaccccaucaagcccgggggcgugcugauccuuggacaagagcaggugggugcagggcaggugcaggugggcacagggugggugcaggaugggcacaggguggccgugcgcccuuucagggauggugcgaggaggggccaacugagcagcacgaggccaggccugcagcuguuccugcucccggccccagcuguuggccccucagaccuggccacaguguccugacagccaggucgggggagugagaacccccgcagccuggcccuugcuguccugugguuagagguugggcguggggucacggccugcauggcagggaccaggugggugugugguucaaacagauuccaaauagaaccuggcacagaggggugugagugucccuguggucaugggucaucucgugacacaggcuccagcuuccaucugggaggaggcugugugagggacccuccugggaugcucaugguaccaacucaggauuguggggcuggugucuuccaggagcccccugcucagggucuuaacccugauacccagcaaggggcacuuagguaauccauagugggugcucagccugugggggagacagggaugaaaggguggcaccucaaagugcccucaagaaacuuaccaucuaggggagggaauggcuaaguuggcugucuggucuaggacagauaaguguuggcauuccagucuguauuuggguuuuugaugauggacaguggggcguagacuccaggugcacuggggggcuuugagucugguuccuucuuggcccacuccucccucaauuuccccugcuacaucuccgcugggaggggcugggagucaugagaccuggcucugauccuggcuuugggacuuugagcagugucuucccuuaccagccucaguuuccccuguauaaaauggggagauuugagcgaugccaccucccaguucugacaugccugggagcuucagaaccuacagaaacagguaguguuggucagagcuggggggcaucagagaaaugcccaaaucuccugucugcagcccgugugcagggggacuugugaaccagcccugacgcagcucucuuguucccauuccccaggacaccgugggggguagguuugaugccacucaggcauuugucggggagcucagccaguucaacauaugggaccgcguccuucgcgcacaagaaauugucaacaucgccaacugcuccacaaacaugccgggcaacaucaucccguggguggacaauaacgucgauguguucggaggggccuccaaguggcccguggagacgugugaggagcgucuccuugacuuguagccgccuucuccucuguccaggaggccgggaucaggcuguugccauggaaguucagggccauagacugccccacuuaaacucuugucagucugggcucaggguucccagagcucauuccccaggaaucucuaagaccagggcuggggcagugucugucacuggcuuguuuguucccuaccaauauucuguugcuguuugaaguagugccaggguccccugggaagaugcccccaagacaccugccccaaguggguggauaucugccuuccugcugcaaguggaggcagguccagcagccccucuucagagccccuguaaaugcuaucgcagccugaguccugccgccuuccaguuccuuggugucccgugcaccccuucugucuguccccuuucauggcugugcagccgucccgcuggaguggccaugucccuugugcauugagugcauccccgcuggugacuaagcucgcagcaagcggcuaccccccgaucugcaaaagggccucucccuuuguguucuauacauugugaaucuucccgucugaagaacgcccagccugcccagacaaagccccgccuuccccaaagcagaggggcugucugugucuccagaaaggggacaucgggggggaggggggcucagaaaggagaagggcugugaucuccggucccuucccccaucauccuuccuuagacugaugcuuugacugaaucaucacuagcuauggcauuaaaaggccucucuucucaucuggugccaaagguuccguugcagcuuuuuacaaccauccggugugguuuggaggauuuguuuuuuuuuuuucccaacagaaaagaacagccauuagaagaaggcucccauuuucugauguuccgccccacugugaagagugugcucguuuuaaauucauguugauucuuguaagcacuggacugucuucaucaaguauuucccuacagaacuccucaagaaaacagagaucauuuggcuagagauugucugagugacuccaagcuacucacuguauuggacgggaguaguaauuuauuuuaaagauaaagugacuaaguggggaaauuuauaaagcuaaauauuauauauuuuauuuuucauacauguuugaagugcaaaucuguggauauuccauuuguaggaccaagucgacaugcccauccugacauuguaugcuacgagaacucuucugaugauggaauuucgauuaaagugcacugaaagaugcu

SEQ ID NO: 14512 - RNA, 18462 nt, Homo sapiens
aagugccaccgagaagcgccggccucggggcugucuacagcggcccgggagaggcugugguggccccgagcgcgaguguguaggugacaggacagcggccaggcccgccccuccccucggugaguacccggaagccguuuuggggucgcagcgggguggcagcuuguuuugccuucacgggaguagaaggaggcggcguccggccgcggccgacgguaguucgcuuccccgagagugcgcggaggcccgggugcgaggagggccuguuucucuucagcccugguucauucaccucgcggaccgagggccccgccgucaggagccggcgaccgugcccuggugcgagcuggucuguauguccucacugguccuuuugggacuuugccuuggccuaaaagggaagugggaggagggcagcgccgggcaaggccuucugaggaccgagcugggagccgggcaggggcccagggcgaggguggugggagggggacggcacccucaugcguccuugggccugaaggacgccgcucaaaccuguucgaaccgcagcucuuaccugcguugcucucaggauuccgggaaaaggccggucuagcuggucugaguuagcgaagggccugaccccaaaaguggaguuuuauucgccaagcccguguaguaaaucggagugggcugacgguguuaccaagacauuuccuagggggccugcuguuuuauuuauuuaaaugaguuuauuuacguaaacgcgggccugucacggugguucacgccguaauccccgcacuuugggaggccgaagugggaggaucgcuugaggccaggcguucgaguccagccugggcaacauagcgagacucccaucucugcuaaaacaaaauuaaaauaaaaugagcaaucauaacuagcauuuuucucugggcaccaacuugagccuccaaagacgauuguaaauuuuaaauauuuuguuuuguuuauuugaggugggcugucacgcugucauacaggcuggaaugcaguggcgcagucauagcucacugcagccucuaccucccaagcucaagcgauucuccugccuuggccuuuggaguagcuggaacuacaggccugggccaccuaauuuuuuuuuuuuuuuuuuuuuuuguagggacgggguuucaccauguuguccaggacggucuggaacuccugagcuuaagggauccacccgucugugccucccaaacuguugggauuacaggcuugagccaccgcacguggccaauuuuaaauauuuuaaaguuuccacagaaagcuuuacacuauuaaauuguaccguguuaauuuuuuuaaugccacaaauuccaaauuagagacucuucuaugauuugguucuuaaguauuuaaagcugaagcauauccauauuucuuuuucuuuuuuuucuuuuuuuuuuuuuugggacggagucucacuguguugcccagguuggagugcaguggugcaaucuuggcucacugccacguaugccuucuguauucaagcaauucuccugccucagccucccgaauagcugggauuacagacccgcaccaccacgcuggcuaauuuuuguauuuuuaguagagaagaaguugcaccauguugaucaggcuggucuugaacuccugaccucaagugaucuucccgccucagccucccaaagugcugggauuacaggccacugcgccuggccccauuuuucuguuacuuauuuagggugguuaaucauuaucaacuaauuuuuauugaauauccauaguguguaagauccuuugcaaaguccugacgauauaaaaugaugaaaugcuuuaacuuauuacaguaauuucucuuaaucuuaccuugcagugauggucauuguccuccagagcagugauggaggaaauaccagcccaggaagcagcagggucaccaaggguccaguuucagucuuuggagacccagucugagugucuguccccagagccucaguuugugcaggacaccgacauggaacagggacucacuggggguaaggcagagaaagcacuuccgucugggagagugggagugcggaggggcucccgagggggcuccugggccugguuugagagaggccaagaacuggaauaagaacauggucccuagagggaggaaugaaagagggggcagaugugacucaguucaguccuagucugagccccuuuauuaaggauagcucaucuuucucaaauaagcagagugauggcugcuuacucgcuguggugguuuuuccuucaggcaaccuucacuucaucccaguucucacauccagaauaauuucuaagauaugcugcuuuugccacaucucacaguccuuuccuggcucucacuuccucuuagguucaggaccuuucuuuccccuguucccuucacuuaguuuuucuuugcuuugucaccugccauccauucuguuguaacugcaguguuuugugacuagacuaaauuuggucaaggaagcaaccauuuaauuccuugguugaacacaaugccuguaugaauguauauauacuguauuuugacuacgcagucacacuuugcuguaucguauagguagguuggucuuuuucuuccuuuguuuuauaagagcugugucuuagauugccugugguuaacucuagugccugaaauaacuugugugucacccacacagaucaagugccacaauguguagagugcugugggggauugugggacuguggaaaagauuucgaggaaacagaugacccuuucuuguucuugggggccuuacacacugguugagacagcacccauucacaagagaaacgcugaucaagugucuagaacagugccuggaaagggucagaagucugcuaaauaacccuagcccaggacaaguccccacaagucuuuaugcuuugcuuugcccaucugcaaaacagguauagucuuacucuucuguaagaggacugucaugugaugaagauaaagugaaauacaagcuuuccuaagaaaauccuguaucacaggucaaaacacgcauaaggcaugcaaguacugagacgaagcagaguagacacacccaauaccugaaaaauguucauugguuuuacuagaguauugaggaggguccugcugacaccccuugggcuggagaggccuccucugaaagggagcccugggaaagggcugcucucacucuucacuccuuucuccucccucagcuccaccuguuccucaggugccugcucuuccccgugagggaagcccaggagaccaggcagcugcgcucuugacagccagguaccaggugagcugaggaacccucugcuuuuccucagggacuauugcuacugauggaguguggccucucucucaucccaucuguagaccuugccuggaauuuuuuucaauagcagacuccaguuugggaauugauccucuucggagaccuggacuucacauaaaccaacuucccaucuccccagugccaugagcaaacucuguuuucucuuuguccaugguugugugaugggugcuuauuagauguuuaaggguuaugggcuuuauuccguagguucuaaucuguucucccuccuccucaacguaaguacacaguggauacccucucuaugaucuucauucucuggccauggugcuacaguguucucauuccucagagcagccaggauguguuauuucaggaguuugugacauucgaggauguggcugugcaccuuacucgagaggaauggggauaccuggacccuguucagagggaccucuacagagaagugauguuagagaauuaugggaacguggucucacuggguaaggacuuccuuauuauucgguuuaucuauuugaauuucuuuacuuucuuguuucuuccuaaguauaaggucucugagaaggucuguagaguguggcuuagauuccaggacuuagaaccucugaauccuuaucuuucacaucgucuucuccgggagggguaauuaacguuuguuugggggugccaagaagagacauucuccuccuuauccccaguucauguuuauggccauuguggggcaucuuuucccuuuuagcaaagggaaacuuucuugugcuuugcuugauuucucaccguucuuuucuuuuccauuuuuguaggagagaccccaggguggccucccaaccuccaaccagacacuuuccucuuuguuaucucagugucccuguauuagagaauugaagaauuucccauuuuucuaggaaaaagaaaugccguuuauuuaaaaagacaggcuaaauuccuucuuguugaguagucccucaccccuuaagauccccagauguaucuccaagcaggcagaacuugagaugucauuugaaggcaugacucacugugaguacauuucagugagucacccagaaugguaaucccacguaaccacacccagggcagcagaaaucucagauguuuaccccaugcugagguggggucaaugcuuaacucaugucucucccuugucauuuugaaagguacagugggaagcugggauuagccaagcuguagugcugcugggaagcaucagugggguuugucggcagcucccuuggugugagcauuguuccuuuuucuuuaguuuauuuuuuauauuauauuauauuuuuuauuuuauuuuauuuuuagauggaguuucacucuuguugcccaggcuggagugcaguggugcaaucucaacucacuacaaccucugccuuccagguucaagcgauucuccugccucagccucccaaguagcugggauuacaggcaugggccaccacgcccgccuaauuuuguauuuuuaguagagacgggguuucaccaugcuggucaggcugaucucgaacucuugaccucaagugauccaccuuccuuggccucccaaagugcuggaauuacaggcaugagccaccgcacccagccuccuuuuucuuuaguuucuugcuugcuucugcacucuucuuuuuguguguguaaauacugaaucaugcauuuucuuuucuuuuuuuuuuuuccguuggcuuugucuaugcugguggcauccagggcauugcuuugucucccugauuaugcucaggauucaaggucuucuuauuuguggggaggcaggcugcccacugggacgguuuuuaguguguuuuccauuccuggcucuuuaaucuuuguaggcauacuucuccgccuucccaccacccggauucauagugugaauuccugcccggcccugagucauacccaggcaagugcuuucucuggagaaacacuugccguccuuacagcaggaaucuccaagagauggcccaaguaucggcuucccaucgauauugcucgucccugcucggaaacuccuuuuccacgauugugagauauuaaaauugacugauggaauagaagcuccccaggaugccaccacuguguaaaaucgcagcuccucaaauuaccucuguuuaauuucaaauguuaggguccaaggaagcccucuguugcaaccagauauguuuugaacccaguucauucagaaaccaugguugguggucaucaucuacuuguauugugaaaaaccagaaauuccaaauucagcucuucaguuauggucuuuucauauuauuuuagaaugugaaacuuaugcugugugccccuccuuuuauguggcgaacacaaccugccccguauggugccuaacucuccugugaacccugggcuucccucauguuuaacauucugguuuccuccuuccuugaagucccuguggcccucuucaagguccuaccuuccuacccuuuauucuuugugguucuguacagauugaugcaauuauauugccuuuccugauuaaguguuccuuacucuguccuugauggaggggagaagggagggcaaagaaguuaaauuuauuucagggcaucaaauugaauaucuacuuaauaacuuuguaaacuguaaagugacauacauauaauuguaaaguacuguuaauuuuaucuaauaauuacagaguuuccaacaguuaaccugucuacuuuuuggaguaaagaaacuuuguagcaguuuaaugcagucuaauagcauaguaugcuauagacugaacuuuaucccauuuccucucuuaucucugcacugcacacucgacaugcagucgacaugcauacacacuuuuacacauacaagagacacgcacagugcaagaaagccuucuacucaucuugcuuuugugaucaaguuagcagcaucuccuuagcaguuauuuuuacaauccuugggaaaucauuuucauauuuuuggguucagcagacuucaucugaaaauuaacccauuuaugccuaguguuccauuauuggaacacuaagcuugcgggaauuauuuaugucccgcugcucaaggucaucgccaaggucugauuuuuaacaaaaauugcaaccuccagcauaacuggguuaaguuuauacauuuauuaauuuaacuuuuuaggguuguaagacuuuuuuuuuuuuugagacggagucuugcucuguugcccaggcuggagugcaguggcaccaucucugcucaccgcaagcuccaccucccggcuucaugccauucuccugccucagccucccaaguagcugggacuacagaugcucgccaccaugccuggcuaaucuuuucguauuuuuaguagagaugggguuuugccaucuuagccaggauggucucgaucuccugaccucgugauccgccugucucggccucccaaagugcugggauuacagguugugagccacugcgccuggccuccagauuguauuugucacagacauuagaacguugguccuuugcuuaagugcuuccacuaugcagcaguaaauauacagaguacaaauagcugaguaaagaagucgguaauaaguaauuuucguuaccacauaauugaaaaaagaacauacuccauugaugaugaaugaacaauuugccucugggucacuauccauagggaaguuaccuguuacuuagugugguagauuaagacccauaaaggggaccgaguugcuuuucacauggguaaguguggcaggugcccuauuagaugauggccucagaagcaugcuuguuaaaauucuaauugauauuaacugggucaguagauugggaauguuuggcacauacucucugcuuuuuuaacuugaugucaugaaggacuacaguuauuuugcacagaauguuuuccauugucacagcuauuuaguauuuauugagcagccaauauguuauuggguacuauauauauguauguauacacacacacacacauauguauauacacacacacagacauaggacauuuauauguguguguguguguguguguauauauauauauaaaggauauguguauauaucucauuuaauccuuaccauaacccugugagcagaugacacugcuccuauuuuauaucugaggaaacugaggcucagagaaguuaagugaucuuugcaggaucagugagaggcuugggacccagaucugccucugaagccccugcacuuuuucacuacuuugugcccuuaggacaauaaguucaacuacacauggaguuuuuaauauuuuuagugaguuguguguacucugaugacaagaaaaauucaaaaugccaugacaaauuggacagacaggccaguauauaguuugggaccagaaaggacaugcauucaaaaaguaaaacucucuagggacacauuccaguccaacagguaucuacaaaagaaugauauugcuaaggagagauauuauuuguguauuaaggaccaggaagaaaagcgugaagcuuucagauggcuaaaagcauagccguaguaaaagcagcaaaccauaugauaaggcaaauuuuaaauauuauuuuugaggcaggguccccucuuguugcccaggcuagaauacaguggcaugauaacagcucacugcagccuggacuucccuccaggcucaggugauccuccuaccucagccuucuggguagcugggacuauaggccuguaccaucaugcuaauuuuuuucuauuuuuaguaaagaagguguuucgcuauguuacccaggcuguugaacuccugggcucaagugaucugcaugccucagcuccccagaguccugggauuacacaugugagccaacaccaugcucagcuuuaacuguuauuuuugaagaccagauuaaaauaaauuuuauuagaaaacucucaagauuuaaauaaaauaauuuuuuuuuuggagacagucuugcucugucgcucaggcuggagugugguggcacaaugucagcucacugcaaccuccgccucucaggcccaagccauucuugugccucagccuccagaguagcugggacuacaggcaugcaccaccauacccagcuaauuuuuguauuuuuaguagagaugggguuuugccauguuggccaggcuggucuugaacucuuggccucauguguuccacauccagccuuaaaaucaaaagguuuuaauaacuuaauuuuaaacggaaaaaauguaaagcaagugcauauuuugaaagcauagagucggccaggugcuguggcucacacauguaaucccagcacuuugggaggccaaggcaggcggaucaccugagguugggaguucgagaccagccugaccaacauggagaaaccccgucucuacuaaaaauacaaaauuagccgggcaugguggcgcaugccuguaaucccagcuacucuggaggcugaggcaggagaaucacuugaacccaggagguggaguugaggugagccgagaucgugccauugcacuccagccugggugacagagugcaacuccgucucaaaaaaaaaaaaaaagcauucacgucaaugucaagagaaccugcuacuaaugcuuucuuugauaggcaguaugauagguuggaaagaauauaaacugggaucaagcuuggguuccacuuaccagcuguaguauguugagcaaauuauuuaaucugacacucauuuucuugguuuauaaaacaugaaaaauaaugucuaccuucuggguacaggauugaauuagauuaugcauauaaguaccuggcuugugucgggugcgguggcucacgccuguaauccagcacuuugggagggugaggugggcggaucacaaggucaggaguucgagaccagccugaccaacauggugaaaccccgucucuacuaaaaauacaaaaauuagcugggcauggugguacaugccugugauugcagcuacccaggaggcugaggcuggagaaucgcuugaacccgggagguggagguugcagugagccaagaucaugccauugcacuccagccugggcgacagagcgagacuccauaccccccggccaaaaaaaaaaaaaaaaaauuaaguaccugccuugugcuaguuacuuuaauauuuuggaaagaauagcaagcgauaugagccauagaccagauuuuuuaauacaaauaaaaauuucaggaguguguucaaauuauuuauuuauaguggaguuuccucaaauuuauuauuguuuggacuauugucuagggauuuggauuuuuuuuuuuuuuuuugaaauggagucucccaggcuggaguguaguggcgugaucucggcucacugcaaccucugccucccggguucaagcgauucuccuuccucagucucucgaguggcugggacuacaggcacccgccaucacgcccggcuaauuuuugguauuuuuaguagagacaggguuucaccguguuagccaggauggucucgaucuccugaccuugugaucugccugccuuggccucccaaagugcuaggauuacaggcgcgagccaccgugccuggcugggguuuggauuuuuauuguaaaggauuuccauuuccuugauaauaaaucaucuuuuagaucccuuuuaauuuuuaauuuuaauuuuuuguagagauggagucucacuauguuccccaagcaggucucaaauuccugagcucaugagauccuccugccuugaccucucaaagugcugggauuacacgugugagccaccaugccugguccauagauccucuugauucguuuguugguugauugacugacugacugacugacaggaucucacucucacccaggcuggaguacaguggugugaucuuggcucucugcagccucggccuucugagcucaagcgaucauucugccucugccucccaaguagcugggacuacaggcgugugccaccaugccuggcuaauuuuuguauuuuuuguagaggugggaucucacuauguugcccaggcuggucucagacucuugggcugaagugaucuguccgucauggccucccaaagugcugggauuacaggugugagcuucugugcccagccauagaucccuuuuaauuaacacuucugcgacuccaauuauuuaggauccugguucaccguauguuauucuaaucacuuuuucucuguuguuuguauuuaccuuuuacuucacugucaauauuuuauaaaucauauuagaaaacucaagauuuaaauaaaaucaaaaaguuuuaauacauuaauuuuaaacaggaaaaauguaaauaaagcaagugcauauuuugaaagcaaaguuuugaguuaaauuuaggaaauaggcauuuaggcuagugccaagaaaacuuacacguucuuucuguguguaauuuggaggaagggauggauuuuguucacagucauuauuuauuuuuuuucagggcuuguuaggaggcaaaaucauaauuuuuuuuuuacuagcagauuguuuaaaggcuagguucugaaauaagacugugcagguuugaaaacuaagcauuaccaguuauuguaaccuugggcaagcuacuuaaccacucugaaucuuaguauucccaucuguaaaauggcuauaauaauaguuucuacguuuuaaauuuaugguauuaaaugagugaaaaccuagagagcucuuggcaugguacuuugcaccuaccaaguacuuaguaaaacuuaauaauauuuugaugguacugaugauacccuguucucucuucuaaacugugauauuguaucuuuaccugcuaggcauuuucucuuuuaaaaaaaauuauuucaguaguuuugggggcguacaagugguuuuuuguuacauggaugaauucuaauacauaguggugaauucugagauuuuagugcaccugucacuggaauaguguacauuguaccuaauauauaguuuuuuaucccuugucccuucucccacccuuucccuucuuagucucugaaguccauuuuaucacucuguaugccuuugcguacucaucugcugggcauuuucucuuauaccuucguacauuacauuaaacacacaucuaaaaucaaaccccucaucccacaugaagaccaccuuuuuuguugugcauauguguuuuaaguguagauauggaguaagcagccagaauuuauuucaguuaccaaauaucgacagacacuuuaaauaucucagaguuaaaaguugcaaauuauguuauuggaauucugagaacaauauugauugcugcuucauguuacacuaacuuuacuuuuuaaacuucugaaacgauuucauuugacaggguggaccuuaauuaaauauauguccacaaggagaguugacucuaaaugucccacaggauuucagaaacacaguaaauaccuuucuucuaucuauucugaucuccuugcucauaggcucucacauggaaucuuuggggcagcugucaguucuucauauuuuccagccccaaugcccuuuuuauaaaauuggguagcuguuaauacauugauacuugggcgcacagaguuggcacucaauaaguagccguuaaguaaauuaaucaaaagaauugcaagauacaagauaccuggucccuucuaucaaagaguuuauaaaucaaguaugaaugacaauaccugaaaccacuuaaaaaaaaaucuauguaaacaccguuauaugugacaugucaggauaagagggaacaacuaauaaauuuuguacacauucaguaaauggagagaaagguuuuuggagaugaggggcuugagccagaccuuguaugugugcuauuagaagcuuucugggcuggacacauuuaaaaacugcccuuugauacuaauaguauuaaaauucugucuccuuggaagcagacugccuguugcuuuagcuuuaaaagagauuuauauccaagcauugcauuaugcaagccauagaaagacuguuuuaugugaagaugcacugauugcacuucccucucuauauuuuauuguaguuaguuguuuagagcugucucuguguagagugugagguccuugagggaagggaccuucuuggccucuuauccccugcauacuuugcauagaggaggcacuucauaaauguuuguugaauaaaugcuacacuccuaauggguaagaaugugucauauuacucuuuguuuucuuauguguacugaaacaaauuguuucuugagauugguccuuagaauauuuauucaguuuucacugauucucuugcuacagguuagcuaaccaugcagcaggugcuugaguuucaccuuucuccaguccagcagaauuacauuuugaugaccuccauuuugauacuuguagaccagaucuaauccgaagauuaaucuuuagguaacagauggagagugauaaugauaacuucugugaagacaaacccaugcacacauucuguugucugaauaauauuuaaaugaauccuucugcucccaagucaucaacuugccccuuaacacacaucccucuagagcacaaaucugagcuccuuguagaucuuugcccucuucacucuccagaccuuccuaauuaaugucuucucagaaucgaccuucugucucucuuaaucauuaguuaaaagaaaaaguggcagauguaggaccuggggauacauugccacaucccauuuccuucucuaugagcaggauuuccaauuuccaagccugaugggaucucccagcuggaacaggaucuacaggucuuugaucuggaaacuaagacuagagaagucuuaagagaugacugcucaggugaguaaggcagaaucagauagaauuaguagggaaguaaaguucaauuguugagccaaguuguagcugcuuuggcacucagaaugaagagcucuguguguguccuagcauggagaguuccuuccuuuucccuucaguuagguugacccuuuccauuuguuuaguauccgugcacaugucguacuagaccccaaucaaguugcuuaucuaaaauucuuucagcuguuucccuauuauuuccuuacucugcugaacauguccgcuguuuuaccucacugcuccuguuuaugcccuuaacuucugcuguugagauuuugugccuguuuuucagaguaaauaaacuuuucuuguccuuguagauacuacauuguuuaguuuucucaucugaguuuucuuuuccuaagcacaggguacagauuacauuugcauuuucuauuuauauauuguaucagauggagagaccagagaagagaacaagcuguugauuccuaagcagaaaauuucggaagaagugcauucauacaaagugagaguaggaagacucaaacacgauauuacccaaguuccugagacuagagaaguguauaagucugaggacagauuagaaagacuucaggaaauucuaaggaaauuucuguaccuggagagagaguuuaggcaaauaacaaucagcaaggaaaccuucaccagugagaagaacaaugaaugucaugaacccgaaaaaagcuucagucuggacucuacuauugaugcagaucagagaguucuuagaauacagaauaccgaugacaaugauaaguaugacaugagcuucaaccagaauucagccucugguaaacaugaacacuuaaaucuaacagaggauuuucagaguagugaauguaaggaaagcuuaauggaucucucccaccuuaauaaaugggagagcaucccuaacacugagaaauccuauaaaugugauguaugugggaaaauuuuccaucagagcucagcccuuacuagacaucagagaauccauacuagagagaagcccuacaaauguaaagaaugugaaaagucuuucagucagagcucaagucuuagucgacauaaaagaauacacacuagagaaaaaccuuacaaaugugaagcaucugauaaauccugugaagcgucugauaaauccuguaguccaagcucaggcauaauucagcauaagaaaauucacaccagagccaaaucuuacaaauguagcaguugugaaagagucuucagucguaguguccaccuuacucaacaucagaaaauucacaaagagaugcccuguaaguguacuguauguggcagugacuucugccauacuucauaccuacuugaacaucagaggguccaucaugaagagaaagccuaugaguaugaugaauauggguuggccuauauuaaacaacaaggaauucauuucagagaaaagcccuauacguguagugaauguggaaaagacuucagauugaauucacaucuuauucagcaucaaagaauucacacaggagagaaagcacaugaauguaaugaauguggaaaagcuuucagucaaaccucaugccuuauucagcaucacaaaaugcauaggaaagagaaaucguaugaauguaaugaguaugagggcaguuucagucauagcucagaucuuauccugcaacaagaaguccucaccagacagaaagccuuugauugugauguaugggaaaagaacuccagucagagagcacaucuaguucaacaucagagcauucauaccaaagagaacucaugaauguaaugaagaugggaagauauuuaucaaauucaggcuucauucagcaucugagaguucacaccagggagaaaucauguauguacugcaugugguaaagccuucagucauagcucagccauugcucagcaucagauaauucacaccagagagaaacccucugaaugugacgaaugaagaaaagguauuaguguuaaacucuuaaucgacuccugcaaaucuauaccagugagaaaucuuacaaauguauugaauguggcaaauuuuucaugcuauuaguauuuucauaccuuagucacauuuggagaauucacaugggaauaaaauuccauugcugcaaugaaugugaaaaagccaucagucaaagaaacuaccuuguuuaguaucaaauucacgccaugcaaaaagauuauaaauguaauaagcauguaugugugugaggagauucagucauaacccaacgcucauucaacaucaaagaauuuauaccuaagagaacuuauuuggguguaguaaauggcagaucuuucaauaggaguuuaacuagucuuugucauaucagaauauccauaguagacaagaauuugauguaacgcaaauggaaaaacucgacaccacauuucaggcuuuacccaacaucgaaauaauggagagaaaauuguugauuauuuguuuaugaaauuguuaauacauagucccaaucuuuuucauugcacaaaaaucuaggguugacuugguaaaugcagugacauuuucucauggaguuccuuuauuuaauauguauucuaaguagguacguuuauuuuuacuuuuuuauuauaauuuugauauuaaaaagaacagagauggggucuugcuuuguugcccaggcuggucuugaacuccuggccucaagcgauccucccaccuguccucccaaagugcugggguuacaggcgugugucacugugcugggccuauuuuauuuauagaacucauuuaagcuguuuuuauuuuaauaugcccuauaaacauuuuuauauuuuuugaaauugguucuuaguguucacaacuuccauaagauacugcuaaugcaccaguauuaaaacacaucgacguaaguagcucauuuagcuuuuucugcuguucuuggcccaaguucuuuccaaaaccaacucuuaggccugcucuuuacuagggaucuuaugucguauugcuuuacagccacaacacuuggauuccuguugauuaacuucuccauucucuuaagcaccuuuagaagauuuagaaguuuccuaguuuuaaguguuucaccagcaaguauuccauaccuacuugauguugcuggucuggugucuuauuuccuaaagugaagcaucuuuuuuuaaaaaagaauuugauugacaauauauccaguccaauauaaguaugaaggauucucucuccugagauuguagcaggcagccaaacauuuucaaaugaugcccaagguuuuagcugucuugugugcauccacagucugcgaagaagacaugauaaggacaucagggagccaacaagacuccuaauagccucacuacauucauccagugccuauucugcaugccuaagcuuagaguucuuuuauauaccucuacggccagcaaaaugcucaggucugcucuugguaggguaaacauaaagaagauacacaggccgggcaugguggcucacaccuguaaucccagcacuuugggaggcugaggcggauggaucacgaggucaggcagucgagaccauccuggccaacauggugaaaccccgucucuacuaaaaauacaaaaguuagccgggugugguggcacgcgccuguaaucccagcuacucaggaggcugaggcaggagaacugcuugaaccugggaggcggagguugcagugagccgagauugcaccacugcacuccagccugggcgacagagcaggacucucucucaaaaaaacacaaaaaaacaaaaacaaaaaaccauacacacacacacacacacacaaaucagcaucauaagggaauguagccuuccaacagagaugaugcuguucguauguuaaucucagagacaguauuucaagagaguggcaggucuguuccugguaaaauuuuaaccauuaggauugcagauaaauguuugaauucugcuccucucucaucaauccaggacaguauuugaagugugagggcuuuguguauaguuguuuauccauuaccacauuuuuguauuuuaauagucuacaggcuauauaaaagaacauggcuuuuugacugauaaaagugauuacagauguuggcucaaguucagggccaccaucauauaccuaacaagaguucaugauucuuuagguaaugucaaaacauuuuguauuuuuccaucuuaagcuuuauaacauuuugugaguaagacaaauguuauuuaaaauucuuguugucaguccagcaauugaggcuuucauaguucaguguuauaauauucaguagggacccucaacaaauauauaaaaauauguugcucacucuauaauccuccuauggcuaaccucuaggauaguucugccacuauauuuuacuucuuugccaucagcaagaguaggauuucaucaaggcaagguaggaaucuaaaugaaauugauauauaaaugaauugaucuaaauguaaaagcaaaugaaaaaugcauguguuuuuuccugucaaacauguauacccuuauguauagagaccaguagucacguauggugacugaaacaggauuauguaaucccuaaaaagcagaauauguaaaaaucacauguaugcguuugguuuaggaaugugcuuuuguacuuccacuugaauaaagguguguuugguauucugagaauuuguuucaaacaaaaucugaaggucucagacagaagcguuugggaauguuggaaucacaucucuggcugcaacuccuuuccucccuggaacuugcuucacagcaagaauggaucacuuuccuuugcauugauaacaaagcuugcuuuuccacagaccucuggaacaaaagcugaauguuugggacuuaaaggggauuugauugggaaguuguugguauauaaaauaagacuaaauaguucgagguuucaguagaacuaggaauaacuuuuuguuuguuuguuuguuuuuugagacagucucguucugucacccaggcuggagugcaguagcgugaucucggcucacugcaaccuccgccuccuggguucaaacgauugucuugugucagccucccaaguagcugggauuacaggcaccugccaccuugccuggcugauuuuuguauuuuuaguagagaccggguuucacuguguuggccaggcuggucucaaacuccugaccucagguaaucugccugccucagccucccaaagugcugggauuacaggcgugagccgcugugcccagccauauuuuuuaaauaaguaaaacacuuuaaaaaaggcggacucaaaauaguccuuuagggcaauccuuuaagcagauauuuaauuggccugauacaugaguuugugu

SEQ ID NO: 14513 - RNA, 18462 nt, Homo sapiens
acacaaacucauguaucaggccaauuaaauaucugcuuaaaggauugcccuaaaggacuauuuugaguccgccuuuuuuaaaguguuuuacuuauuuaaaaaauauggcugggcacagcggcucacgccuguaaucccagcacuuugggaggcugaggcaggcagauuaccugaggucaggaguuugagaccagccuggccaacacagugaaacccggucucuacuaaaaauacaaaaaucagccaggcaagguggcaggugccuguaaucccagcuacuugggaggcugacacaagacaaucguuugaacccaggaggcggagguugcagugagccgagaucacgcuacugcacuccagccugggugacagaacgagacugucucaaaaaacaaacaaacaaacaaaaaguuauuccuaguucuacugaaaccucgaacuauuuagucuuauuuuauauaccaacaacuucccaaucaaauccccuuuaagucccaaacauucagcuuuuguuccagaggucuguggaaaagcaagcuuuguuaucaaugcaaaggaaagugauccauucuugcugugaagcaaguuccagggaggaaaggaguugcagccagagaugugauuccaacauucccaaacgcuucugucugagaccuucagauuuuguuugaaacaaauucucagaauaccaaacacaccuuuauucaaguggaaguacaaaagcacauuccuaaaccaaacgcauacaugugauuuuuacauauucugcuuuuuagggauuacauaauccuguuucagucaccauacgugacuacuggucucuauacauaaggguauacauguuugacaggaaaaaacacaugcauuuuucauuugcuuuuacauuuagaucaauucauuuauauaucaauuucauuuagauuccuaccuugccuugaugaaauccuacucuugcugauggcaaagaaguaaaauauaguggcagaacuauccuagagguuagccauaggaggauuauagagugagcaacauauuuuuauauauuuguugagggucccuacugaauauuauaacacugaacuaugaaagccucaauugcuggacugacaacaagaauuuuaaauaacauuugucuuacucacaaaauguuauaaagcuuaagauggaaaaauacaaaauguuuugacauuaccuaaagaaucaugaacucuuguuagguauaugaugguggcccugaacuugagccaacaucuguaaucacuuuuaucagucaaaaagccauguucuuuuauauagccuguagacuauuaaaauacaaaaaugugguaauggauaaacaacuauacacaaagcccucacacuucaaauacuguccuggauugaugagagaggagcagaauucaaacauuuaucugcaauccuaaugguuaaaauuuuaccaggaacagaccugccacucucuugaaauacugucucugagauuaacauacgaacagcaucaucucuguuggaaggcuacauucccuuaugaugcugauuuguguguguguguguguguguaugguuuuuuguuuuuguuuuuuuguguuuuuuugagagagaguccugcucugucgcccaggcuggagugcaguggugcaaucucggcucacugcaaccuccgccucccagguucaagcaguucuccugccucagccuccugaguagcugggauuacaggcgcgugccaccacacccggcuaacuuuuguauuuuuaguagagacgggguuucaccauguuggccaggauggucucgacugccugaccucgugauccauccgccucagccucccaaagugcugggauuacaggugugagccaccaugcccggccuguguaucuucuuuauguuuacccuaccaagagcagaccugagcauuuugcuggccguagagguauauaaaagaacucuaagcuuaggcaugcagaauaggcacuggaugaauguagugaggcuauuaggagucuuguuggcucccugauguccuuaucaugucuucuucgcagacuguggaugcacacaagacagcuaaaaccuugggcaucauuugaaaauguuuggcugccugcuacaaucucaggagagagaauccuucauacuuauauuggacuggauauauugucaaucaaauucuuuuuuaaaaaaagaugcuucacuuuaggaaauaagacaccagaccagcaacaucaaguagguauggaauacuugcuggugaaacacuuaaaacuaggaaacuucuaaaucuucuaaaggugcuuaagagaauggagaaguuaaucaacaggaauccaaguguuguggcuguaaagcaauacgacauaagaucccuaguaaagagcaggccuaagaguugguuuuggaaagaacuugggccaagaacagcagaaaaagcuaaaugagcuacuuacgucgauguguuuuaauacuggugcauuagcaguaucuuauggaaguugugaacacuaagaaccaauuucaaaaaauauaaaaauguuuauagggcauauuaaaauaaaaacagcuuaaaugaguucuauaaauaaaauaggcccagcacagugacacacgccuguaaccccagcacuuugggaggacaggugggaggaucgcuugaggccaggaguucaagaccagccugggcaacaaagcaagaccccaucucuguucuuuuuaauaucaaaauuauaauaaaaaaguaaaaauaaacguaccuacuuagaauacauauuaaauaaaggaacuccaugagaaaaugucacugcauuuaccaagucaacccuagauuuuugugcaaugaaaaagauugggacuauguauuaacaauuucauaaacaaauaaucaacaauuuucucuccauuauuucgauguuggguaaagccugaaauguggugucgaguuuuuccauuugcguuacaucaaauucuugucuacuauggauauucugauaugacaaagacuaguuaaacuccuauugaaagaucugccauuuacuacacccaaauaaguucucuuagguauaaauucuuugauguugaaugagcguuggguuaugacugaaucuccucacacacauacaugcuuauuacauuuauaaucuuuuugcauggcgugaauuugauacuaaacaagguaguuucuuugacugauggcuuuuucacauucauugcagcaauggaauuuuauucccaugugaauucuccaaaugugacuaagguaugaaaauacuaauagcaugaaaaauuugccacauucaauacauuuguaagauuucucacugguauagauuugcaggagucgauuaagaguuuaacacuaauaccuuuucuucauucgucacauucagaggguuucucucuggugugaauuaucugaugcugagcaauggcugagcuaugacugaaggcuuuaccacaugcaguacauacaugauuucucccuggugugaacucucagaugcugaaugaagccugaauuugauaaauaucuucccaucuucauuacauucaugaguucucuuugguaugaaugcucugauguugaacuagaugugcucucugacuggaguucuuuucccauacaucacaaucaaaggcuuucugucuggugaggacuucuuguugcaggauaagaucugagcuaugacugaaacugcccucauacucauuacauucauacgauuucucuuuccuaugcauuuugugaugcugaauaaggcaugagguuugacugaaagcuuuuccacauucauuacauucaugugcuuucucuccugugugaauucuuugaugcugaauaagaugugaauucaaucugaagucuuuuccacauucacuacacguauagggcuuuucucugaaaugaauuccuuguuguuuaauauaggccaacccauauucaucauacucauaggcuuucucuucaugauggacccucugauguucaaguagguaugaaguauggcagaagucacugccacauacaguacacuuacagggcaucucuuugugaauuuucugauguugaguaagguggacacuacgacugaagacucuuucacaacugcuacauuuguaagauuuggcucuggugugaauuuucuuaugcugaauuaugccugagcuuggacuacaggauuuaucagacgcuucacaggauuuaucagaugcuucacauuuguaagguuuuucucuaguguguauucuuuuaugucgacuaagacuugagcucugacugaaagacuuuucacauucuuuacauuuguagggcuucucucuaguauggauucucugaugucuaguaagggcugagcucugauggaaaauuuucccacauacaucacauuuauaggauuucucaguguuagggaugcucucccauuuauuaaggugggagagauccauuaagcuuuccuuacauucacuacucugaaaauccucuguuagauuuaaguguucauguuuaccagaggcugaauucugguugaagcucaugucauacuuaucauugucaucgguauucuguauucuaagaacucucugaucugcaucaauaguagaguccagacugaagcuuuuuucggguucaugacauucauuguucuucucacuggugaagguuuccuugcugauuguuauuugccuaaacucucucuccagguacagaaauuuccuuagaauuuccugaagucuuucuaaucuguccucagacuuauacacuucucuagucucaggaacuuggguaauaucguguuugagucuuccuacucucacuuuguaugaaugcacuucuuccgaaauuuucugcuuaggaaucaacagcuuguucucuucucuggucucuccaucugauacaauauauaaauagaaaaugcaaauguaaucuguacccugugcuuaggaaaagaaaacucagaugagaaaacuaaacaauguaguaucuacaaggacaagaaaaguuuauuuacucugaaaaacaggcacaaaaucucaacagcagaaguuaagggcauaaacaggagcagugagguaaaacagcggacauguucagcagaguaaggaaauaauagggaaacagcugaaagaauuuuagauaagcaacuugauuggggucuaguacgacaugugcacggauacuaaacaaauggaaagggucaaccuaacugaagggaaaaggaaggaacucuccaugcuaggacacacacagagcucuucauucugagugccaaagcagcuacaacuuggcucaacaauugaacuuuacuucccuacuaauucuaucugauucugccuuacucaccugagcagucaucucuuaagacuucucuagucuuaguuuccagaucaaagaccuguagauccuguuccagcugggagaucccaucaggcuuggaaauuggaaauccugcucauagagaaggaaaugggauguggcaauguauccccagguccuacaucugccacuuuuucuuuuaacuaaugauuaagagagacagaaggucgauucugagaagacauuaauuaggaaggucuggagagugaagagggcaaagaucuacaaggagcucagauuugugcucuagagggauguguguuaaggggcaaguugaugacuugggagcagaaggauucauuuaaauauuauucagacaacagaaugugugcauggguuugucuucacagaaguuaucauuaucacucuccaucuguuaccuaaagauuaaucuucggauuagaucuggucuacaaguaucaaaauggaggucaucaaaauguaauucugcuggacuggagaaaggugaaacucaagcaccugcugcaugguuagcuaaccuguagcaagagaaucagugaaaacugaauaaauauucuaaggaccaaucucaagaaacaauuuguuucaguacacauaagaaaacaaagaguaauaugacacauucuuacccauuaggaguguagcauuuauucaacaaacauuuaugaagugccuccucuaugcaaaguaugcaggggauaagaggccaagaaggucccuucccucaaggaccucacacucuacacagagacagcucuaaacaacuaacuacaauaaaauauagagagggaagugcaaucagugcaucuucacauaaaacagucuuucuauggcuugcauaaugcaaugcuuggauauaaaucucuuuuaaagcuaaagcaacaggcagucugcuuccaaggagacagaauuuuaauacuauuaguaucaaagggcaguuuuuaaauguguccagcccagaaagcuucuaauagcacacauacaaggucuggcucaagccccucaucuccaaaaaccuuucucuccauuuacugaauguguacaaaauuuauuaguuguucccucuuauccugacaugucacauauaacgguguuuacauagauuuuuuuuuaagugguuucagguauugucauucauacuugauuuauaaacucuuugauagaagggaccagguaucuuguaucuugcaauucuuuugauuaauuuacuuaacggcuacuuauugagugccaacucugugcgcccaaguaucaauguauuaacagcuacccaauuuuauaaaaagggcauuggggcuggaaaauaugaagaacugacagcugccccaaagauuccaugugagagccuaugagcaaggagaucagaauagauagaagaaagguauuuacuguguuucugaaauccugugggacauuuagagucaacucuccuuguggacauauauuuaauuaagguccacccugucaaaugaaaucguuucagaaguuuaaaaaguaaaguuaguguaacaugaagcagcaaucaauauuguucucagaauuccaauaacauaauuugcaacuuuuaacucugagauauuuaaagugucugucgauauuugguaacugaaauaaauucuggcugcuuacuccauaucuacacuuaaaacacauaugcacaacaaaaaagguggucuucaugugggaugagggguuugauuuuagauguguguuuaauguaauguacgaagguauaagagaaaaugcccagcagaugaguacgcaaaggcauacagagugauaaaauggacuucagagacuaagaagggaaagggugggagaagggacaagggauaaaaaacuauauauuagguacaauguacacuauuccagugacaggugcacuaaaaucucagaauucaccacuauguauuagaauucauccauguaacaaaaaaccacuuguacgcccccaaaacuacugaaauaauuuuuuuuaaaagagaaaaugccuagcagguaaagauacaauaucacaguuuagaagagagaacaggguaucaucaguaccaucaaaauauuauuaaguuuuacuaaguacuugguaggugcaaaguaccaugccaagagcucucuagguuuucacucauuuaauaccauaaauuuaaaacguagaaacuauuauuauagccauuuuacagaugggaauacuaagauucagagugguuaaguagcuugcccaagguuacaauaacugguaaugcuuaguuuucaaaccugcacagucuuauuucagaaccuagccuuuaaacaaucugcuaguaaaaaaaaaauuaugauuuugccuccuaacaagcccugaaaaaaaauaaauaaugacugugaacaaaauccaucccuuccuccaaauuacacacagaaagaacguguaaguuuucuuggcacuagccuaaaugccuauuuccuaaauuuaacucaaaacuuugcuuucaaaauaugcacuugcuuuauuuacauuuuuccuguuuaaaauuaauguauuaaaacuuuuugauuuuauuuaaaucuugaguuuucuaauaugauuuauaaaauauugacagugaaguaaaagguaaauacaaacaacagagaaaaagugauuagaauaacauacggugaaccaggauccuaaauaauuggagucgcagaaguguuaauuaaaagggaucuauggcugggcacagaagcucacaccuguaaucccagcacuuugggaggccaugacggacagaucacuucagcccaagagucugagaccagccugggcaacauagugagaucccaccucuacaaaaaauacaaaaauuagccaggcaugguggcacacgccuguagucccagcuacuugggaggcagaggcagaaugaucgcuugagcucagaaggccgaggcugcagagagccaagaucacaccacuguacuccagccugggugagagugagauccugucagucagucagucagucaaucaaccaacaaacgaaucaagaggaucuauggaccaggcaugguggcucacacguguaaucccagcacuuugagaggucaaggcaggaggaucucaugagcucaggaauuugagaccugcuuggggaacauagugagacuccaucucuacaaaaaauuaaaauuaaaaauuaaaagggaucuaaaagaugauuuauuaucaaggaaauggaaauccuuuacaauaaaaauccaaaccccagccaggcacgguggcucgcgccuguaauccuagcacuuugggaggccaaggcaggcagaucacaaggucaggagaucgagaccauccuggcuaacacggugaaacccugucucuacuaaaaauaccaaaaauuagccgggcgugauggcgggugccuguagucccagccacucgagagacugaggaaggagaaucgcuugaacccgggaggcagagguugcagugagccgagaucacgccacuacacuccagccugggagacuccauuucaaaaaaaaaaaaaaaaauccaaaucccuagacaauaguccaaacaauaauaaauuugaggaaacuccacuauaaauaaauaauuugaacacacuccugaaauuuuuauuuguauuaaaaaaucuggucuauggcucauaucgcuugcuauucuuuccaaaauauuaaaguaacuagcacaaggcagguacuuaauuuuuuuuuuuuuuuuuuggccgggggguauggagucucgcucugucgcccaggcuggagugcaauggcaugaucuuggcucacugcaaccuccaccucccggguucaagcgauucuccagccucagccuccuggguagcugcaaucacaggcauguaccaccaugcccagcuaauuuuuguauuuuuaguagagacgggguuucaccauguuggucaggcuggucucgaacuccugaccuugugauccgcccaccucacccucccaaagugcuggauuacaggcgugagccaccgcacccgacacaagccagguacuuauaugcauaaucuaauucaauccuguacccagaagguagacauuauuuuucauguuuuauaaaccaagaaaaugagugucagauuaaauaauuugcucaacauacuacagcugguaaguggaacccaagcuugaucccaguuuauauucuuuccaaccuaucauacugccuaucaaagaaagcauuaguagcagguucucuugacauugacgugaaugcuuuuuuuuuuuuuuugagacggaguugcacucugucacccaggcuggagugcaauggcacgaucucggcucaccucaacuccaccuccuggguucaagugauucuccugccucagccuccagaguagcugggauuacaggcaugcgccaccaugcccggcuaauuuuguauuuuuaguagagacgggguuucuccauguuggucaggcuggucucgaacucccaaccucaggugauccgccugccuuggccucccaaagugcugggauuacaugugugagccacagcaccuggccgacucuaugcuuucaaaauaugcacuugcuuuacauuuuuuccguuuaaaauuaaguuauuaaaaccuuuugauuuuaaggcuggauguggaacacaugaggccaagaguucaagaccagccuggccaacauggcaaaaccccaucucuacuaaaaauacaaaaauuagcuggguaugguggugcaugccuguagucccagcuacucuggaggcugaggcacaagaauggcuugggccugagaggcggagguugcagugagcugacauugugccaccacacuccagccugagcgacagagcaagacugucuccaaaaaaaaaauuauuuuauuuaaaucuugagaguuuucuaauaaaauuuauuuuaaucuggucuucaaaaauaacaguuaaagcugagcaugguguuggcucacauguguaaucccaggacucuggggagcugaggcaugcagaucacuugagcccaggaguucaacagccuggguaacauagcgaaacaccuucuuuacuaaaaauagaaaaaaauuagcaugaugguacaggccuauagucccagcuacccagaaggcugagguaggaggaucaccugagccuggagggaaguccaggcugcagugagcuguuaucaugccacuguauucuagccugggcaacaagaggggacccugccucaaaaauaauauuuaaaauuugccuuaucauaugguuugcugcuuuuacuacggcuaugcuuuuagccaucugaaagcuucacgcuuuucuuccugguccuuaauacacaaauaauaucucuccuuagcaauaucauucuuuuguagauaccuguuggacuggaaugugucccuagagaguuuuacuuuuugaaugcauguccuuucuggucccaaacuauauacuggccugucuguccaauuugucauggcauuuugaauuuuucuugucaucagaguacacacaacucacuaaaaauauuaaaaacuccauguguaguugaacuuauuguccuaagggcacaaaguagugaaaaagugcaggggcuucagaggcagaucugggucccaagccucucacugauccugcaaagaucacuuaacuucucugagccucaguuuccucagauauaaaauaggagcagugucaucugcucacaggguuaugguaaggauuaaaugagauauauacacauauccuuuauauauauauauacacacacacacacacacacauauaaauguccuaugucuguguguguguauauacauauguguguguguguguauacauacauauauauaguacccaauaacauauuggcugcucaauaaauacuaaauagcugugacaauggaaaacauucugugcaaaauaacuguaguccuucaugacaucaaguuaaaaaagcagagaguaugugccaaacauucccaaucuacugacccaguuaauaucaauuagaauuuuaacaagcaugcuucugaggccaucaucuaauagggcaccugccacacuuacccaugugaaaagcaacucgguccccuuuaugggucuuaaucuaccacacuaaguaacagguaacuucccuauggauagugacccagaggcaaauuguucauucaucaucaauggaguauguucuuuuuucaauuaugugguaacgaaaauuacuuauuaccgacuucuuuacucagcuauuuguacucuguauauuuacugcugcauaguggaagcacuuaagcaaaggaccaacguucuaaugucugugacaaauacaaucuggaggccaggcgcaguggcucacaaccuguaaucccagcacuuugggaggccgagacaggcggaucacgaggucaggagaucgagaccauccuggcuaagauggcaaaaccccaucucuacuaaaaauacgaaaagauuagccaggcaugguggcgagcaucuguagucccagcuacuugggaggcugaggcaggagaauggcaugaagccgggagguggagcuugcggugagcagagauggugccacugcacuccagccugggcaacagagcaagacuccgucucaaaaaaaaaaaaagucuuacaacccuaaaaaguuaaauuaauaaauguauaaacuuaacccaguuaugcuggagguugcaauuuuuguuaaaaaucagaccuuggcgaugaccuugagcagcgggacauaaauaauucccgcaagcuuaguguuccaauaauggaacacuaggcauaaauggguuaauuuucagaugaagucugcugaacccaaaaauaugaaaaugauuucccaaggauuguaaaaauaacugcuaaggagaugcugcuaacuugaucacaaaagcaagaugaguagaaggcuuucuugcacugugcgugucucuuguauguguaaaaguguguaugcaugucgacugcaugucgagugugcagugcagagauaagagaggaaaugggauaaaguucagucuauagcauacuaugcuauuagacugcauuaaacugcuacaaaguuucuuuacuccaaaaaguagacagguuaacuguuggaaacucuguaauuauuagauaaaauuaacaguacuuuacaauuauauguaugucacuuuacaguuuacaaaguuauuaaguagauauucaauuugaugcccugaaauaaauuuaacuucuuugcccucccuucuccccuccaucaaggacagaguaaggaacacuuaaucaggaaaggcaauauaauugcaucaaucuguacagaaccacaaagaauaaaggguaggaagguaggaccuugaagagggccacagggacuucaaggaaggaggaaaccagaauguuaaacaugagggaagcccaggguucacaggagaguuaggcaccauacggggcagguuguguucgccacauaaaaggaggggcacacagcauaaguuucacauucuaaaauaauaugaaaagaccauaacugaagagcugaauuuggaauuucugguuuuucacaauacaaguagaugaugaccaccaaccaugguuucugaaugaacuggguucaaaacauaucugguugcaacagagggcuuccuuggacccuaacauuugaaauuaaacagagguaauuugaggagcugcgauuuuacacagugguggcauccuggggagcuucuauuccaucagucaauuuuaauaucucacaaucguggaaaaggaguuuccgagcagggacgagcaauaucgaugggaagccgauacuugggccaucucuuggagauuccugcuguaaggacggcaaguguuucuccagagaaagcacuugccuggguaugacucagggccgggcaggaauucacacuaugaauccggguggugggaaggcggagaaguaugccuacaaagauuaaagagccaggaauggaaaacacacuaaaaaccgucccagugggcagccugccuccccacaaauaagaagaccuugaauccugagcauaaucagggagacaaagcaaugcccuggaugccaccagcauagacaaagccaacggaaaaaaaaaaaagaaaagaaaaugcaugauucaguauuuacacacacaaaaagaagagugcagaagcaagcaagaaacuaaagaaaaaggaggcugggugcgguggcucaugccuguaauuccagcacuuugggaggccaaggaagguggaucacuugaggucaagaguucgagaucagccugaccagcauggugaaaccccgucucuacuaaaaauacaaaauuaggcgggcgugguggcccaugccuguaaucccagcuacuugggaggcugaggcaggagaaucgcuugaaccuggaaggcagagguuguagugaguugagauugcaccacugcacuccagccugggcaacaagagugaaacuccaucuaaaaauaaaauaaaauaaaaaauauaauauaauauaaaaaauaaacuaaagaaaaaggaacaaugcucacaccaagggagcugccgacaaaccccacugaugcuucccagcagcacuacagcuuggcuaaucccagcuucccacuguaccuuucaaaaugacaagggagagacaugaguuaagcauugaccccaccucagcaugggguaaacaucugagauuucugcugcccugggugugguuacgugggauuaccauucugggugacucacugaaauguacucacagugagucaugccuucaaaugacaucucaaguucugccugcuuggagauacaucuggggaucuuaaggggugagggacuacucaacaagaaggaauuuagccugucuuuuuaaauaaacggcauuucuuuuuccuagaaaaaugggaaauucuucaauucucuaauacagggacacugagauaacaaagaggaaagugucugguuggagguugggaggccacccuggggucucuccuacaaaaauggaaaagaaaagaacggugagaaaucaagcaaagcacaagaaaguuucccuuugcuaaaagggaaaagaugccccacaauggccauaaacaugaacuggggauaaggaggagaaugucucuucuuggcacccccaaacaaacguuaauuaccccucccggagaagacgaugugaaagauaaggauucagagguucuaaguccuggaaucuaagccacacucuacagaccuucucagagaccuuauacuuaggaagaaacaagaaaguaaagaaauucaaauagauaaaccgaauaauaaggaaguccuuacccagugagaccacguucccauaauucucuaacaucacuucucuguagaggucccucugaacaggguccagguauccccauuccucucgaguaaggugcacagccacauccucgaaugucacaaacuccugaaauaacacauccuggcugcucugaggaaugagaacacuguagcaccauggccagagaaugaagaucauagagaggguauccacuguguacuuacguugaggaggagggagaacagauuagaaccuacggaauaaagcccauaacccuuaaacaucuaauaagcacccaucacacaaccauggacaaagagaaaacagaguuugcucauggcacuggggagaugggaaguugguuuaugugaaguccaggucuccgaagaggaucaauucccaaacuggagucugcuauugaaaaaaauuccaggcaaggucuacagaugggaugagagagaggccacacuccaucaguagcaauagucccugaggaaaagcagaggguuccucagcucaccugguaccuggcugucaagagcgcagcugccuggucuccugggcuucccucacggggaagagcaggcaccugaggaacagguggagcugagggaggagaaaggagugaagagugagagcagcccuuucccagggcucccuuucagaggaggccucuccagcccaaggggugucagcaggacccuccucaauacucuaguaaaaccaaugaacauuuuucagguauugggugugucuacucugcuucgucucaguacuugcaugccuuaugcguguuuugaccugugauacaggauuuucuuaggaaagcuuguauuucacuuuaucuucaucacaugacaguccucuuacagaagaguaagacuauaccuguuuugcagaugggcaaagcaaagcauaaagacuuguggggacuuguccugggcuaggguuauuuagcagacuucugacccuuuccaggcacuguucuagacacuugaucagcguuucucuugugaaugggugcugucucaaccaguguguaaggcccccaagaacaagaaagggucaucuguuuccucgaaaucuuuuccacagucccacaaucccccacagcacucuacacauuguggcacuugaucugugugggugacacacaaguuauuucaggcacuagaguuaaccacaggcaaucuaagacacagcucuuauaaaacaaaggaagaaaaagaccaaccuaccuauacgauacagcaaagugugacugcguagucaaaauacaguauauauacauucauacaggcauuguguucaaccaaggaauuaaaugguugcuuccuugaccaaauuuagucuagucacaaaacacugcaguuacaacagaauggauggcaggugacaaagcaaagaaaaacuaagugaagggaacaggggaaagaaagguccugaaccuaagaggaagugagagccaggaaaggacugugagauguggcaaaagcagcauaucuuagaaauuauucuggaugugagaacugggaugaagugaagguugccugaaggaaaaaccaccacagcgaguaagcagccaucacucugcuuauuugagaaagaugagcuauccuuaauaaaggggcucagacuaggacugaacugagucacaucugcccccucuuucauuccucccucuagggaccauguucuuauuccaguucuuggccucucucaaaccaggcccaggagcccccucgggagccccuccgcacucccacucucccagacggaagugcuuucucugccuuacccccagugagucccuguuccaugucgguguccugcacaaacugaggcucuggggacagacacucagacugggucuccaaagacugaaacuggacccuuggugacccugcugcuuccugggcugguauuuccuccaucacugcucuggaggacaaugaccaucacugcaagguaagauuaagagaaauuacuguaauaaguuaaagcauuucaucauuuuauaucgucaggacuuugcaaaggaucuuacacacuauggauauucaauaaaaauuaguugauaaugauuaaccacccuaaauaaguaacagaaaaauggggccaggcgcaguggccuguaaucccagcacuuugggaggcugaggcgggaagaucacuugaggucaggaguucaagaccagccugaucaacauggugcaacuucuucucuacuaaaaauacaaaaauuagccagcgugguggugcgggucuguaaucccagcuauucgggaggcugaggcaggagaauugcuugaauacagaaggcauacguggcagugagccaagauugcaccacugcacuccaaccugggcaacacagugagacuccgucccaaaaaaaaaaaaaagaaaaaaaagaaaaagaaauauggauaugcuucagcuuuaaauacuuaagaaccaaaucauagaagagucucuaauuuggaauuuguggcauuaaaaaaauuaacacgguacaauuuaauaguguaaagcuuucuguggaaacuuuaaaauauuuaaaauuggccacgugcgguggcucaagccuguaaucccaacaguuugggaggcacagacggguggaucccuuaagcucaggaguuccagaccguccuggacaacauggugaaaccccgucccuacaaaaaaaaaaaaaaaaaaaaaaauuagguggcccaggccuguaguuccagcuacuccaaaggccaaggcaggagaaucgcuugagcuugggagguagaggcugcagugagcuaugacugcgccacugcauuccagccuguaugacagcgugacagcccaccucaaauaaacaaaacaaaauauuuaaaauuuacaaucgucuuuggaggcucaaguuggugcccagagaaaaaugcuaguuaugauugcucauuuuauuuuaauuuuguuuuagcagagaugggagucucgcuauguugcccaggcuggacucgaacgccuggccucaagcgauccucccacuucggccucccaaagugcggggauuacggcgugaaccaccgugacaggcccgcguuuacguaaauaaacucauuuaaauaaauaaaacagcaggcccccuaggaaaugucuugguaacaccgucagcccacuccgauuuacuacacgggcuuggcgaauaaaacuccacuuuuggggucaggcccuucgcuaacucagaccagcuagaccggccuuuucccggaauccugagagcaacgcagguaagagcugcgguucgaacagguuugagcggcguccuucaggcccaaggacgcaugagggugccgucccccucccaccacccucgcccugggccccugcccggcucccagcucgguccucagaaggccuugcccggcgcugcccuccucccacuucccuuuuaggccaaggcaaagucccaaaaggaccagugaggacauacagaccagcucgcaccagggcacggucgccggcuccugacggcggggcccucgguccgcgaggugaaugaaccagggcugaagagaaacaggcccuccucgcacccgggccuccgcgcacucucggggaagcgaacuaccgucggccgcggccggacgccgccuccuucuacucccgugaaggcaaaacaagcugccaccccgcugcgaccccaaaacggcuuccggguacucaccgaggggaggggcgggccuggccgcuguccugucaccuacacacucgcgcucggggccaccacagccucucccgggccgcuguagacagccccgaggccggcgcuucucgguggcacuu

SEQ ID NO: 14514 - RNA, 443 nt, Homo sapiens
gaugguuuacaucgcaaauggacaagugcuggacagcuggagucagucuccauggagauuaucuuugauaacagauuucuuauggggaacagcugaguuugugguuuugcuuuucaaaacucugcuucagcaagaugcgaaaaaaaaaaaaaagaagcuauggaaacucaucugauuccagauaugaugauggaagagggccacugggaaacucuccccagagaauuggucgaaucaaucauuugcguggccccaguccuccuccaauggcugguggaugaggaagguaaaugucugcucuaugaagcagacaacuggacaugcauauucauagcagaaagaaaccaucaagaaguggggggcuggccaugcuggagcaguagacaaaugugugugucuaaauagggacugcucuguguucucacagaugaaugagguaaugc

SEQ ID NO: 14515 - RNA, 1399 nt, Homo sapiens
ucuuuuuuuuuuuaaaccaaaaaacauuuuuucauuuaaaaaaguauuuagaacacauaaaacaaggcaacauuuauucuuuuuucccaucuucugguaugggaucuguugguggcuccuccacuguugggcuguugcucucugagccaguguuacuaucccugguuccuuccucugccauacuguccacccccuccugccacucuccuuguccucaggaguagacgugccuucuucaccauucuguuggcucucugucauuucuucaaggugugucuccucugucuccauuggaauguugucgucuucuuucuucuccucgccuuuguuggcugcuuguucuuccucaggaaggaugcugcucugacugcgcucagcuugcucugcugccuccuucucccuuuccuccugcccuuugcgggccuguuccucugccugugcaaucucagcugccauuuucuccauauccacuucuacuuucagagggcacaaccuuuuaaguucauuguuaagugaaucugugcuuuccaggaauuuccucuucuucuccuggugucguuccucuauuugaaguucagcuucuaguuuucgcugaugaaccauuaaggacuggaccuguccuucgaggaccugcauucuagcuguugugacaacugaccgaacgucugccaccacacucccacuaaggauuucacugaugaggagguaguuucucuggaaauggguagugacuguaugcuucauugaaaagccaucaucauaaucaucuggaucuucagcaggcugaaugcucauguacgguucuccuuucuccaagcgagacugucucuguccacuuucucccucuaaaacagcuucugcacgacuuuuugcauuuauguaagcaaaguacacgggggaauuaugauaggccuucauagauucauuguacucuaucuuuucugcuuuguauucguuuaaauauucuuguuuuucaucagugagaucuugccacaugccaccaauaaucuagccaaucucccacaacuuuaggucaggguuggaagccuuuauuuggucucagaccuuucugcuguaccucauguagggcaucagcagcuuaucugguggcuuucaggguuuuggaaugguaauagcggaggaugcccugacccagcuguuggugggcggguuuccucccagccuguaguugcugucggugagcugacuguauggauuguaucccacaaacccuggugugcugggcauuuguguugcaggagcuggggugggagguggggcauaagauggucuuuuugacauuuuggaagauuaaguucucaguuccuuaagaacgaaucugagacaccaugggcagaaaaagcgccugcagcuccagcuucacuucccuuuacgugcu

SEQ ID NO: 14516 - RNA, 971 nt, Homo sapiens
ugccccugauucacggucucugccuucuagcuaugaauucccuauucaucuauaauuuccuugagcaccaagaccaaaccuuacagacuccugaauggaugucugcauauaggucuccugcauggaugacugugcuuggcacauagaagaauuucaacaaauaccugcugcuucuguugucuuccacauguaccagcaagcuaacauguaggggauaccacucaaaaucugacaguacacaauuaacugcuaaaugggcaguugagacaccaaagcguuuuagguuuuuuuucuccauuuuccccggcuccuugcacagcgaggaccaggaucaugugaucuguauuucuuuugcugucaucauugcuagagaccacauacugagcauguccuugugccuggcccugggagaaguguggugugcauucucucuuaauuuucacaacuccaagaggcagguauuacaauuauucccauuuuacagauuaaaaaccugaggcuuaaagagguucaauuugcucacaguuacagcacauugagucugucuaguaacuaaggugauggcagcaggaauugucuagcaaggcauaagacacaggggucagugaugguugguggccuaagccccucacccagcaccauauauuuucaaugaagaucauggaccugucuauguuuucaaugaagagcccgugugguuugaaagugcaccaacugcaaaaagcagacugcauccuggaggggcaaguccccacguauaacuugcccaagagccuggauguguggacucacucuuggcauggccgugaaaagcagucauccacuucuuaauugauuguacacugguuccaucucaaggauucccagagaggauuaagaaaaaggauguuauucaaccaaaacgcugaucaaauuaaauauucagaucucagauaugucaguuaagaucucagcucaaggcugaaauauuu

SEQ ID NO: 14517 - RNA, 4119 nt, Homo sapiens
ggugggcuccagaaauccaagaaccagucuauagcucuguguccuguuccucacacugccccccaccccacccuagaccccaccaugcaccuagaaguaaauauuuggauacugaagcaaaugcaugacucaagcacauaggauaguauuaaugauggacacuuagugcagggccagggcccccagccaguggagugcucaugaguguucaggaaugagccagugcaaccccugccugcagaggaggggcugggcauggauacugagaugcuaaccaucacugccccuaaggggacuucaucuaucccuagcaaggucacagugacugcaguugccuccacugauacuaauucagagcucuugccccccgccccccgcccuuuucccauauuaauguuaccccuuagcaucuuuucuuuucuuucuuuuuuuuuuuuuuuugagacggaguuucgcucuugugguccaggcuggagugcaguggugccaucucggcucacugcaaccuccgccucccuaguucaagcgauucugcugccucagccucccgaguaguugggauuacaggcgcccaccaccacgccccgcuaauuuuuguauuuuuaguagagacagcguuucgccauguuggccaggcuggucuugaacuccugaccgcagaugaucuugcccaccugggccucccaaagugcugggauuacaggcguaagccaccgcgcccagccccuuagcaccuuuuaaaaauaaaaagggcagcguuuuacagcaaucugucccauuguugcagaaacauccaacugauugcacuuuuucuucuucucucgucaacucguaacuccuaucucaaguucacccacaggucuagugacuccggcuggcugcugcggggcgaggagacucgcagaaugccugacuagaggccacucgcgcgcucuggacgguggccguaucuccagggucugagccccggagccgcaguccugccgcagagcgccuggagccgcgagcagcuagcagcccggcgaagcgcacagccucggcgauagucagcuccgcggccucugcucccgccccucccggccgcuccgggaaggggcggagacgaggaggagcugggacggccgccgcgcucccgggcgcaccaagcccuuuaaaagccgcgggccuugacaguucugcaggcagccgccgcggucccggaccucuagucccgcacucccagcuggcgagccggcuccgggugcggcgaggcccagcccucucggauugcgcgccggaccccgggacgcgcuccaugcggccgcucagcauguccgggcacuuucugcucgcacccauccccgaguccuccucggacuaccuacugcccaaggacaucaaacuggcggugcugggcgccggccgcgugggcaagagcggugagugcggcggggacccccgggcggcuucgcuccccggcuccggccgcgaccacugggggcgcugcggagagagggcgccucggccgaagcagagggcgcgggugcagguagaaucgggcugcuuucgcgcugggugggucccgguccgucccggccugcuucccuggcguuuccuggugcaucuacuccugggaucucggcgggauuggcgccuguucggggauggggugcgggagaggugucccgccagucguacucgcggccaagcccgcggcaccacggcuuugcggagccucuggaagcgagcagugcccacgguucugcacccuucacuccccccaguuuguccgaggugccuggguuugacaggcuuguucuacuccuucgguugauuuuccuauuuccuuuucagcaaugaucgugcgcuuccugaccaagagauucauuggagacuaugaaccgaauacaggugagaauacuuucacgcucccugcuuuuaugcuugcguguuucuuuuuacggaugggaguuugagaauuaaaaagcaaacucuacuucauucuccaggcaagcuguauucacggcuggucuaugucgagggggaccagcucucccugcagauccaggauacucccgggggcguccagguaagaaccgccaggggcaaacagcucacccccacccgugagaccaccccagugggcacagcacguagggcgcccaugcugggcgcaggggucugagcaaggcaucuaaaccgaccugugcguuuagagggaggaaugggcuguccacagguggggccagugguugggguguuagaaacucucuaagggggaggcaugguuagaagcagccuccucuuguuaagcaccugacuuaacuucacuuugcaacccuggugggccaucacuacuuaagcaggucucaccauuucuuccggagguagccauggaaccauuaacaaagaaaaaaacguuuaaaacaaaacaaaacaaaacaaaaaaagagguaggauucugaugggagagacucuucuccccuggcaagcucugcuuuuuuugagacggaguuucacucuugcccaggcuggagugcaguggcuggaucucagcucacugcaacuuccgccuccuagguuccagcgauucuccucgauucuccugcuucagucucccgaguagcugggacuacaggcacccgccggaacucccagcuauuuaucuauuuauuuauuuauuaguagagaugggguuucacuauguuggccaggcuggucucgaacuccugaccucaagugauccgcccaccucggccucccaaaguggugggauuauaggcaugagccacagcgcccggcccaagcacugcugaacugcugcuguuaauggcuguucccucaagucaguaauugcaaucagauaaccccuuggcagagggucuagaauguaacuuguuuauuaaccaguuacuaauugcuacuccguucuccagaggaaaggucuuguggaagaacccuaagaaaggaauuucuuucuguaacauucuuaagaagugcauguuaaaaauguuuuuaugaguuugggaauagauauuuaucuuggcuuauuuucaaaguuuuguuuauuaugaguuaguguuuccuaaaacuugagccauucugguuugaggucauucuucagucagccaugguucaccagagacugccugacaagcaagggguuuaaaaauaaugcagggauaacagcuaauaaaguaacucaggcagggaguuugccugggaaucuguucuuuccauaucaaaagccugcuucugcagaagcuggguggaaacugaaaacuguauuuagagauuucuuuuucaaguguuucuucaaggguugccuugauguuguuuugaguuuaucucccacugaggguuuccuugacuggaucucauuuugauguuuucucagauccaagacagccucccccaggucgucgauucccuguccaaaugcgugcagugggccgaggguuuucugcuggucuauuccaucacagacuaugacagcuacuuguccauccgaccccuuuaucagcacauccggaagguccacccugacucuaaagccccugucaucaucgugggcaacaagggggaccuuuugcaugcccggcaggugcagacacaggacgguauucagcuagccaaugagcugggcagccuguuccuugaaauuuccacuagcgaaaacuacgaagaugucugugauguguuucagcaucucugcaaagaagugagcaagaugcacggccucaguggggaaagaagaagagccuccaucaucccucggccccgcucucccaacaugcaggaccugaagagacgcuucaagcaggcucugucucccaaagucaaagcccccucugcacuggggugaacuaucucagacagaugccucuccuuuuuaauacgcauuugugcagcuaaaagacugggcuucucgcuuuuuaaucacacauucagaguuuauuuuuauaaaaaaauugauuuucaaguacauguguauuucugaaaauucaaacagugauugccuagaagcuggauaaaauuuuguuuuguuuuauuaaaagaacuuuuuuuuuuuuuuuuuuuuuuuuuuuuuuacuguaacugcuggccacuuuuccauuaaaggcaaaauggcaacauugc

SEQ ID NO: 14518 - RNA, 45598 nt, Homo sapiens
auaggauuuauaaguauuuuauuuuucugagaaaugaccaaaaaauuggaaccaguuuuaacaaucucugaaaacuuuaaauucuagacauguuuauuuugaaacacacuuccaaacaagauaaacaacaauauguaagucuacuacacugcagaaguagcuuaaacuugccaagacauccuccuuugcacuuguuuccucaagaguugcuaggucauuuuuuuugccuguggccagcagccucuuuaaaaacaacaaaggaccuaaugucaaagucacucucagguguuugcccugccagcucaggccuucuccgcacaccgcaccccgaaggagcacggaggcccgcagggcuggcuggcccugguuccagccucaccgccgguuggaccgcuuuucguacuuguccuggcugcuccgcuuucguggcggggaguaacuggcggaaccucgagcgcggaagcugugcuuguaaggauggcuucuguguuucuucggguuuucuucuuucugggccuggcucuucgcugguuccuuaucgcccucuuuuuguucauggucuugcucuuuaugagagggcaauguguuuuuaauuguguuaauuagaaaucuuuuauuggugcuagcaagaggacacuucauccugggguggggaggagaaaagaaaaaccaucacaaaucaaaugguuaacuccaaagcuggacccacuaucgugauuaguaccaaagaauccugcucccacagaaucgaguuucugaauuuguuagcuuuccuugcaugccaccuaguguaaacucugaguaccagggaggaaaaaaaaagacgauuggaauucuugagacaagacuggcuggaacacuuuaaaccuuucuuccuuccugggacuaaauuuccuacugaaguucauauguacagguauugaccacacugugaacuaacagaaucauuuaauauuuucuuucaaacuaguaagugcccuauuuuacuguaacuuauuuuggauuaaauuuauugcaucuugcguuuuauuaccagacagugaaaacuguuccuuuccaaggaaacuaaaaaguauauucugcuguauauuaaauacaggagcuaaaggaucuacuauagaauaaaaaaauuguguaaagaauccauaaauaugcaauaaucuuuuacuuaaaaaaauucuuacacuucuauuucaggaugccaggcuaugcucuguggaggagcacuuuacucaaucuccugcccuggugaauuucugugcaggauauauuucaguaccuucaugauucaaguuuaccuaggagaggcugcaaccaaucaaauugcuaauuaaugugcuuagaucuacuuauauacuauguauuaucuuuuucagguguuaauaaaucuuucauuuucaaaaagaugacccuauacaaaugagaacguucauauuucucuuagccuugaggugucugccauaugaugggcuacuuuaggaguaugcugauucucaaaaucauguuauucaggguggcugguauuaaacaaaaacgaauguagaauagccacauuucuauaaaacuuugauuuacagagaaccccaaacaauacuucaaaaucaagccaacaacacuccacauaggaauuguguggacuaguacuguacaggugaaguauaagcagucaggcauuagcauagccucacucacagaggucagaccaucucagaaaaccaaaauggcacugaaucuggaaguaaaaggaagaaaaacaagaaaauaccuccugcugcaaauagguagcucuugagccuacaaggacagagaaaauaucugagaaaaauggucaggccagaaaagugacaaaggaaugaacuagaacaaggagaaacuuagaaaaggacaguggaaaauuagaaaauuuaagaaaaggacaguggagugcaacagaaauagugggaacauucagagguggugacagcucuggaguuuagaagccacagugaaugagacgaagggcaaagaagaaaggcaaaaacaaagaaaaaacaguucugcaaguacgaacuauagagcuucacagagcuuccagaaaagguacaccagcauuacgcugccuuaguagucucaagguaaagacauuucuaccuccugggggcacgcuggcauuaggacauuccugugcgggaagacaggcacgugaugagaggcaagccgaguucuccugcagggucugacaggguacuacugaaugcaggcguugcuuuggugaagacacuugacccacugcaguugcaaacucagcaaugauucagaacaguauuaaacacuggcauguuccaaaacagcauaacacagacagccuacaggaaaaacuacccuccaucacagagaguaaaaagcuuagagggccugucuuuggcaaugguggccuggugcuuacuacaagagcaaaaucuuuuuuauagacaaaugaacuacauaugucucuuggauauauagggcuaggaguagcuggugaaacauguccagcaacagaagaauucuggggucuuuucacugaagugggccaucucaguggugguaaacuggccaguucuucucugcauuaaacaacaaggaaggguacuuuucccagacgugaugguaauccaggaucucagaacaaaaccuuugguaacuacuggugaauuccacucuauuuugcuguuuucaaugucagaucaucuuuaaaaccaaaugcuuccucgaggugagcaaagcccugcuacuaacugcagcauucacgccaagaggcagaggggacugcaccuaucuuccaacugcuaguguaacccacugacucaacauagugacccaaagaguuagccagagaaugagaugguuuuauagaauaauuccacaagaaaacuggcauuuacaucucuuuuaacaucagagaugcaguuuuuuaauguugguuaugccugggauucuauucuagguaaauagccaaggguggccugaggagaucuugguuuacuggggugggguggaggugggguuugaaagucagacaucucccaggcaugccaguacacauuuuagaagugaugacaagugcucauucacacucuacuaauaaauagggcagggcaaugagauacaguaguugcaagcagaugugaagguacauauaguaaaucauuuuauauaaagaaauuccaaaaucugcacagaauagauccaagucuaaggacggcaacaucaaaaccaaugucugagggaaucaguggggagagcuucucuggccuuuaagguagaaauuaauuuugcugaaucucacaguugguuguuucauugcuaagaaaucacacuacaugagacaguggcugggcacacaugcucuggaaucacacuaacagacuggacuuugggcauguuauguaaucucccugcugccucuuagcuguuaaguggggauaauaauggcgacuaucuuaaaggguugcaugcagaucaaaugaauuagaacauguaaaguacucagaacaaugccugacacauaaaggcauuugguuaauuucaguuuugguucacagccuacuauuuaauuagcugugugaucacaagcaaguuacuuaacuccucuuugcauucguuucccccacuugcaaaaugggaauaacagacguaucuaccuuauaaaguuauugugaggauuuaaugagauaauguauaaggcauuuagcaugguaucuggcauacagcaaacugcaacaaauguuaccuacagguccacaauuucuuaucccuaauuccaaaauuuaaaaaccuauuaaaaccaaguuauuuuuaugacaccaaaguuuguuuggcagcaaaacuugaucugaccugacuuugggcuauuuauauagucuuuaucccauuuaauauaaacauucauguuuugcugaagaaaugauaccauguugaacaaguacagaguagugguggggggggugucuaguacaugcuaucugugcuguaauaccuuucuaaaauguaaaaauaucuaaaauuagagacuuauuuggauacaaagguuuuagaaaaaggaugguggacauauauuauuuuacucucucuucaugagaaagaguacacauagcucucaaauaggcuaauacauccggaauuuuugcaagauggcaacucaagauaucccaaagccucaaaucaccugugauaauaaguuaaucaagaacagaguagaaucucuaugaaagaaaagauuaagaaaaaaguaagccaucauuaaaaguuaaugagacauuuuacauaaguuuccaaaaaaaggguuaaaauuuaaaaguuuugguacuuuuaacaugguuagauuuguauuuguagaaguuucagauucccggcuaucucaauucuccauugccaccgggaucaagaggcuacuacauacuaccuuugagcuuaucauuuguauuuccaacuguuccacaaacccucuaggccucuguccucagacguaaaacuaacgguugaaguaggugggugaucucuagagucccuuccaguuuuaggauccucugcucaugcucuguacauuaacucuuuagaaaaguucacucuucucauucaucacauuaggaaauuauuucuuacugccauuucccgccucccccgaucuuccacaguauuugagaugacaugauaaacuggcauuagacacuccaccauuccuggcuuuucucguaucagcuuuaggguaaccaucugagcccugaaauugagcauaagaucauaggccacggcugccugcugugucugcacugucugucacugucuaugcccaaaaggugugcugggggaaggacuggaggaggccacaggacagggcagcugauuuccugucuuagcucugaccuggggggcgacuuucucacccuggcuaguuauuuuuauauuuaguuuauuuuuguuucuagaaaguuaugcuagcucacaugguaagagccagauuuaaggugcuaacaacauaaauggauauaaacccuaaauaucaugagacugguuaaaucugcuuuggaaaguacccaugacacaaugucagauuugagaucuggcauucuauccagguuaaacuuuaaaaggaaagcaauuuccuucacuuugaaaccugugggcucagaggcugugauggaaggguuccacaugccaugggaaaggcugacugcucaagaaucugccacuggagagaugaagacucacuggggcuagaauuauaagcuuuucaucuuuuuugucucucuugcugaaggauagagguaguaguaucuaacuuuccacagauuuagaccugcuaccuuuugcuucuaaaauauuuccugaauaggaccuaucugagagugacacaggaucgccagccaacaggguacguugaagacacaauuaccuugugcuauuccauuaccaauguugccucauuucaucuccacagccgucauccgaaaggaaagaaaagaaaaaagguacagcgccuauccacaucccaagcuaguaagaugcggagccagacuggaagcagggagucuggaaaggggcagagagaguggagcagagaaagacucacugcaguccaaccagauggccaauuaacagagcagucaagaaagaaaccgcaggugaaaagcuugucagcacgcuguggcuaaggcuccucauccaggacaggcaugaagcagcagaugcacacacagugacaggucugcugagaacagcuggccacucaggagcccaggagagucaccaacacagccaaggacaaagguggagagucccuuaaacaugccugacucugagaugugugaagucgaacagguagugggaaauaagaauuauuuuuaugguuagggaauagacaccuuggagucauggaagcaaguuuccaugcagugcacuucaaugcguucuuuuauucuauggacaaauccauucccauacuagcaaauagcguaucuuccauucuguacgugucuuugcacucucauggauguaggucuggaauaaugcaucuagaaagacugaagcagaggccuaacucucccaacucugcaugaaacaaggggaauauuuuuuaucuugaugcugugguugauuacaacucauuuuguuguuuaaugcugccacaacuaccaaaaccacccauggugcuacaguuuauaauuuggcaaucaaaugccucagcauguggccaccugaaaaaugcuuuuuaugguguuauaaucccuauuaguaagcuguuaacccuuaauuacuguguacaacaguccugaggcucacaguggguguucaaugacugucuccaacauuguaccuaaaaguaauaaaaaaucauugacauguguuugucuguauauguauguguguguguguauguguguguauauauauauauauauauacaccugagauaugcaacgcauuaugcuaagcacuguagcaaagauacauaccaagcuaucuguuuaugugucucugucuuuggagacuaccaagaggaacagaagguaggggaagucaaaguucagaagcagauacgugaauaguaacacacugagacaguuugcaaggcuauaauccucggccuccagcucccucagcaacgcaaaucauuuacauagauaugugcucuaacaguaacacauucagggcucucucauucacuuucauaacuggauaugaaaggaaugugggaagcaggggcaguaagcauuggcauuucagcauguuaucagacaauaauccacagagagaagugaugccauacaaggaguguuaagugacagauaggaaagcaaaguuauagucccaucagcaauucgcuagccagggcuuuaggaaaacucuuuggguuucauguucuauacguauaaaggcuuuggaucucuguggccugaaaauauugccaagagccuccuccacgaaucgucugagaugugagcccuugcuccccuccucauugguucuaacacagucaguguggcaugccacacugugaucacuugaugcuuguuucuguauccaccaggggauuaaaaacuuuaaggccaggaaagugagucuucuuuacugcuguccaugaucagccucuuaacauaccugcuggugcccugugaauauuuauauaaauaaauaaacacaugucuggauaaagacuggagaaauuauuuaguuuccaauaaucaacaguugaugacauaaacuggaagaacaagaugggugacuuccuuccauaucucuagauugacucucaauccaaacagaaaagcauaaaaaaaagucauuccccuuaaaacaauuggguuaagagaacucaagaaucauuuucucucaauucaaccuuuaggauuuauuuugccaaaauauaagcuuuuccaaguauaaggcugaaguuccacaggcacuagacucagaaauuauauugggcaguagauaagcuaaagugaaugugaccagaauuaaaacagcuuuguagacaaugaagcugggcaaauuucugaaauuuaugcuuauaaauuccuuuauguugacuaaaaggaagucauaugagccaauauuucagcuucuccuaaagcaucugucaacaacagcuucuaaagagauucuuuugcugaaauacauccaaggaagaauauagcaccaaauggucucuuucuuuauaaaauaaaaaauggcaucccacuugcauuuucuuuagaucagcaaucucucucuggcaacugcucaaccaucuauuucuuauggaauauccaaaaugaaaaaaauaauaccacucacucuaguucuauuuuaaauuuuaaagcaaauaaaaggucuucuagauacuuagaaaaaaacaggccauggccacuagugaacaacagauugcuacucuuuuaagaacuguccaagaaguccacuccacagcgaugggucuugggacucuuguggcugaacaccuggccaggcuaccuaagugcuauuucagugcagaggagcugucugccucuggccgagguguaggauuguucuggauucugcagagcaggcugguaucauucuuuuuaauaaaacaaaagggacuaguaaaauguuuuucaaauuuguguucacuuuagaaucacccggguagcucuuuaaaacuccaaagcccaggccacaccccaaguucauaaucacugauaguggggcacaggcaucaguauuuuuugaagcuuuccaggugauuccaaaugugcagauaaauuugagaacuaaugacuagugguuaaaaguuucucacauacacuuauuuaaauaaauggaaaccaggugaucuuccagaacgagcagaugaagggcaggugcccuuugucccagcacuagugaguagaagcaagccacgguugucauggguccagaccuccuuucauagcccauaucuguuugggugugcugaacugcuggacugaacucuggcuaggaaaaaacaguugccccuggaauaagcaaguacccagagauuccugcuuccagagcaacacagaucaagaaucaaaaugugaacauuaugagagagauagagaaaaaugcagauaaacuuuuuauuuuuaaugaagugaagucuucuaugggauugacuugcucaauuguucagagcagugcuucccaaacuugauugaugagaucuucuaguaagcuuaaaaaacuaacaaacaaacaaaaaaccuguaggaccgaucuuagacuucucuaucagaaugcccuagagugaggcagggaaggagauguguauuuuuauuuuuuauucauuuuuuauuuuuuugagauggagucuugcuccgucgcccaggcuggagugcaguggcgcaaucuuggcucacugcaaccuccgccuccuagguucaagugauucuccugccucagccuccugaguaacugggaacacaggcgccaccaugcccagcugauuuuuuguauuuuaguagagaugggguuucacuguguugcccaggcugcucuugaacuccugagcucgggcaauccaccugccucggccucccaaagugcuaggauuacuggugugagccacagcgccuggcuggagaucuguauuuuuaaaaaccucuccagauuauuuucuaauuaaaaaaacucuguuaaaaagugauaaauagaagacauauuuguuauauauuacuguaacagagccccugguagaggguuacaauggauagcauucccugcuucucaugcuccccuuagugcucacuguuaggaggccuaacuucucacagaccuuuaugcguuacggggucccauggccuucccugaccuggccaauagaggauuacaugcauugauccacaacucagguuuucacauacauaguagauauuuucucacaaggauucauauagugcugaccaauucuuuuuagugacuguaaaauauucaacaguaggauguaccacaguuuauuuaagcauuuuccuaucuauggacauuuggacugcuucccuuuuuuuacuaucaaaaugugcuacaauaauucuguacuuaggucugcacacauuuauuaaguucuaugaaagagggauuacugggagcagagauccuggguaaaggggcacagagaacugugacucaacauuuugcccauggcccugcacagagcaaaccacaccacugccugaagcacaacacugcaccccuuuccacaucccuucaucuccacuggauuacugccucuuucauuucugccaaucuaauggugaaauuuaagugcuauuuaagaggaauauaaauaccuaugcaugcacucccacccccauuagauuauaaauuccaagagagcaggaaucuuugucauucuguuuacagauacaugagugucaaaauagcagagccuagcucugcuaaguacucaauaaauguguuaguauguuuacuuacuggccauuuguaguuuugauauauacacauacacauacacagacacagacacacacagauaugguuuucuuuuuauaaacugauuuguagaagcuuuuucaauacuuagaguauuaguccuuugucuguuauauauggcaaauaauuucaaccagucuaccacuugucuuuucacaaguuaacuuuuuguaugguaucuuuuucuauguagaaguuuacuauuauuaugacaugguugaaucugccauugucucauucauagcuucuagguuuugugccuggcugagggagguuucuaccuuauccuugccaauauuauaaaaauauuauccuguauuuucuccuauaagauucauauuuuguauguuuaguuuuuaauuuucaguauuacagaugaauagucaacuguaucagcaucacuuacuaaauaauccacccuuucuccacuaguaugaacaaugaccuuuuuccacacaguuaguucauacacauaugucggucuccauucuuuuuuuuguuuucuuuccuucuccacucccuuccuuccuccugccucuuucuucccccagucucuauucuugauucucuauucucucacuaaugucuuuagucuuacacgaaucucauacuaauuacuauaaauuuacauacuauuauuauauugagcaugcaauauucucaucucauuccucccaaaaauaucuuagcugaaaaauugcaccuuuauaauggagagaucugguagucaccagcuuuaucaagggcaaccugacauuaaguccuccugaucuguuguaauuaagacguauaaaaacaucaccuguguaauauuccuuccugucaaacaaguuugaccugaaucuaaucaagaaaacauaauaaggcaaauccaguauguggaacauuuuugccuggauccugaaucugcaucccaaacaaaaggcaaccacuauaaaagacauuuuugggauguuagaugaugauaugaaauuauacauuaauuucauugauaugguaauuacaaugugguuaugcaugagaaugucuuugagaucugcaugcugaagaauuuagggcugaaguaucaagaugccuacaauuaauuuucacaugguucagccaagaauuauauguuuguguauuacauguaaauauacuauaccacacaaucauagauaaucaaacaauguccuuuuuucucauuauauuuucuagugggcuauugacuguauaaggaauugauuuugaauguuuaucuugugcuaaaccacuauggguagacauccuaucuucaacaaaugacccuuugucuccuuuuuucuccuccuaguuauuuuccuuguuuugcuguauuugcuugcuggcaccuaucuaaagcagcaguucucaccaugugacccgugaacccugagaguccuccagacucaugaggcaaucuacaaagucaaagcuauuuccauaguuuugauauaauuugcuuuucuccagaagguugacauuugcacugauggugcaaaagcaacaaguaaaacaguggcaagaaacaaggcagugaugaaaaacuguaccaguggucauuguacucuuuaccaccaugcacuuccaguuaaaaauggccaguuuuacuugagaauguccuugaugaagcagugcaaauuauuaauuuuguuaaauuuuuacccuugagcaucagucuuuuuaauaauguauguguauaaacgggacauacauacaaagcacucugguacuugagauuaugauggaggccucaaggaaaaguacuugugugacugaauggcaaagugaacuagcugguuauucagaugugggugggccugucacuucuaggaaaacaacucccaguauucauugccaauauauaacuggagcuuccagaugaaagaaaauuagaauuuuggcaaacugugaacuugacagguucccuugacacuuaaaagacugaucugaugagauuggugaugauauuuacaaaugugauuuuaaaaauauuauauaaugacacgugucaacauuuggaagcuucauaacucagugaaccaauauuuuccagaugaccaaugaugauguuacaaaaucaagaauaaguagaagauccagccaagguacaaggauauuauauaaagggcuuuuacuguaauaggauaggaaaaguacacauuauuaaaaagaauauuacgaaauuacuacuugaaguuacuugcaaaguucugauguaguaucaaagaagaauaucuacagucuucugaaaaaguuauugaaauagagcuaaaaucacgcaauuuacaagugaguaagaaaauaucaaucauaguucuugcucuguaaggagcguucaaggggcuugguuguuucuugccagcucuccagauagacaucauuuauccugacaacuuuaguaucaccuacuggcuuuguuaaacuuucugauauguauuuccuuuugaaaauacauaucuuuguaagguaguauuuucuucacauacuucagccaaaauaacacauuacaauagaucgaauucagaagcagauauaagaacccaggugucuucuauaagccagacaucaaagagguuuccaaaauuacuguacucaaugcauuuuguuuugcaaauauaguuauuuuucuuauaaauguuauuuaucuuaauguauuugauuuauuauuuaaaaaugaauaaauacuuaaaaauugcccagcuuuaauuuuaaacauugguauugauagauauaacccacauaaacaaaagcucuuugggguucucaauaacguaagagugcaaguauccuaagauguuugagaaccacuguuccaagacaauugagauaaccaaguaacaaucccagcaggaauucgugucuuucagacucaugggaaaguguaauuucacauccuagucucccacgggauccaccucuuacaaucuggaguaucuuacuuugccugccaucuuuuauuuacucccuuuucaacaugcuuuuucccuauaccugggaagaagcugcuaguugucccucaauaucugcucuuucuuuuuucuguagucaaagaaccccagauacuuaucugccacgcaacugccuaugaaaaaaaagaugaaauuucuguccuugcagcuagauguagacaucagacuaaauucuggccaaugggguacaugaagaaaugguaaauacaggccgggcacgguggcucacgccugcaauccuagcacuuugggaggccaaggcaggcgaucacuaggucaggaguuccagaccagccuggccaagauggugaaacccgaucucuacuaaaaaaaaauacaaacauuagucaggcaugguggugggcaccuguaaucccagcuacucgggaggcugaggcagagaauugcuugcaccagggaggcagagguugcagugagcugagauccagcgacagagcaagacuccgucucaaaaaaaaaaaaaaaaaaaaaaaaaagaaaugguaaaugcaacuucuggcaaguuuucuuuuuuuuuuuuugagauggagucucacugugucccccaggcuggagugcaguggugugaucucggcuuacuguaaccucccucuugcagguucaagugauucuccugccucagccugaguagcugggauuacagacgugugccagcacaucuggcuaauuuuuguauuuuuaguagagaugggauuucaccauguuggcgaggcuggucucaaacuccugacucaagugauccgcccaccucggccucccaaagugcugggauuauaggcgugagccacagcgcccagucauggcaaguuuucuuaaaggaaaggggugugccuuccuuucugcuaacugaaauguggacucagugucuguuacuauauuagacuauguagaaaagagucauacccuaugauugggagauuuggaaaacuggaaggagccuggguccccaguaacucuguguaacuaccaaccuaaccaguguuauuccuaaagaguacaucaaugcccacacaaaucucaagacagucuggugcacaugguaacuuuccccagggagagcagaacuagcacugauacacuaguucuuuuacuaucagaaaguuuuaugaagccaguaggugguacuaaaguugucaggauaaaugaugucuaucuggagagcuggcaagaaacaaccaauccccuugaacgcuccuuacagagcaagaacuauaauugauauuuucuuacucacuuguaaauugcaugauuuuaacucuaugcugagucuuucuaauagguauuagauuggaccaaugauuacugacagccugaugaagguacagccuuauauccgaaaccaaagcacccugugccuaaauaguuuauacuaaucugacucacaauaguagaggcaccuuauuucuguaaagcacagaggagggcuggaaagaagagcagauuuaacuaauauuuacuaacuaacugcuacaugccaggaaccaugcuggguguuuucauacacauuaucucaccagauuuucacuaucauccucccacuuuucccaugagucuauaagacaauaauuccugcuggcauucuuauuuuuuucaauugucuuauaauagugguucucaaacuuuguggucuuaggguacuuuacacucacacuccuaaaaaugauuguggacaccccaaagagcuuuuguuuauguggguuacaucuauuaauauaaauauucaaaauuaaagcugagcauuuuuuucaguauucacuuuaaaauaauauaucuauuauuuacuagguauuuuacugaagcuaagaugauuacacuugauagauacagguugacucacauuggauuauuucauuauauaauuucauccauaaauauaucagaauacauuucuaaaagauaauggcuuuuaaaaauuaaaauaacagcaauacuaucacaccuaaaaaaucaacaucaguuccuuaauaucaucaaauacccucaauuguugaauaacuuuuuacaguuaguuuggauaaagacacaaacaagguacccauuuuauuugauguuccucaaaucuauuaauucacagcauacucuucuuucuuuucuccuugcaauucauuuguuaaagaaacuggguucuuuguccuguagcauuucucacauuuuggauuuuugugauugcagccuuauggugucauuuaacauguuucucugcccucuguauuucuugcaaacuaguaguucuaacuagagacuugaucagauucagguucaauuuuuugacaaggaugccccagagguggugguuugcucuucuugcaucuuucugugguauaaggguuaaugaauguguugaaacucaaaugaugauaauauuauucuauaauccuucuaauauauuaguuacaauucuucuguaaaguuuucuuucaucaauuaauuggugacuuugaaguauaauuuguacagggaacaggguaaaugcuuacuucuuccuauuuaucaguuuugugaauagugauuuggugcucuagcauccuauaaaagggacuaccagguuuguuauuaugauuaucauuaugaccuuacagauuuuaacauauuuuagguguuuuaaucauuuauuuguuuuuuaaaucaaauuauaucaucuuugacuagugggagaccuuucaaguggguccugagucuuucugaaaugaguacauuggucuuugacaguuucuuugcuuucuggugugacaagauuuuccagcuucucuuauacauuuccugcccauguagucaagaguuugguuuggcccaaagagagggcuggccuuugccuuagcuuccagaaaguaaugucauagaaaugucuuuguuuaggguggagcuggucacaccuaagagucuuagagugggagcuggccaugccagagagacuaacaugugacuuagggugagagcuuuggguuacgugguaucagucaaccuggaaacugagaucagucauguaauccauccauccauccauccauccaucaaucaaaccuauguaaugaaaccucaauaaaaacuuugaacacugaggcucaggugagcuuccuugcuuggcaauauuccaugccuauuaucacacacugaugcugggaggguagcauaucaugacuucaaaccuauuuaaugaaaccgcaauaaaaacuuugaaugcugagccgcagaugagcuuccuugcuuggcaauauuccaugcuuauuaucacacacugaugcugggaggguagcauguccucuucacggagcagaggauaacaguggcuuuaaucuuugugucuuauuuuggcugauuuuaguuuguaucuugucccuguaauaagcuguaaccacaaguauaacagauuucaguuaauugugugaguucuuccagugaauuauugaagcuaagcgugguaguuugggggaacccucugaacuugugguugguaauaagaaguaaggauagucuuggggacugugaccucuaauuuugcaguuuggcuaacucugggcacugcuucaggucugcaaucaguucuuacucuaaggauuccgcucuccuuucagugagaaaugguauuuacauaacacaguuuuggcaccggggugcucacugcuacuggguggguggucauuguuucuagaccuuuucugugaagagaacuagaaaaagcuuuucucucucccucucuuuuuuaagagaaaaucuagcacaaccucauacugauguuuccaauucaaauuuaggauuauagguagguuuuuauuucuuugauuuuauauuuguagcucuuuaaaauuuucauguuaaaucuugguauuuauauauagaaaguauugcuuguuuuauccuacuauauaauauuuucagaauagcaauaccaauauuauuacuaacaauaugaugacugaaaacaauuucuuuguaguuauuuuuuaucuuuuggaaauauagucaaauuccagaucaccugaaauaguuucuuuccauguagcuaagccauccacucaaugguuuaucagguccauguuuuauuuugcuugauuuuuagguauuaucuuuuccauuuuaauuuuugucuuggaauuuaggugaacuaugugcaugguucuaaaugucaaaauuacaaaaugagcuauguucagaaguuuagcuucuacucuuuucacauuuuuacauuuuacucuuuuuaaugacccuccuuauuccauugcaguacguuuuuaacuguagauauaaauuccagaaucaacaaauucaucaaaugcaaauggcaucacuaaaguagugccuagaaggguguuuuuuuugguuuguuuuguagagaugaagucucacuauguugcccaagcuauucucaaacucuugggcucaaacaauacucccaccuuggccucccaaagugcugggaugacaggcauaagccauugugcccagcccauauuauuaaguuuuaacaagcucuauuuuguacauaaucugcaaagguaaucuuuaauucuacauggcugaauugucacauaaucaaaaugcuuacaguuaaaauuaauuuccuaaaauaaauuuuaauuuacuaaggacuauaaguaaacuagaaauucuuaaacaaugaacaccaacauaauauuacucuugcacaggugacuuugcgcacaguaguaucuaaauaccucuuggagacuugugaacuaaagggacaaugaaccuauacugcguauccuccauaggcgccugcugcccauuucuucauguuauuagaguuucucaacauucaguucucagcagugucuuacucuacacuugucucugagagauuuccucugcuuccaugguuucccauuuccucuauaugcuaaagauuuacauauuuauaucuccagcuaagaauuuuuucuuaaguuuuaaggaagauuacucaaagaacuuaccaacccaugggucccauuguuucagcucuaguuuucccacguuuugccuccuuaagcaguucuucuauugcuuuccugauaagaaaaaggaaaagauuugagaggcagucacccuacuaaguucugaaaaucaauucauuccagguccaugaucuugggaaaggaacuaacuuuugaagcaugauugcuggggcaaauuuuuuuuuaaaugguugacaauuuugaacacauaaauuaaaaagaaacuauuaauauaaagagaagcaacauugaagagaaaaaaauuacaaacuggaaaaauauuuuugauaugagacaguuaaaucauauauccuuaauauaagaauuaucuuuucuuauuaauuugaauaaccaaaagacaugaacagccaaauauguauauaucuauauuuuuucaaauucacuguuauucaaagaaauaccagugaacucaacaaggauaaauguuucugcccauuaguuagugaggggguagagaaauggauaacuucuucucuacuaauggggacugaagcugauauuacauuucuggaggacaauccagcaacauaauaaagaaccuuaagaauaguauauaccaguugaucuaaaaauuuuuuacuuuguccuaugaaaauauucaaauaaguauggaaaaguauauguacaaggauauucaaacuacuuguuaacaauuaaagaaaaaacagaaaacuuaaauauuuacugauaaaggauugguuaaauaaaucauaacauauccacauauguggaagauuaggcagucauuaaaaaugaagacaaaugaauuuuuggcacaggacacucauaacauauucaguauauaaagcugguacaaaagaauauguguagaauaaccuuaauuucaaauuuauuuacauauauauuacauagaaaaacauuuggagacggcuaggugugguggcuuaugccuguaaucccaguacuuugggagggugaggugagaggaucaccugaagccaggaguuugagaccagccugggcaacauagcaagaccuggucucuaaaaaaaauaaaaauaauaauaauaaaaaaauuuggagggauguuaucaaaacaguaagaugaguuuuaaggugauuuuuucuguuugcauugcugcauuuucuauuuuuucuacaaugaacauguauuauuuguguaauuuuugaagagguuaaaaaaacagaaaacauauuuaucaaccauauucugagacuuuacuauguguaagauacugugcaaggugcuauggguagcaacauaggaagaugaucgucccugacuugaauaugauguaucaauaacaaaguuaagaaaaaauaaaguuaagaaaaagagagguauaaacaaauauaguccaaaacaaauauaguccaaagacagaacuauaaaucuaaucaugaauuuuugaagcuggauaauuauauagagucuauauuaaaauguuaugacacuauuauaaugcuaccauauacuauauaaucuucaaaugauauuaacauucuguuuacaagaauguuuuauuucauguugauuuuuaucaaaguaaagcaugcacauaguuuaaaaagacaaauauuauuuaaaagauuuuaaauacaacagucuucuaaauuauccugcccuacccaccaaagaaaacaauuucaacuuuuuucaucuguuucucguuauuuaccuccauauuccuaauacuaugcuuucaaacuauuucaccaccucuuaaucuucaaaaauacaucugcuuauuuuuguguaacucauuuuaaaauaaacucuuauugagaucuuuaaaagaugucuuuucaguuaacucagcagcuugacauuuucugauccuucuugggaaggcccacugcuacagaucaaugaaaaacuaaagcgcuugccuaucuacugacauguugacucccucaaucacaaguuucgcagcccaaccucuuauggaaucacaaagagguaaguucaucugaugaccacauaugcugcuucuuccagcucuuuagaauaaugauauggccugcugaaaugaucuggggacuuugucucuuacaguucaagcaaaauuuauccuaauaagguccaaaacagauuguuuuucacccuuauagauuuaaguaaaaaaauuaaaggguauaaauauuccaaauaugccucuuccuuucccauaaauuagugugguaguuuuaaaauaaaaagauaaaucauaccuagauccaccuaugugcucuccuucugucaaaagaaaugguuaaaaauaaucaggaaaacaacuuuuuggggcaguuccccaauuaugaacaaaauauguaucaguuacaaauaaacuagaauguguuuucccauaaaaacuauguuaaaauguuugccuagcuuucuggaccagacuauagaaacuuauuugagucagaauccagcugaaaugcuauacaucugcagaagauacucaguaaagauucuugcagagacccugaaggcauauucuaggugcuuucaagagcuugaaguuugacagugacucuucuuuaguuucgauucuacuuaaaacugucucuagcacuguuauuaauuuuaccuggcacgcuuaaggaugccuucugguuuacgaguacaaagagaaaagaagauauauguaugagaaagacugccugcggugaaacaaauucaccaaggauggaggaccauaaaaggaggaguagauacugggugggagggcacucagucagcuugucuaccguguucccacugguaaagggggcuuagcugcuguucacagccaaaguggugcagcgugacccauucccaugguucggaucuacccaaguuagguaucugcaauugguuuaacaacaacuaaugaagauauagagcuuuaaguauaccaaguacuauucuauauaaccaugauaacauaguuauuaccaccaauacagauguggaaagugauauucagagacaucgacuaacuugcccaaaguaacacugcuaacgaucaaggagaagggcaaugaggaagaggaacaaagcaaacaaaacccaaccucuguuuuuaaggcuagguaucaucugauccuucuauuagacuaucuccuccacaaauaucugcgcagcaaauccuggagaaauuguuuaucauuaaaaggcaaaaaauaaacuaaauggggaaaaaaaaggccuaacagagugccacuacugcauucauucaaagagaacugggggauaggcugauacuggagaggcggaaggaaugaaggaggacugaucacuauuuuguccuaagaauguugagcauucgcuacuucccacccaaaagucuccugcauaagcucccucuacagagcuuuacuuccaaagaagaaaacaauucuuagcaaucaaguaucccaaccuuaaaacacuauaacuaccuucaaaauuaaggggagaaagucagcaacuuccccauuacuguagccucuguuguuuccucuagaaaucucauuaaugaauuauuggguaaggaaauuauaaauccaguuucuauucuacaugaucacaggggcaaaauaacuuaaauuaucaaagauuaugaaacauuaacaugcaugaaacaagauaguuuuuaaugaggugaugaaagaaguauaaacuguaauuaaaauacaggaaaagcaaauaggagaauauauaagaacuaaguauauacagaacuugaacaauuaaaaaauuauucagacauaaacuuaguucuugguaugcuaguuuuuacacuugguucuuuucaauaucuugaagguuucuuuguaaaacuaauuaauuauauuagaauacuaaguuccauggagacccaagagagcugagucauuaagcagacgguuuucugggcacaggaacaaaccacaaucaauuuucaaugauccauguguguauuaucuccagccaauuuuccauacuagcacagcuuccucaggccugccuguucacuccauuagccagcugguacaugcuuaaggaaugucaacugaucauaauagcagcuuaaauaaaacccaaguaggaaugcaaaucugguacaaaaucaucuuaaaauccaaagucaaacaaauuaguuuugaguuaucugggucuguuucuuuuuaaucacuuuaaucaacugaggguuaacuguuccaguguacagaagggguagcaagaaauugaaggcaacugaaauaaagcaccagaaauugagaggaaaauuaaauaauaaaguaggaaaacaggaauuuuaaaggaauaaaaucagagaagcuaaaucucaaauaacugcucaaaaaugauggagucagccagagggaacuauaggccucuuccugugauggugaaggaaagcuaggaacacaaggcugaacguuagaagcuuuccucauuugugucucucucagucuuuaaaagucaccuuugaucagcuagcuguauaguacaguaucugucacaugauggacagaaaaacagguucaaaaaaggcaauacauugcuuaauaagacuacucucuucuugauguguucaaacaagcaugacuuggugacaagaauacagacuucuuagaaaauuggcagaaaugaguacagcaucauuugcugcuguugacugggaaguuaucuaaaaggcccaacacauuaucagugcugaaggcaaacauguuuauacuuguggagucguccacauacguguaaaagaaaccuuacuauggcaaucuaaauuucuucccauaauggaaugauaaagcuuagagagaaaaauggaacuaucuacucgaucuucaguaaaguuuugaugucaggucauugauuaaaaaaauauagacagaugaucagaucacucugaacaucugcaaaccacugcuuauagguucacacugccaguaguaacuagugguuuaguagucauagggaucuguagaaaccacaggacaaaguuuggguucuuuaugacuuaguguuuugacuacagacacaggcaaaaauucagaaauauccuuauuuaauuucaguaaaauaucagauugucuggggucauguaucagcucuaaagaaagguacaaaaauucaaauugugaaaagcguuuuuaaagacaagguaaaacucaauaggaacacugagguuauuugggaaaugaaaagacuuauucacagacauaaacuaaaggcacaauaaauuaaucugcacauuuuguuaaauucagcuaaucuacauuacgcacuugcuaaauacaagguacugugauuuauacggugaauuaggcucuucccugaagaggcuauuagggccugcauauaaaauaaagagccauauauguacuuuaaaaacaaauacuggauuaucuaggagaaugugaggagggagcuccaauauucauuuauaaaauaacaaacagaaagucaugagaaaaggugcugaauuuuuaagaagaacuuaugcugguaaaagacuggaaggugauggaggaacaugaguuugaaaggaaaauuaaugagauccuuuguugauuucaugcccaacaugaacuaaagagauagaugaaagugguauuuuaagcagugguggaaaaauaagacaaagauacugcagauugcuuuuugcaaugaugauaauaauuacuucacaggguuguuaugaggauaaaauaaaauauuugauuuggauccaaguguucuguauuuuauaggaagcagaagaaauaugauagcuauuuuuuuacacuccuaaaggucucggaacuugucuuuuucaaccuaguuuucucuaugccuggcacauacaugguuaaguuaagaucuggggaauaaauggguucuggguaugugugggacaugauacaaaugcaagguuuuaaaaauaaaaauacugcaucuguagacagaauagaugaugaugggugagauggaagaagaggaaagacaaaggaggugagaagaagauaaaagaaaaaaauauaguaugucacuggguaaauaaauguaaugaaaaaaaugaagagcuacagguuccugagggagcaauccccuguaguggccaaacaaacaggggcacaacagcaacacguauccuuagugucaucaaacauuagggcagacugggaaaccacagacacugaccaaggacacagaaugaggcagagcuggaauauuuccugucaggauugaggacuuugaucuacuagggcugucugaaaaucucagcaagguuucagaucuggaaaacacuuuucccuucagugagcuacugaucagagauaaauggccuuuguuuagcuuccaauauuauucuuuugcuucauuguauauauauaccuguuaacauccucugaacuccauuucuuaguggagaugcuaauuguguuuugagaugacagcgccuaguguuggaguggagggugccacuacagagagggugagaugucacaguggggccacuggccugucucugcaaggccuugccacacagaugcucugugggauaaccacaucuagggccuuggcucugacaguccagagacauaacauggcuuagacacucccaccaacugccaacacuacauuugcuguuacaugcacgggggagcuuugcccagguuaugcccucuguccaaaucacucuccacucacaaccuuuacaccagacacucagcucucacauuaccucuccaccaagccuuucccgaucucccuguuugcuccacaucaauagauguaacugcuccuuucuuauaggcccacugaggggcacaugaaguccccauacaauauuuccaaacauguaaaaguuauaaaauaagcuaaaaauauuuaaauauauuucuucuuccuaucuugacaaauaugcuuucaucauaacaaaauaaaaaauauuuucagccauuuuuugaaauggcugaauauuuggauuaauauuaauauuuggauuaaugguaauauuuggauuaauguggaaagacagaaauauuucguauauauuccaugaaacuuauuuucuugcacugauuuuaauaaagucccuaauuauauuguuauaaucaagauuuucauauaaauuaaaagugauuucauuccuugcaaauuauaggaaaaagagccuuguaaauacuuugacuuggggcuuaucuagaaacaccagauguguaggaauuaauauggaaguuuagcauauggcccaauugcugucaagcaaacgcuaagagagaauugugaauuuaggcauuugauauuucacaugagaugugaaaguaugguuccaggcauuuguauugaaaaugcagugccccuuuuuuuguaagcacaagaguguacaaucggcccucuguaucuguggauucaaccaaacauggauugaaaauuuuuuuuaaagaagcaaaaaaauaacaauacaaugaaaauaacacaaauaaaaaccaauacggaauaagagcuauuuacuuagaauuuacauuguacuagguaagacuagauuauaccuaguacaauguaauauuaguaauaauagauuacuuagguuacaggcaaucuagacaugauuuaaaguauacaggaagaggcauguagguuauaugcaaauacuaugccauuuuauaucagguuuugguauccauggggguccuggaagcaaucccccagggauacugagggaagguuauauguucuauaaaccauaauagucuaaaaguauuaaaaaacaaaauguaaaauaauaaaaugaucuaugaaucagugucaaauuucuuguauguuccacauagaccuacacauauacaaauauaagaguaauaugauuuaagauugcaaaauguuacucaguuuccaggugcagcuguuucaaguacgguauuaaaucaugaguaucuucagagucaugaacugaaauaauaugacaagcaagaaaauggaagcuuagcacuagugggaaacaauauuuucuuagugaaggaucuauugcauucaugccaagaugaaggauuugacaaguuaaugucuuuuuuaacuuuucugcaguucaaaaccuuuccauacucuaaauuaguguccacuggaaagucaacauugguacaaucuucacauauuuaaacaguuuccuuucauucaagggugcaggucaaaacaugaguaggguguuuccuggguuaugaauugcacugagcacuggaucuccacugacagaggcaucuauauauuugugauauauagggcugcucuccucauccaggguccaggcaauucuccuuugaauacaguuauaauaugcauuuaauaugcaccacugggacaugaugaaaaauuauaaugguaacaguacuuauguaccauguaccuuacagcuaauccucacaacucuauguagcuaccguuucauagauaaggaaauaaggagaauauaaggaaaagucaagaaacuuaccuaaggccacaacagccgauaaaugauacggccugggaugugaacccaggcaaucugacucuaggccccaggaucuuaauccuuacacuacggcucuauuacaaaacaugauccuaguccucaagaagcucagucuagugagaggggcaaggagagcagcaauauuuaaugguacuuaucaugacaagaacugcucuggcaaagacaaaacucaaguccccucaccuggacuucgacauucucaaaucugcaacuauccauuuauagauggccucugagaguggauuacuauuacagagagaucacuucuucaguuaaaauguggguuaauucuuaacguuuagcucccagggaaaacuuauuucucaguucauaagacaccuacuucacuguagggucuacugaccucauuuucaaagcagcaaguauuuuuacaaauauuuauucuuaaauccugauacagaaaauacagugauuguuuuucaauucauauuauaaaaccugaguaaaugugcuaugguaaauuuuuauauaagcuaugaagaaaggccccucuuacugaaaauaacuuugugggguggugaugauaggguuacuuaggaaauguuaaacucugaauagaaaagcccauggacaauacaauaacaggaagagcagaucuguugauaggucaaauguuagguuuaaaaauauuacagucuaugcucuucugaaauauuaguuaggggaaaaauccacacagagaauauaaggucaaauaauuauugaguucuuuuacucaauaaaauguauuuuguuaucucuuuaagagaacagaugcuuuggagaacaaaacugaugaaaacaaaacugcaaaagaaaaagggauuuaaagucuagaaagauggguguggaagggagccaauacccaagcaaagaaaagcuaauauggcagcugcuugaauuuaguaaaggauaggaaaaauggcagaagaccaaaaagcagaaauaaaaaauaaaauucagacucucaccaaauagcuguucaaaauguagacaggaaaaaaauauugcagaauuuguacaaaagaaaacauuacaacauaagccucuaaaguuugccucuacagcuuuuuuuuaaugagggagaaguuugguagguguacuguuuuugauaaacacaccacauaccagaaaaaucaccucaccaaaagcuuugucuguaaaucacucucuuaauccuaaaagagcuuuauguuauacaaaucaucugcaguucucuguagacuguccuaaacaauaccucagagcucuuggaucucagccccgaggauggccuauucagcagaaagucuggucagccugcugaagcuauuuucuucagcgugucaaggcuacaguaaucugcuagaaaacaagcuguccaccccuuguagauuucagucucugauucagcaaaugauuauaaauuauacucaaagcuaaaagccaaagaauagggaaaaaaagaacauaaaagaaaguucuagaauguguaggauuuuggcaucucaucauuucaugcucuuuaaaaaguguuuucauuuaaaaauacacauagaaauuagucucuugaaaaugcuauuucaagauaaauaauuuaccugucaucaucugaauaaagccauuuuuaaccccaggaagaaaacauguguauacuucuaauucuuagaaaucuagcaauacacaaugagaugggaagaagagaaagccugcacuccacagacaacaucacagguucagugacaguccugugaccguuaagugcaaggcacaguccugccuuagaggcaagagaugaugaagggccagugaaauagaggguguagcccacucuagagcaacugugcuucccuccugcuguggggacugccagaccaggccucaucuugaucaccaggcauuuucugucuuucacacucuaggcaucaaacauggcuuugaggcauaugguaguuuccucuacacacuggcagggagagauuuugaaaaaauaguacauauauacguagacaauauuuucuacaucaauaauuaacuacaaaaauauacuauacaaaaaaaaaauuuaugccagugugguggcacaugcuuguagucccagcuacucaggaggcugaugggggaggauggcuugaucucaaaaguuugaggccagccugggcaacacagcaagacccuaucucuaaaaaaaaaaaauuuuuuuuaauguauuaaaacccaucaguaaauucuuaacucuuuaaacccuacaccgucaaguuucaaguuguuuuucuggugccaauuuauacggcaaugaaauuaaguaggacaagguaauuuuaaaucccauuuuacaauuuuaaaaacuuaguuaauauauauacaaguguuuugggaaaauuccauauuuauauaaaggaguaguuaauagaguuaagcgcuuaaacauacacauaaaccuaacuuugagagcagcaucccuuuaaggaaaauguuuauaaaaguucaaagugaugaacuuagaugguccacugaacaagucagccaaaagugcacaacugugcaaauaagguuuuauauugacauucaaagcucccagagaugcuuccuucuuagcuggccaaaguuguagagcucugguacaaugcaaacacauucuuacagaugcugaauucaacagcacaggaggaaccacuagaaaggcugcagagauuaacugaaaggaaggaaggaagcagcucauggagacuaaucucuauaguauggagaaaaacccaaggcauggaaaauucuauuacgauuaauccaaccuuuaccuuuauaucauaacacauaucauaccaacaacacaucagcugccaaaagaaagaaaccacagagaguaauacaaucgaugauucuggcaucagaaaccagcugcaagacaaccaaaacccagcaaaccacacuuuaucauucagagacuuauaaauuauaugugaugauauaacuaagaagggaaaugugaaagcauguucuagagccaauguuuaacuaugcauuguuuuaaaaaauaucacaaacuuaaacacaaucuuuucuugucccugaauuaaaacuauacuuuaaguagccguacauauuaggaccaucucauccacugaaacauaaacaauccuuagggauggaacagcagcugcagcuuaauuggauggagcaaugcuaacaaagaguuuagaacuaaguuaaaaauagaauagguacccaauugagaccgcaggggaaaauucugagagauagaucaugcugauuauccaaacagcauaauuuggcuuccucccaaagucuaauacacucuuacgcuuaccaagaaaggggcgcugcauuuucaguacaaaugcuugggaccauacuuucacaucucauuugaaauauuagaccccuaaauuuacaauucucucuuagcguuugcuugauagaaaucgggacauacacuauauuaauuccugaacgcccaguguuuuuagaaaaguuucaaggaucuuuucacuauaacuuucauuuuaauuaccugaaccaaaauguuuggguaaagauccauuaaauacaaucuauauuauuaaaaaauguaagggaaaaguuucucaaauguuagaguuagaggccaucugguuuaacuuugucauauaaaaccgaggaaauuaugguuuagagaaguuaacaacuugccuaacacuaaauaauaucugguuuuugaaaauuuaacucaaaauuaccaauauuuaagccuagauggcauguauggucacccuagggagaaacgaugaggagacagauuauaauuauaauauuuuagcccaggaucauuaccuuuagaggacaacacuuuaaguaccaacacuaacacuaucccaaugcuaugugaugugucuaugauuauugugaucugcaauacacaagcuucagagcagaauuucuuacccgaaaaauccagacugaauagacuuacucaguaacuguucuaucuuuauauagucccuaaaacaccucucagugcuuuuagaagacaaauuaugcaguucuuccuuuacaguuuuaaaucuaggacaccaucaaguaaccuuaagagaauaagaaagcagccacaauauaguggugagaaaaugagucccaguuccgcaccuacuagcucugugauccugugauauucaaggucacaaagcuaugcgauuaaaaugaagauauuucuacuauccuuucagaauucuuagggggauuaaauacaauuuauauauauauauguguguauguauauauauauauauauauauauauauauaguuacuuuguaacuauagagcacugaacaaaucuauuaagaauuuuuaaaaaaauaaucauuuuauaguuauaauuuuaauaguaaucauagauagacuauugauaguuauguauguuaacuaaaauaucaugugcacagcaauuuacugaauaauauauauuaccucaccaagucugagaugaacccuugaaguuccuguuucccuuuuauuguuuaggcaaccaaggcuuagggaggcugccuugucugaggucaaccaguaaggggaacagcugacucuaccccagagcuuucugacuucauauccagaguccugucaaauaacacauacccuuauuucauucaauccgugaauaaaaguuucuauauuuugaggaugaucaaguacugcuuuagcacaauauagaugaaaaaguuaaaaugaacauauuuaaagauaauacuaauaacguuuaauaauaugaaaaaugguguuuucagaaaccaaguauugucaguaaaccuuuauuuggguucuuaacaaguuacucucucauucauuugauucuuuucauguuuaagauuuacaaagaacagccccuauugccagcauguuucagcuaggccaacaauuuugucucuuaaacugaacuccuuggaggauaugcucuggcaaagcuguuaucuuuaugaguccaaggcagguaacaucgacaacaucacgcccauuaaaagcuaaguuuggccaggcauaguggcucaugacuaaucccagcacuuugagaggccaaggcagguggauagguugagcucaggaguucgagaccaggcugggcaacaugcaaaaccccaucucuacaaaaaauacaaaaauuagccaggcuugguggcuugaaccuauggucccagcuacuugggaggcugaggugggaggacugcuugagcccaggaggucaaggcugcagugagucaagaucaccccacugcacuccagccugggugacagagugagaccaugugccaaaaaaaaaaaaaaaaaagcagagucuauggagucaggccaucuuucaguuccuaucuaauuacuagucauauaaccuuaggcugguuaccuaacuuccccaggucucaguugccuuuucuauaaaggggaaaagacacuaucuaccuugaaggaggauuaaacuuguuuuccuaccuggugaggcaaaucagucuucuuacuuuacagucacaguuacgugucuguuaggcugucugcuuuuggccaggaguaagucuaguuggcuuccucauguucuggcuuguucugaucuuucauugcucuccgauggggaccaacuuauuagaacaaggaaauaggaagggaauccucugcuugcuugcuacaagucugggcagcagacagugacacaccuguaagcuaacacuucuaaagacagacauuuucagcacaacaguuccuaaucauaaaccccuagaauccuuuauguuuuccaaccauuuaaggacaaaguacaaucuuugccauauaaacaaacuaaucauaaguuucuaaucauaagccccuggaaucccuaauauuuuccauccauuuaaggacaaacugcagucuuugccauguaaacaaaccaauaaacaaaaagcagaaauaaaacuguagaaucaagucuagaaggcuucaauuacaaggucugauaaagaauauaaauccaacucauuuacuuugacaagaauaugaugaugguacucucuuacuccucaucuucagggaaugaagagauaaaugaagcuuauauuaauuuuauauuaccaauuuuaaucacuuuuggaaacaacaacagcaacacaaaccccuuguuaaguauuccaagcuccgggacuuauguuuaaguaugcagaacaaagcagcaacucaggaucugaaauaauguuagaugagggaucgcaauguugggugauccuucacuugaaaucugaauuccaaugaaaauuuauucuuagaucccauguaacuuauuaacaguuguagacaaaugcucaugaggacccaagggaaaagugcaagagucuguucaauuuauuguggagcaaacaugauaaaaauggcacaacagacaucaaauuauugaaugcuuuaagucuuuguuuuguccuucaagugcuucaggucaccuaaauaaagacuaggauuucuggcaauuuuccauggaagugaaggaaaguccauuucacaaaguaagggcaaaauaaaacuuaagcaauccuacauccuuucaccccauuagauuuuuuugaaauauuaucggucugggaauuccccaaauccaaaaucacacaguagguauauggguagaacaggugcucacaaaaccaacauugucggccuuggcgggggucaguucucauuaaugugagaugcguugcagucaaauuuggccuugcagauacaaagcccugccuucuuauguguguauaaacaacaugcccaauucuucuuagcucaggugaccccucuggaaucaucuaccuggcaauaucuaucagaucugcuugguuccuacugcauaggcuacuccucuggcacucuaucuuugccugcucuggucacccuuugccuaaaugaaccucuaggucugacuccuccuggacaggcccagucucuugccaacuacaugugacaaacuauggaguugaagacacacaaccacaaauuugugguucucaauucgaagcuuauagaauaguuauuucccuuuuuaaauucaaguucagcucuugggguauuuaauguaaaaacaauacagagucaaucugcuauucauucauuugauaaacauuuuuugaacaccugcuaugagccaggcauuguuccagggguuguggauacaucagugaacauuaaaacaaaaaucucugcucucacagagcuuauguuacaguguguguguuugagggguagagggaaaggcaauauauaaugaauauaauaaaaagguaaauuauauaucucauauguuagaagauaagugcuauagaaaaaauacaagguaggagugcuggggggcggggggugcugcaauuuuaaugagguaaaagaguuacaagaaaugacaccuauccuucaguucuuuacuacacagcucuuuggucuagucggauugcaaacucugugaagguaggcaugaaaugagauucgucuuugcuuucuugguaccuggaaaacaaauggaccuuaaauagcugcuggaaaaacaaaugcaugcauucuguuauuuuuccaaagcaaugcuauuuguaguaaauggcauagauuuacgagacagcugguuaggaaaugaguguacuauucggcauugaaaaaacagcauaccuuggaaucaaauccuuucaauuccacuucaugguacucaaaacuacaauccuaccacuuuuucccuccuagaguucuguggggauaagaucccaaggaaaauucauaucacucucccauacugcucuugcaaaguaaaaauauccaucaaucaacuucaagugggagauauucuaccuuuuuaaaccaauagacaagacaacagaugaggcaugggaucaagguggugaagauaguaguguuagaggcucuugaggacacagagaagacaaaaaugaaacagaauauaaagcauaaccaccuuuaucaaggcucucuaugaugcuuacuccugccuccccucagcuccuccucccacugaagccacaggauaggcaugguuccuugucccacucaauaauuuuuugucuucuugaagcuuguuacugugguggcuuucugaguugcaaaugucagcugauaaguguacaaaauaaugucauuauaaaucaucaguccuucuuccuguugugguacucauacucugacacugguauguaaucaugcacauuauucauugacuuucugaagaaacauuaaugaaagccuacugugugccugacccaguuuuaagugcuugggguucagaagcgaacaaggacaaagcccuugccgccaaggagauauuuuucaaguggaguuagacaauaaauagauaaauauauaauauaaugucaguugacaaugaguacuaugaaggaauauagcaagguaaaggaauagagagugauggagguuuguaugugggugugcaugccacuuuagagaaggcggauggguaagcagccgcuaagauggugccaaggauccccaccuccugguauucagacccucauguacucgcucucaagugugggcuggacuuacugacucaugucuaaccaacagaauagagcagaggcaauggaaugccacuucugagaguagggcauaaaaagacuggcuucugucuuggguucucucuaacucuguuuuccuggcucuggcaggaagccagcugccauggcauguagcagccccauaugagugagcuugugggcaaaucgucucccaugcaauccucaagagugcagccuggaugacaucuugacuacagccuugucagagacccugagucaaaaucacccagcuaagcuccacccagauucuugacccacagaaacugagauguauuuguugcuuucagccacuaaguuuugggauaaucuauuacgcagcaauggacuaauacccagucaaggauggucucucugagcaaacgacuuuggaaauggacaggccaugugaagauuuaggggaagagagguucgggaaguaaagggcaagugccaaggcccugaaauggcaauguuaggcuuauaugcauaaaagugagaaggccagcguggcagagucacaggugaugcuuuggguagacagcagggugggggaggcgggcagcucaugcaagccagccaggagggcuccuauggauaacaugacacaaccuguacuaugaagaccauaaguuuaacucccacuaauugacuugaacaacaaccauauauaucaauagcaauagcuaauguuugaguauuuaaguguacuagaaauugugcuaaguguuuuauuucauuuauuucucacaauagcccuaugaaguagguguuacuaucagccuaauuuuauagguaugaaacugaggcucagaaagguuacaucacuugcccacauucauaagauaggaaguguggagccaacaggcccucugacuucagagucccuacccuucgccucuacacaacacugccuugaaagaggucagcagagaaagagaaagucucucccacccaugaaaaaaacaaaaaacaaaaauuguaaccccaagcuguuguuuaagccaacuaguucaaucucuguguaauuagaugcuccaggcuguuggauuuucucuuggaguccuuuuaauaaaauuggugggggcauuauucauaauuuuuuugagguuugacuccagucaggaagguaaaacuuagaaaagcaccaagguagcuuuuguuuuugagauaugcuaagugccuugcauaaugaacagggaauauacugagaaacaguacuagauaaaaaaaaucaggcuggcuauuccagcacuuugggagccggaggcgggcggaucacgaggucaggaguucaagaccagccuguccaauauggugaaaccccgucucuacuaaaaaauacaaaaauuagccgggccugguggcgggugccuguagucccagcuacacaggaggcugaggcagaagaaucucuugaacccaggaggcggagguugcagugagccaagaucgcgccacugcacuccagccugggcaacagagugagacuccaucucaaaaauaaauaaauaaauaaauaaauaaagucuuuuuaaugcaguuuuuacaaucaacugaccuagauugagcccuggcuaccuaccaauaguccagauaccuggcaccaagccagguacccaucugcuacagaacuugcuuuuccuucugcuuaaccuuuaucuuaaagcuuaaggaugauuacgaauguuccaucagaaucuuaauuucuuuuuaaaaagaggagaaacacaauuugucugcgacuuuucucuauauccuauuaauaagaaugcuauuuuaaaguauuuuucuuaaaagcuauggguuuaacagacugauaaccuuccauacagggguccucaaaucauauuacagacugaagaaaacaaaaaaauacacaggcuacuaagauuuuuuguuucaaaguuuucacaugaaggaauauaaaccaacccagcuugcucaacaucaaugauauuacaauaauaacauuaauagcuaacauugauugagaguaugcuuuaugguucagguacuguccuaagcacuuugaauauuaucuaaauuaacacuuguaacaucccuauaugguauuauuguuaucccaauuugcagaagaagaaacucaggcacaaagagaucaaacaguauguccaaggucacauggcuaacgucuagagccaggaucaaaacccaggcauugugaguccaacagcucuaaauuccaauguuauacugccuaaguuugcuaugccuaugcuuacugaaaagauacccaagauuccacacauaucaauuucuguuccuaaggaaggucuauuuuggcugggcacaguggcucacgccuauaauccuagcacuuugggaggcugagaugggaggaucacuugaguccaggaguucaagaccagccugggcaacauagugagacugucuccacacacaaaaaaacaaaaacaaacaauuagccaggcaugguggcacaugccuguagucucagcugcucaggaggcugagguaggaggacugcuugagccugggaggucaaggcugcagcgaguugagauugcaccacugcauuccagccuugguaacagugcgacugucucaaaagaagaauaaaaaaguucaauuaaaauaagccccuccaauauacauacauguaucagccaaucgaaaacaacuccaauauccuacauauccuccuucccacagaguaguccaauauucuuuacuauaauuguuagguaaauacauauacagauuaaaaacagaugauauaaauuuaggcacuaauaaaagucacaaacacaaggcugaaauauacaauuuauuccucuagaaagguucauaauuuuucuuucauugcugaauaaucuaagcucagguuuuuaaaaaaauucugggcucauucucuuuuauccuuggucucucucuucuuguauuucucugcucaaauguuaccuccucagaaaggccuuccuuaacuauucaguguuuucuccuugucaucauuaguuuacuaccugaaauuaaauguuugcauguuucuuuauugucuaacucugccaucagaaaauaaacugcaugugggccaacuuguucacugccguauccuggccccuaaacugugccuccguauaguaugugcucaauauuuacagagccaauuaaugaaaacauucccuguaaagcaagcagcuuggugagugcagaccguaagagccaggcuguucacugcccugaucgccucuucuuaacucucaauuuucacaucuguagcccuggauucauauccuuguaaaauacaugaauucuucugauauggguuggggaaggagguaagggugguugcacccacuaacucccguuaguaaggacaggcuggagaaaagaaaugauaaauccugccuuacugguuuuugguugugagggaaugguaggauaaacaaagggguaaaugaaccuggauauggggccuuuggggucaucuacaacucuucuauuaccccucuauagaaucugucuccaaguuacuuuuuuuguuuaagcauuuuuuuuuuguauccauccuuuuaucuccucucuuacaaguaugcccuccuuacauuauaccuggacuauuacaaauguccccaguucacugcugucuuccaguuuccuuccacucacccauucugcacacaggcaugggacaaaaaaaaaaaaaaaaaaaaaaacuaaaacuuuacggcaguucuagcucaagaaucuuuaacagcucucuuacacuggaaaaaaggaaaccauuuauuccuguuauuaaucauaagccgccaauucuuauuugccaucuucacuggccaacagaaugagugcucaugaaagaauagauguuucagcagugccuuucacccaucccauucugaauucaucacauaauacuccacacugcacauucgggcacuucauugucaauacaauugguuuucuuuuucauguguacagcucuugucugccuucuccaaaaccacagaaggguuuucaggacagacucauagucucuuauuuccaccauuucucaggacugugcuacuauuagguacauacuuacuguauaguuaaauaauuagagaucuaauaauccaaguuugagaagaauuucaucaugagaaaaaaaaaaaaaccagacccacgcaguaacuguaccaggauaguuuauaaagcaggaaaagaaaauagcaacauuaagaauuugagcaagaaaaggcuggguuugggggucuuaauaaguacuugaaagcagauggguagauuuggguaaacuuccuaagagaccaguuuaaagguuguuacaaagaaugacucuaaauuacgcuaaccaaaaagaagacuuuugucuagugaucuggagaccaucuaaaaucugaauaacguguuuaagggaaacuaaaagaagaguggggagugguaggccacggaacuugauaugcuuuccuaucucuugagaugcaagacacucuuugggucaguacugaagagaccacuuuguagacaccuuuccaucucucgagauucugugugaaccugugcauuaugccaacuaauuagaguacuuagauguuacagcuauaugcaauuuguaaauaauuagcuuguaaaguacuuugaaaauagaaaguaccagcaaguacucagaauuacuacauguuaaaagccuuugguauauauuuaauaaucagcuuuuuaaaagucacaguacuuuacagcugaagagaauuucugaucuugaaucacuggcaugaguuuauuuagaaugaaaugcuauuggagugcaaaucagaugcggauuaacuuuucacaggauguauaagauucacauucaucucccuaguccuuuuuggaccaacucagcuuucccucaggucccuacagacuuuaugcagauuccuuucacauauacaagacucuugguuaaccugccugcccccuucucaguuucuucccuccacccaacugccuucugcagguguuuuguaugaacccgugaguuuauggucacccuaaagacauucaagacugcauucuacgugaucagucuaaauucuuuuaggugcaaugaaguugugauguggugagcggucgccucuggcuguguuucccacuguacuucaucuacuaucaucagucuguaccuugauguccacuaauuaaacuuuguuuucaucuccugacaggccuugguuuagaggaauuaaacuccagguaaguaauucuguuuacuauccccacaggcaaaguuuugggagaggaaaaaaguuuuuaauccuuuuccacauccuuuuugagcuuccuuuuaucuucaaaggcuaaugcccuuaaacaaacauugacuuuccagaauuucuuacugucaccauaagagaauaugcuguauccuugcccuaugacaucccugcucccgccuaaacucaccucuuccaaugucuucaugugauucuuuuauuggaaaaccaaacuaagccauuccucuguauaaugagugguaauguuuacucuucuuaggcaguaaacuaaugcuguuacugccuagugaccuccacguuaacuccaggugacauuuuucuauucccuauuugaaacccuuggcuuccacacccuauuuuugcacuuuccuaccauuacauugacccaaacuuacaaauacucuuaucuuuaacucuucuuugacccaaacuuuaaauacugaaguugccuagggcuuuguucugggcccacuucuuugucacccucuauuuuuuuuuuuuuaaucaauuuaugucaucuuuauggcaaggacucauaaaauuugucuccagcuuagaucucuuccacgaucuccaacucacauagccacugcuuacaauguucacaaaugaaacuuuugacuccuaucaucuuuuccaccucccaaucuauuuuccauuuuaagcuucccaauuucaguaauuggccccaaagcuaggcaguagucaucuuugauucuucaucuuccacaguuccugaaguguaccaauucugugccaauucaauucuaaaauauaccucaaaccuaccuucucuucuccaucacuagcuucuacccuuccaggccacuucaacucuuuauagugucucucucugcuucuacuccagccucccuauaauucaucuccccccacucuguaaucaaaguaaagaagacgucauucccacugaaccuaaaauccaaaaucccuacuaccccaacucuuccucccauggacuccagaggacaggcccuucuccuugucuacugugcuacaaaaacaugcaaaucuuuguucaauaucuucaguuccucaugccaccaguuuucugcuuuaggaccuuugcacaugcuauacccccagaaugcauuuucucuccucuuugcacagccagcucucucccuuccuguaaucucuagaacaccuuuccuaacuuccgugccuaaaguagauuccuuucuuauguuuucuaucuugacccuacauuugcugcuuuuacagaauuacaaguuuuuaauuuuauauauuuuuuugagacaaggucucccucugucacccaggcuggagugcaauggugugaucauggcucauugcagccucaaccuccuagguucaagauauccucucgccucagcuucccaagcagcugggacuacaggcaugugucaccaugccuggcuaccuuuuuuauuuuuuuguagagacagggacuccccauguugcccaggcuugucucaaacuccugggcucaagugauccucccaccuuggcuucccaggugugagccaccaugccgagccucacaauuuuuuuuuaaggggcucuuauaacacaugcuuuaugagaacaggacuuacucugucucauccacuauagcuauauaucuauccccaaggccuggaacauacuagugcucaaaaauauggauaucucuuuaaagaauuuggcugaguguaggaaauguaggcucuauggcacgcuaguguaagaggucagguuugagugacugaaaagcugcaugccauaacuacuuacaugaauucauagaguauuuacuaaguguccacuaccugucagguguuccagguaccagaaucauguugaccuccaaguugguuuaguggguaaacaagauaagcacuaccaauagcauaguaaaugccaaggccaggaaacacaggguguaaugaaagcacaaagaaguacccaaacuaggcugagaggccugacacauaagcuuugacuuaagaguacggcaggaguaagacuggcccaggaagaggggauagauaaacaagggcccaaagcacagagcacuggcgggugggauauguguuuuccaaaacagucauuuccccuauauggaauuuuccuucuccuuggcuuuaccuucucucaaauagggcuucuucuacauuacccuaggcuauaccuacuuaaggacugaaaauguuuucuagucaucccaauuuucuccuucuguaauauaaucaaaacaucuuaccuuacuuagaucaugacuaaguauaucccaaaauucaagcaguaaacugguaucuuuccuguaaaugccucaaagauggagccuuacucccuaaaacucucauguaaaaccagaauucucacacuucuuccaaauuauucccacccuugccaagucuaccaaucacagcaaaugaugcaauucuuuaaaagccaaaaaguuuagcaagaagccaaguccccaccccaaucuucuuuccuucuguuuuuaaacaacaaucuaacuggggucaugguuuuugucucuucccuuacccccaccacuccaacuacagacauggauauauacuucuuuuaauucccaugaucacaguucuugucuaggccucugauauucucaguuuccucauuuucaaugcuggcuuaauuagaaaaaaagucauccucaaggaccauuugguugcauggaacagaaaccagucaaacuaguuuaaauaaaagagggaauuuauuagaagaauacagagguucuugcagagauuccaacagcugcaaggggucaacagcuagaaucacgccuuucugaaggacagaguaugcuguaaccacaaacuucuaauucuggguucugcaccaucaggaagagaauauccuacaggacaguucuccuuguauacugcauaaaggacuagaauguggauucauuucugcuugcuuuuugauccuuauaguccuuuaugcuggccucaaacuugucaagcacauguuggcagacauucaugagcucauucaggccucucugaaauggcucaacagcuggaaggguaccucgagucugaaugcguaaauuaauuuugcucucugaaggaugggucguaguguaaccacaaaauuccacuuccggguucuucaugaucauguaacguagagaauuuccuaggguauggucuuccucgugcaauacaaaugucacacagugucuaucuguuccagcugccuggaccauuuccagggcugucuuccucucgccuucagccauugaggucuucaauccagauauuuuucuacacacauauuuuuuauaaaaaugagaucauacugaauauuguuuuguaacuagcuuuuucucauuuacuauaucacauugcaacacauuauuauuaaucuacuccagcuacacagaauuauucgccucucauuuuccugccuccacaaacucuaucaauaaauauuuaauuuauugccuccaguuuuucccugcuccauuugaccauccacacuggccacaaggggaguuuucuuagaaaaacacaaacuuaaguguuugcaaaaauauuuuuugguagagucacaagcaagggauaggauuagaauaggacugguccugcuagaggaugaagagaggguugaaaggcauagaaaucccgauugcucuaguauaaaaauagaggauacagaugaucaaugugcaggcccaacuacggcuuccauuuugcaagagaaggaaacuaggagaauggaagguucaggagucaagcagcagggagaaaaagagcucagcgcacagaguggcuuuaggagcagucugcacauagaaagaaggugagccguaguuacagggacagaggcacgaguaccguccucaggagcagaggcccggggcgugauuuuuacacacugcuguuguaacgggggugggcaguucggauacuuaacucuggucucccaacuugucuucccuccuugauagcuaguguaccucucagccucucaacugaaacacauucaugucuccuccccacuucucucuccaugcuucuucucugcgccccgagucaggccccggcugccaggccaggcagcgugccccucggccacccgcuccccuugggcgcggcccgcuccgcccgccuccuccucggccguuaccucuccagcuccugauccucuuccaucgcuggggcgguuucuggauccucagguggugcuggcggaucgggggcucugucccauagcgcgaggcgcggaggcgaagcaggaagcaaggaccgaccgacggaaggcgcggaggacggaaggagggaggaggagccgcagcggcgcggcagggcccagccgcggggcggggcaugaggcuccacccccagcccccgccccgacgcggggugagcgguggcucgcggccccgcggcucaccugggcgaccacgcgaggccacucgcggcgggaggggcagggggcggggccagcgccgccuuaccccgaggcccagacaggccugcgggcgccccggcucaacucugguaccuuuccccaggugauggcgaaggggcgcggccuuaccugccgcccccaaaucacuucccuucccaguggcaaguccgaaagcggcccgacuucccaacuggggcgguguugacccaggauggcccuuccugggaccccggcccucccgggccuuuugugggacgacaggcuuaaacuguagucggucaacacaccuugaagagggaggggggucacgugcgagaugagucaccacagaauacgaagguugaaggcgguauuuguuucaccggggagcuugcaguugcauuuucaacugggucaaaauagggcaagaaagaaaugucucuuuugggggagugagaguuugggagaaaacuguuucccaccuuauccuuuccguccuaggauuccuucuacccccagagcgcguccucuccggcuguagacuuccuuuucccuuucuccccaguggcuccucaaaccuccucaccugcggaacccgcccucaccuuuguucccaggcgcccagcccccgccucggcaaccuuucgccgcccaggcucgcucuccauccagcucccugcgucccggccuucgcugugcucccucaggugcgcuuccucucgaaucggcccuucuuguccccucgccgcuggccccgacccugcccgacuccagcuguccagcgcaacuacguuucugcuucccugcgccaccuguucuccuggccuccccccaccccgccccgcgauuccucuggauguucacuccuuccccagcugugccacucuuggcggcggccgggggugcgcgcagacaccuagccagcggggcuuccgcaggggaaucaggcgggcggcggggacagcccggggcgagugggggaggcgggcggcgagggcggaguggucucacucua

SEQ ID NO: 14519 - RNA, 2332 nt, Homo sapiens
gccagcaccccgcgcucuuugggcggugcccacggcagcagaggcuacuguuucagccuaggucucagccgcgcguucagccuccugggcagaggcagcugcgggauaccgcggccagggaaagcgcguggagagccgaaaggugcggugggcgcagagggcgggcuggcugcggggcgaccgcgcgccggggccaugccgcgcuccuuccugguggacucgcuagugcugcgcgaggcgggcgagaagaaggcgcccgagggcagcccgccgccgcucuuccccuacgcugugcccccgccgcacgcgcugcacggucucucgccuggcgccugccacgcgcgcaaggcugggcugcugugcgugugcccgcucugcgucaccgccucgcagcugcaugggccccccgggccgcccgcgcugccucuacucaaggcuuccuucccacccuucggcucgcaguacugccacgcgccccugggccgccagcacucugcugugucgcccggggucgcucacggcccggccgccgcugcugcugccgccgcgcucuaccagaccuccuacccgcugccugaccccaggcaguuccacugcaucucuguggguaagcggggccgccgcgcagagggaccgggcagaggugauccgaagcaggauggagagccagagauggaggaagagggacccugggcuuucugggggcggugagggucaugucggggacuaaggggggcgcuugggguggagugaggauagagggccgggacacaacgccaggaggcggaugagggcagacguccagguccuggagugugggccgggguaagugagggcugggauccaaggcucuccaugaaggggaagggguuccagggcugcaugacuccgggagaaucaggaucucggagcuggacaaggagcgcucacuguagcucugcuguggauuguguuggggcgaagagauggguaagaggucaaagucguaggauucuggcgaccgccuaccaagggauuggguccacagcacagaggucugaucgcuuccuucucugcucugccaccuccagacagcagcucuaaccagcugcccagcagcaagaggaugcgcacggcuuucaccagcacgcagcugcuagagcuggagcgcgaguucgcuucuaauauguaccugucccgccuacgucgcaucgagaucgcgaccuaccugaaucuguccgagaagcaggugaagaucugguuucagaaccgccgagugaagcacaagaaggagggcaagggcagcaaccaucguggcggcggcggcgggggugccggugguggcgggagcgcaccgcaaggcugcaagugcgcaucgcucuccucagccaagugcuccgaggaugacgacgaauugcccaugucuccguccuccucagggaaggacgaccgggaucuuacggucacucccuaggcgcgugucucccuaggucgcccaccccaagaccucccugcgccucggagacuaguccugggacucagcgcugauucccaggcacccgcagccaaaccacugccuggcauggauuuggcacugcuuugcagaggucccgggccugggcagggcugagagcuuggcagagacuggaccauggcguccccgccccagggcucgcucguguccaaagccaacuccaagcugugaacacuguaagcgcucgaguccuccugggcagugcagcaccgcggcccccgcccgcaagccugcuuggcgcagcgccuugcuggcagccggcgccuccuagcccgcccucucugggcuggcuugggcuuccucgcuuacucuacucuccuccgcucucggucaaggucggcggccuuggaugcucguucgcuucucuuuuuaaaaugucuuuuugucccuccccaccucuuuccugugaucauuuauucacucggcccccgcccgccaacacacacauuuaugaacccccacuuuuuuuuuccuucuccuuuucccuuccccuccucagggagccuccuccuucagucaguccauuugucccuugaucuggccuugcuguccucaguccccacggcuccucucacagaugauaaauuucgcccguaguauccauauuggggaaacagauuugcucuguuuccaacacgcucuuccuuccucuaaacauaggaccccgcucugcgccgcuggcgaccccacucuucccccuccagacucuggcccgccccagccuagcuguguaauuguacggccucugcaaugccagaagauauuuauuuauuuauuuauguacaaaauuuuaaauaaacuuuuuuuuuucuuagaaau

SEQ ID NO: 14520 - RNA, 2178 nt, Homo sapiens
cgaaccgaugggaagauuuuuuuuuucaauaacaacuaugcuacccagcagauucuuuggggacaguccucggaguccuugaaaaccccuuugggguuuaugccaggauaagaagagacuagaagaaagggacagcuaguauuuuaauauguaaaucuguuugcauaauauuuccuagguaaacuauucguugauccaaccaaaauucggcggggcugggggguaucguuauugaggaugacucgcucuaggggagaacgcggacgcauuuucccaucagaguucccuccauaaaucaaaaccucaaaagaagaguuaaagacgacacccaggugucuacaguauccaagggccgggccaggagagguccuuggccaccuggcgccgaguucgcggccgcagacucccacggacggcccagcacccgagcgcgcgggccgagcugccccagacccggcgcagcgccucggcgaggccgucugcgaaguccgggccgccacucgggaccgcggcccgagccagaggagagacuucggagaagagggaagaggacgcggggugggaaacgccggggccgcaggcaaguagugggcgaguccggagggcgcgaaagaggggaggggcgcgggaggcaauggaaggagcgagcgcggggaggagcgaggcggcugggccggaggaggcgcgcgcccggguccacacugcggggugggggcugagggaccgcgaggggcugcgagcgagcgagcggggccuuaccgagcagcggcagcuggccgccgucgcgcgccaacgccggcauggccuccggagcccgggguccccaggccgcgccggcccagcccugcgaugccgccuggagcggcgcgccucgcgcugcagguggcucucuuaaggaugcgcgucaccgaccgcaaauucccucggacuggugcaaaguggaaggggggaggaacccucuccccagaggcagggaccgaggcgggagcggagagguugggcagagccgagcagccggugccuggcgcagcgcugcagccgagcccacgugcccgccgcgguccgcagccugugcucggcggcccccggggcuccccgacugcggcggggaagauugggcgcggucccgccggagaaguugcacuggcuccgcggcucugccgccuugcugccccugugaguccccgaacucugucguuuggauccggggcguggggacugcagggagccacaaaccacccuccuagugcgcugggaucuuugaggcccugagaaaggcgcugaauccgcucggcacgcuggcaacucccgccagcgcacaggcgagcauuccauuaagaaccauuccauucuuaauuguggacugauuuccuuugucucugccuccaucuccuaggaugcucaggacccagucagcggcgggaucaagaaaaacaggcaggguuucaaugucaaccaaggcaauuagggagguuaacaaacagccuucaaaacaaaacacacagaaaauacaucccagaggauguugcgaaucauccgcucaauaguucuuguucuucaucgcauaauuuuucgaguugaaaauuauuauuauuuucuuugcaauaaguugaggauuggaaagcucuggaugccaguucugguucuucccuuacuuaacuagccguuugaccuccacaaaccucuguuuacucaucguaaaggaaagggauggaccaaaugguucauaaugucucucccaauucuaggaauuccacgcucuuaauuauuuuaauuauuuucuaauaaagcaugaaaauugacuguuuacucuuggccauacaguucuuuuccuuagauguugucuacaguacaauaauucuuuccccuaggguauggcagaaacuuuagaagugucuaccauggugcagccacuauggaaaacacuauagagguuucucaaaaaauuaaaaaaaauacgguccaacaauuccauuucuggccauguagccaaaagaauugaaagcagggucuugaagagaugucuguacacccguguugaaagcagcauuauucacaguagucaaaaggcagaaguaacccauguccacaacagaugaaugauaaacaaaaaugcaguauauacauacgacugaguauuuuucagcuuuaaagaggagggaaauucugauacagcua

SEQ ID NO: 14521 - RNA, 3436 nt, Homo sapiens
ccagcaagucaugguggcuuaugccuauaaucccagcacuuugggaggccguggcuggcagauugcgcaaguucaggaguucaagaccacccugggcaacauaaugaaacccugucucugcaaaaaaaaauacaaaaauuagccaggcaugguggcgaaugccuguggucccagcaacuuugaaggcugaggcaggaggaucacuugagcccaggagguugaggcugcagugagcuuugauuacaccacuguacuccagccugggugacagaaacugucuuaaaaaaauaaaaaaaaaaaagaagaagaaaaaauccagcacugcaggaacaugaaaaccagcuaucucgaucuuccacuuuccuuccccauaauggauacaugcuguggaggcacaguucucaucugugauaauuauagaguggaauuuuugauuucugagacuccaguuacaaacugcagccuugugggagcugauuaucuagccugccuuuacagcagcccagaaccuccuucaaaucugcaaaauucucagaaacacuucuagaaaucuggcgaggcuuuguaguaagguugugagggagcagagaggaagguuauaaaugaauaaaaucuucaaaggaggugggaaccacugcaauagcaaauuauaagaagcaugcuuaugucacauggacacacuuguuucugaauucugcuugcuaauuucuagaaaggacguacgcguuucuuguaaacacgaggcaccccaagauaagaagacagauagagcaagggauggacauggucaucuccucagugauuggagaaaguuaccggcuucagguaagccuagccugucugaauccagggcugucaaccacauggaaggagcuugugcauuucaugcaggaacugaggcccuauugcccuggcuuaggccaagagaauggcccuuagaaaacaaagugcauucagacacuuuguucucaaagguggcauuauugcuaccaauaaaaugaguuuaguucuuagcaaccuauuagaaauggguaagaauaaauguaauuuuggccaagcaguucagaauuuuuagauggaauaugaugcaaaugcaaaguuuuguuagaaaaaauaaagacaacaguuuaaaaauaugugugagagugaaagggaaauaagaggugugauguuuuggauauuuaggcgguuguuaguucuacaaugucaacaggauacuuauguccauuaagucaaugcaauguuccucucucuuucaguuugauuuucaagaggcagugaagaauuucuuccccccaggaaaugaagugguuaauggagaaaauuuaagcuuugcauaugaauucaaagcugaugcauuauuugauuucuucuauugguuugggcucaguaauuccguuguaaaaguaaauggaaaaguucugaauuugucaaguacaaguccagaaaagaaggagacgauuaaguuauuucuggaaaaaaugagugagccuuuaauccgaaggagcaguuucucugaccgaaaguucaguguaacuuccagagguauguuaaaaauuccgaaggauauguggaagguaguuaaauaaaaggguagaguaaaauaauggaagagagucaauugauucaaaaggcaagaccuauuaaugaaagggaaauagaucacaaaauucagaaaguaagaaguggggcauguuuauuaccaaaaacaaaugcagugacuuuuccuuuugagcuccuuuaagucuucugacaugaggauuacauuaugcaguauaccccaaaauaacuuuaaauauuauuauuaauuuaaaugaguauugaugaucauuuaaauauuauuggcaaucauauuggaagacugcugccuuccaaauguucauauucuguacaacagaaugugaacaaaaaugaucaguugggaggagucacuauauggucaagauaucagucuuuuuuuuuuuuuuuuuugaaacggaguuucacucucguuguccaggcuggaguucaguggugugaucuuggcucacugcaaccucagccuuccggguucaagugauucuccugccucagccuccugaguagcuggaauuccaggcgcacaccaccacgccuggcuaauuuuuguaguuuuaguagagaugggguuucaccagguuggccaggcuggucuggaacuccugaccuugugaucugccugccucagccucccaaagugcugggauuacaggugugagccaccgggcccggccaagauaucaaucuuuauaguauuuggaaggguucuccagauuuggacagagcacaaaagaauaacucuugagaagguuucacuuaacacacucuugaugacauauggcagguucuugguauugacacccguguggcugcagguggcaugaaucaugcauggcuugucuggaucugucuucugcagagcccauucucucugucuuuugcuagucuggacuggagagcaacuucccugagucaggacucuugcugcuaauugcagaaaaccagcagucucugugaaguugugguguucucagaguucagcuguaaaauauagaauccucauuaauuguauuuacagccuguguuuuuuugcuuuguuuuuuguguuuuucauuuuuugagacggacucucgcucugucacucaggcuggagugcaguggugccaucucggcucacugcaaccuccuccuccugggcauaaacaauucucgugucucagccucccaaguagcugggacuacaggugugugccaccauacccagcuaauuuuugugguuuuaguagagacggguuuucacccuguuggccaggcuggucucgaacuccugaccucaagugauccaacugccucagccucccaaagugcuggaauuacaggugugagccaccacgccuggccacagccuguguuucuuucuucaaauguuuacaacaaaaaugcuugcuacuagcuauuucuuauccuagaaguggucucuuucucuuuuccucccuccuucccuccuuccuccucucucucuccaucucuuucucuuucucucuguguguuuuucucuccugcucuuucuccaucucugucuucauuucagucuccaucucuuccaucuccauuucugucucugucuguuucucucucuuuccccucucuuucucugucucucugucuuucuguucaucucuucccauguuguuucagcuuucucugccugggaguuccucacaaagauguguuugugcucugcucuguugcaaucauguggaggauuauacucugauccuuuuggaggggaugauuaacuggccccuuugcugcagugccauaugugccugggccuuuuucugacaccccugaguucaccuaucagccccagcagccugggcaggauuuuccgguuucaccauggcucacccucugu

SEQ ID NO: 14522 - RNA, 726 nt, Homo sapiens
ucuuuccccuggccccuagcagcaugcuugcagagaggcauggcagcuugucuuuagguagauugcuuauguuucagauagaaaacgaaauccuugucagacauacuauugaaucuauccuugaguguaugaauucucaaguuugguugcaucuuguuuagacuuuguucucaaguauuuaaaaaauggcuggcuuuguucuuuaggauaacaagcuccuuuaguucgaaaagcuucccacuucauuugaugauucaguauuaauguagugccucugugaaugccagggcaggguugggagcgcaaggccgagguccugccauuuggaguaagauuuuccagacagggcagggcugggcugugaaucuaucaagaccacccuggccccuugcccugugcacaauccccagcagucacuucacaaacauguugguuuaauucaacuucaggaccuccugggugacuugaaacaggagauucugggucacuucuggcuggauagugacccugaugguauaaaucuuugauuuugggaauucuguaggaaguaaucuuaagaauuuaauauggcaaaucccucauucucaugacccauccagguagcacuucuacaaaggcacagugagacaggugacacaccagcugucugcauacagccauguaagccucugagggacaagaaccaggcaggggugccaacccugcccaaagcaucaggaggcucag

SEQ ID NO: 14523 - RNA, 2534 nt, Homo sapiens
ucagagacaggagacaggggcagagccucugggcugggggcugccucccugagcaagucacuccuguguuccagugggagcguauggugugaggggcccaaccuggacaucucuucaaucccaagauggauaaaaacaaaucucucagugaaggaucauucaugccuauugccaggaguuacagaggaauaagcgugagauuuaaaagagguuuuuauuaccuugucugaagagagagcuggugcugcuggguuuucugcauuccaaccucugaaagaaggguugugugugugacucugugagguggccccauuccugagagagucucuagguacaugggaaauaagaugcauuggaaauggcacucaucugggacacucuagagcuguugucucugcugaaggagccacccuccaccugacugggagggcuccuagcuagggaugguguaucacaccugcgacaguuccccuuaaagaugcucuccacucagacacaggaggcaggcugaggaacugaggggcacuaggagacuugggguugcagaauggaacauguacauuggauuuucuuucaauuuauuuagucuuaaaaaaaaaaacaaaccaugccauggacaguuugcuugguauuugaaagcuugaugcucgccaucacugaggauuugagcaaagugaauauucccugaaguuuuuuaaugaauaggcauuaaaaaaaaaaagcuauauaagaaacaauggagccaugaaagcagauugaggcagaugagccauuuuauuuggaggauccucugagcagugauugccuugaauaguuuugccuguaccuugaccucagcuggucucacggugaaccgugagcccucacuuccuccuagcuucuccauggggccaaauccaaaguguguacguuggaccuguaaccaccccugccuaucccugcugcacaucuggccugcugcucaccaccucuguggucaaggcuuccuucugcccuuuacaagcuuuuaccucuccagaaaauucuaccgucacucuaucuugcuuaacagugucuuuuuauauuuuccuguguuauuuauuuugcuuaguuuccauagaaacauaggacuggaggauacuguggggauuaucuacaccuacaucuuacggaugagaaaacugaggcccagggagauggaguuagauuuuguuuugagugagccaugggggaaaagaaggaucuguauaaaaggaccuggcuccucucagagagcuggcuguguuucuagaacuuugcgucaaugaguuucucaggguagcagguuauuccugcauccccagagcuccccagaagcccagcaccagagcucauucugagaguaucugcacucccucugggaucggcugacccugcuucugacccuuuuagacucuuggcguggucuggacaagcaggcuucuuuccccagcuuccuggcaaccaugaugucauccagaauguucucucuccagccugaccucauuuccaucuugcugccucucucuaaugcugccacucuccuugccauggaauuugcuggcgggcccaucagcagggugccuccuucugccccuccuaagugucuuuggugcccucgugcccaugagcaggagucuguuacgaggcugcauuuggaccagcccccaguggagucucacuguuuuguucccagcuccacagggagggcaaugugacccauccacaccugcacacagugccugccaaggcaugacgugcugaggaagacguuugcaaauuugaaggcugaugaggauaagguucucggagaguuccugcuguacaucuguggccuagggcuucuccuuauggagaauaaagugagucaaauucaauuggccuuagaauuauagaagguuagagcugagucuuaagagaucaucuagaugagagagaguccaccagggaucaaauuucauguccacacaaaucaccauaggugguuguuuaaaauucagauuuuuggguccuacccagagagauuaggaauuuaguugguccacaguagaggcaaggaaaaggacuuuuuaauaagcauaagugguucagauuuggaaccccucgaaggugcaaauaaggaaggcaagagccggguccgcaguguccacugccugucgguccccacucaggugaugaaggcuguggcuccccagucucugcagaggggagccucugaucuugcaccucugcgugaccuggucuuccuuuuguuucuagaacucucccuucugugugucccacccuggauccuccagaggcaggcugugcucccagaaagguacccagaggaaaacacaaagguaugagggagggcagcacagaaaggaaacugaaugagcagugaaugcagcuucaaaacuacuucacgauuuugccaagggaaauugcucagccugaacauccagguaauuggguugaaaaacagucaucaagccaucugccagccaauuaaauguguggucagucacucaccugaugaaacaccaaacaaaaau

SEQ ID NO: 14524 - RNA, 2580 nt, Homo sapiens
uuuuacugugauuauucuucaucuuccuuccuuuucaugucauuuuauauguucuuauguaaaauuacuuucaucuagaauaggaauaaugugaacugaaaucaccuaaccuauuaggaguuaggggagggagacuguguguaauauuugcgugcuuaaauauuuucaaugaaaaguuacuuugauuuaguuuuuuauguuacuacauaauuaugauaggcuacguuuucauuuuuuuaucagaugucuucuccuaauugugagauauauuaucaaaguccuuuaucacuuuguauggccaaaaggaagucuguuuccacaccugucucagcccagaugacuucaaagucuuguaaaggggagaaagagauugaugaccaaaagaacugcaaaaagagaagagccuuggauuucuugaguagacugccuuuaccuccaccuguuagucccauuuguacauuuguuucuccggcugcacagaaggcauuucagccaccaaggaguuguggcaccaaauacgaaacacccauaaagaaaaaagaacugaauucuccucagaugacuccauuuaaaaaauucaaugaaauuucucuuuuggaaaguaauucaauagcugacgaagaacuugcauugauaaauacccaagcucuuuugucugguucaacaggagaaaaacaauuuauaucugucagugaauccacuaggacugcucccaccaguucagaagauuaucucagacugaaacgacguuguacuacaucucugaucaaagaacaggagaguucccaggccaguacggaagaaugugagaaaaauaagcaggacacaauuacaacuaaaaaauauaucuaagcauuugcaaaggcgacaauaaauuauugacgcuuaaccuuuccaguuuauaagacuggaauauaauuucaaaccacacauuaguacuuauguugcacaaugagaaaagaaauuaguuucaaauuuaccucagcguuuguguaucgggcaaaaaucguuuugcccgauuccguauugguauacuuuugcuucaguugcauaucuuaaaacuaaauguaauuuauuaacuaaucaagaaaaacaucuuuggcugagcucgguggcucaugccuguaaucccaacacuuugagaagcugaggugggaggagugcuugaggccaggaguucaagaccagccugggcaacauagggagacccccaucuuuacaaagaaaaaaaaaaggggaaaagaaaaucuuuuaaaucuuuggauuugaucacuacaaguauuauuuuacaagugaaauaaacauaccauuuucuuuuagauugugucauuaaauggaaugaggucucuuaguacaguuauuuugaugcagauaauuccuuuuaguuuagcuacuauuuuaggggauuuuuuuuagagguaacucacuaugaaauaguucuccuuaaugcaaauauguugguucugcuauaguuccauccuguucaaaagucaggaugaauaugaagagugguguuuccuuuugagcaauucuucauccuuaagucagcaugauuauaagaaaaauagaacccucaguguaacucuaauuccuuuuuacuauuccagugugaucucugaaauuaaauuacuucaacuaaaaauucaaauacuuuaaaucagaagauuucauaguuaauuuauuuuuuuuuucaacaaaauggucauccaaacucaaacuugagaaaauaucuugcuuucaaauuggcacugauucugccugcuuuauuuuuagcgcuaucacaggacccagagccuaugcccuuuuaaacuuaccacaaaagcagaagauuaauucaauuuaagaugauacucucauuuguuacguccuuuuuuuuuuuuuuuggagauggagucuugcuuugucgcccaugcuggagugcaguggcaugauccuggcucacugcagccuccacuucccggguucacguaauucucccaccucaagccucccuaguagcugggauuacagggacgcaccaccaugcccagcuaauuuuugcauuuuuaguagagacuggguuuuaccauguuggccaagcuggucucaaacuccugaugucaggugauccaucugccucagccucccaaagugcugggauuauaggcgugagccacugugcccggccaauauuuguuacuuucuuagguuuaauagagaaaagggauaaaacauuucuaacugggaguuaauugcauggagaaggucuuaaaucagauguuuuaaugccuuaaaugucuguauaauaucauguuuucaaaucuaauuauaaauacguuuaaagccaagaauaaaucuuuuaaaaaauugacuuguuuccuuccauaacucugagccaugauuuuucuguucuguaaaaagcauuaacaaaauugucuauuuugcuacucccuguaacuuaaguauucugcaagucuuauuaaugagacuuguuuuguuucuaaaacaguuugguuuucacauccuaauuuugcagugauccacucuagaacaaggaauaaaacuuggguuucaaacaggagaacagaaaaaauuacaaga

SEQ ID NO: 14525 - RNA, 1073 nt, Homo sapiens
cagagugagcgacccgggcaaaagugcgucacccagcuuuuuugucccagugcagacacgcucagguccuguccaggaauucuggaggucucugaggcgcaaaaguucacacagagcuuacgucuacguuuacagcuaaucuaaacaguccagucaagaagugaaagcgaaaaacaccaccaccgccccacccucaccuaaaacggggugucuacucaccuuacucuaccccuacgcauugaccuuuaccucccaauaaaaccuucuuuuaggaagacacgaaccucugugaaggugaaagaaaagcggagacagcacuaaagccgaggucuggagggacuaaaagcccaccucucagaaucgcgguaacaaaccucaccuccguacgcaagauggcggucaccucucgguuacccaggccaaaacuaggcguuugcgccaggcauugugggaauugaaguccgacguucacaccggcuccguaaaccucacggcacggagacuaggucucccagaauccauggcgugacaaacgcaguaauuuggcaacaaaaguagaccggaauuaguuccuagaucuggagcagggaaguuaucuaaaaacaccaacuuucguuaaaagaaagcagcgaccuccucuggcguucacccccgaaggaaaaaggaauuugagaaacuggcgccccccaauagauguauaaucggcucucagugcaugcuucuuagagcuuucuagaagacaaccagcugacuuuuccaacggaacuccacaguugguaccacaaauuugcauuccggucguuucuacgaaagaccaccugacguaauuuuaggcucaugcuuuucuguggaaggacagaauuacuggggcgcagguccccaauaacagauaaaaauacuuaugaacaaaaucguuuagugucaggucgcuguuuuguuuuguuuuuggaaauacagaccaaucacugagcuuucccauuaaaagagucaauacgugcaaagcaaguagaacagcgagcuccugguaagaauaagcgcuauguaaguguuuguugcauuaaaaauaaauacaa

SEQ ID NO: 14526 - RNA, 17452 nt, Homo sapiens
agucuguucggcacuugaaguacuccuuguuuaagaaaucacuacugggcaguguuucggauaauggaauaguaacucucugggauguaaauagucagaguccauaccauaacuuugacaguguacacaaagcuccagcgucaggcaucuguuuuucuccugucaaugaauugcucuuuguaaccauaggcuuggauaaaagaaucauccucuaugacacuucaaguaagaaguaagugugacaugcuuauuucuuaauuuaguaacaaauagcuauuauuccauuaacaggcauauuugugauuuauauagaccucugauuaguguccagggguccuaaaguuuguacaguugauggaucuaguaagaaagaauuuucuucuuaugcagaaagaaauagauggguugcagguaguauuuaggguacuucugaaacaugaacauagagagaugacaucuuaaugauuucacauuuuaauuuuagcaucuuuuccacaauaugauaaaaugcauauguuuuuaacccaaaugauuaauuugcuuuaaaacugauuaauuaucuagaggaagguuuagaaacgauugacauuuugggcuggguaauucuuuguugugaggggcuguccuggguauuguaggauauucaucagcaucccuggccucugcuuacuaaauaccaauggccuaaauuguguccagacauugucagauguccccugguaguaaccagggacaaccugggagcacccacuugagaaauacugauuauguacugguguacauaauccucuaagcauuugggcccacuguacccucuucuuguuaaauuuagguaugcuuaguuagcuaaaaaacaaaaacaaaaacaaaagaaugcaagagugauacaguuguauucaagaugcuuaccacugucuguagaucauguggaguaugaauguuacuacaagggaaggucccacugucagccuuuauuaugaugcuagaauuuuuacuguuaggacuuauuugcugucuucuuuuauggaacaauuuacugagagcccaguaagccauucuucuuuucuacuauacacaccaguaaagagcucagcuucagcagaucaccauccguauuucuuuauuagcuuccuaaggaucaagcaugugaacuguguuccucuuagcuuuuuggccaagacuguacaacuaagaacaaaguaacagcugcuccccugugaaaggucauaguccucaugaggccuaagcaggucaauaaauggaaaguggauacuuaggcccuccucaaccaugaggccagagccccuguuuguggcguaauagacaguucugcuacauucacugucagaguaauaauuaaagaaauaggugcugcuucuauaagaugcagaauguaccuauuggaagugaauagaaaaguaagauggaauguuuagcaguucucuauaugccauuuuauuagaaaugucucuaagucaaauucugaaauuaugcuuuaaacaaauauuugggauaugugugcucuuugaccaguuugaaguguuaauaacucugguuuugguauauaguuacuuauauaagcuaauauaccuguacacacuaacauuucuacacauacuuuguucuccuuuccaaaggcuagugaaaacuuuaguggcugacacuccucuaacugcgguagauuucaugccugauggagccacuuuggcuauuggaucuucccgggggaaaauauaucaauaugauuuaagaauguugaaaucaccaguuaagaccaucagugcucacaagacaucugugcaguguauagcauuucaguacuccacuguucuuacuaaggugagacauuuucuuuucagcauuuuuuauuuuauuaaauaaaucuaacucagaauauggaaauuauauguggucaauuaaacaguauaguuuuguuucauaauuacauaaugauuuuacauguaauguauaauaauuuuaguacaaagccauuugauauuuaguuuuaaaacuuuuuuucuuuuuuuuuucuccuuauauaucucucuuuuuaaaaguauuuuaaaagacauuuuaauuuagagggaaacucaggucugccagcaagcuuaagauuugcaaggaaaaaaauauauuuuuuaaucuaacagggaauuuauaaaauauuaauguauaguaugaaacauuaguaaccugagcuuuuaaauauuccauuacauuucagucaaguuuaaauaaaggcuguucaaauaagcccacaacagugaacaaacgaaguguuaaugugaaugcugcuaguggaggaguucagaauuccggaauugucagagaagcaccugccacguccauugccacaguucuaccacaaccuaugacaucagcuauggggaaaggaacaguugcuguucaagaaaaagcagguaaauguugcuuauauauuguuggaggguugguuuguuuuuuuuuuguuuuuuuguuuuuggcuugcauauaauuagcacauucuucaagaacauagaacucaaauuuauuugaguacuuagguaaaauuaguagaagugaaaaucauugaagaagugaaaauaguaacuuuggcuauuaauuucaaaaaugauaaaaggcccuuauuguuuagcuaaacuucucuugugagaaauauugucuuaaaaauggaaggaggcuaacucagaaauuauucauccuuaauacuacuaaagacugaauggcuuuucauugugucuucagauuaaccaguagaaaauaugaaacuuugacacugucuuaugauuugaucucauuaaauaaaaauaaaugagaauguugcaauuucuaaugauuucuucuucucucauguaauuggcgaaacaguucugaaacaggauucauuuagacuuuauugauguguuauaugauaagcuuucucuuauuguagaaaauauuucuugcucacaauaaaaaaauauucuguaaauuccugaaaaccuuuucauuuuuauuuuaagaaguuaugcuauacugucaacgugcaacaaauacuuuagaaagucuacaugguauacuaguauguuucugaaauauugugcuuaguagaaauacauauauccaugucuuuuaaauuuuucaggauaaauacuugggcaaaaauauuuauugguguuuuuuuuuagcaugauuuugcuauuuccaaguagaagcaaaacuuuaauuuguugaucuugauaguguggaguaguauuuuaaaguaaguauauucacuauaaauuuccugugaauaucuguaucauccuuauauaagagccauuauauauuaggaaaauaauuaaguucuuauuuaggaacuccuggagacaaagacaacugauaucuacuuaaggaagaaauuauuuuugaaauauaacuuugaguaaugucugccaacauguugaauuaacuauauuaugaaaauuaucuuuuuucaaaauuuucaaaaauuaaacaaaauaaagauucucucauucacuguaaacucucugaagucucuccauuauucauuuaguuuuauaguaagaaggcucuuguuuaacaaagacagcauuaauuugcaaaucaaaggcuuggaucuuucagggucauggauuaacgauaacucuugguagauucccaacauuucuggcaaagugagugcucugcccccacaaaauuaacaauguuuguguauuaauuguauuuugaaaugauugucaucuuacagaaaaguuuuaagaauaguacagauaacuccugagcauuacccuuuggcagaugcacuuuauaaauuuugccacauuugcuucaucauucucuuucucuuccucucucugucucucauucucucucucucucucacacacacacacauuuuucuuugccucugaaacauugagaauaguagacucagucucagaucugucacuuccggccaggaugcuuuuaggcaauucucuuaaccuuucugggucucauuuuuuuccuguacacauuuaagaugacauuuaacuguuaggguuauugugaaaaucagauaaaauguauuggaaguaccuggcacaugguaggcacucaguacacuaugguguugauacuaucauuguggucaucaugaucaucacuauuauuauuuuaagcuuuguauaaaauuaaaguucagaaaaaaauucuguugcuucuauugaaguuguccugauucaguuauuucaaagaacuucucuaaacuuguuauugguacuuaguuuuagaaggaaaucaccauuuaagaagaaaagaauaagacuuuagcgcuguuuucaaaugauaccaaacuucuguuuccuaaaguuucagaggcugaguuaugcauucaaacauguuaaggaccuagaaaaaaggagaggaaauuucuucuuuguaacaacugaacucuugcuauagacacucuucaacaauaguacaaaugauuugguaauauuuuaacuuuauagcagguguuauuagaaaaguuuauuuuauucgccagucuugggcauuuuuggauaugcaggcuguucuuuguuuucaucucagacuuuucaguuuuucauuugggccugagaugccaaauaaagcacuuuuuaaaauguaauacaguaaugugcuaccaauccugauggcagacuuuaaucaaaauuuuugaaccucuaaaacugucguuacuccaguaaugaaacagaagcuucugagccugcugagcuccucuuaaaaggucccuacucuaaagccauguguuuauacacugccagaaaaaauaaacugcugccgucucuuuauuguugucuaccuuacuauucuuuaugaguuugguguucugguuugcuuccucuuugaaacuauggagguuagugaagucauuugagaucuguaaugcugagggcaauguuaagcucccacuguuagugaaagaaaagacagaaaaccccuucacugcaagucagggaagaaaaguaacauuaauugaauccugcuguauguuaggcaucgcucuauaugccuuacagacuaaaaaaaaaucacauuuguagaugaucaugagucagucaauagcaaaaguaaguuguguucaguguacuuuaagagagcagcaaaguauauaaauuauuuuagaaaaauuccaacaaaauggcuaaaauaagguauuacuguaugaacaaauaagcuguuuucuuuugaggaaccuuuuguuccaugaaaauccugguuaacuuuagcucuugucauauucuguuuuauuguuccaugaaaauccugauuaacuuuagcucuugucauauucuguuuuauucuccuuaugcucauaguuguaauauuaccaacaauaugagugauacauuaauuuuuacaaccuagcuuaugauaaaauuuauuuagauguaauaacauugauuuuuauaucuaauuccuauaagguuugccucgaagcauaaacacagacacuuuaucuaaggaaacagacaguggaaaaaaucaggauuucuccagcuuugaugauacugggaaaaguaguuuaggugacauguucucaccuaucagagaugguaagucuguucagaggauccuguucucuugcugguaguuaauauuuuuauucuggcuaaaagaugugaauaauagcuucaguccaacucuauucacggaucaguuugcuaauuuucuccaucccuggggugguaucuuuuucuuugcccugauauuucaaauguuaucauuguaaaauauaugcugguaauuuucacaugggaauuaugcaaauagcucucaaguuagcauuuuaauuuccacaaaaguuucuugaaggaaguuuuuaccuucauaggcaaucugucccuuguaucuacuucuaaauuaauguuccuaaaauuuuagauguuuugguaugcaaaaaagucuuccuaauuuaaaaaauuguguguguauagguguacaccucccaccaccccauaaaaaaguuggcauaauaaaaagcaaauuugccagcuugauaaauagaagcauuauuuguuauucuucauagugucugaacuaaguacauuguuuaggugugucuuuuugguacuaacauccauaauguuuuucuuaguggaauggaguuaccucauugcuaacagcaauauuaauaacauggauacauuucuagaggguaauuugacagaguuaauauauucauacuuuuuggccuuguauuuacauuucuacaaauuuaucucagaaaauacucagagaagcccacaaagauuuguguauuuauuauuauaaguguaccaugucaacagcaggaucucgaaguuguuucauccacucauuaucuuauacaauuucauuuuuuacuuuaaaauugucucuuuuccaaauguucuacaauuuuauagucagaaggaauaaauacauacguggugguacagaauuauugaguaucuucugccuuacccuggccugcaaauuucuauuuaaauugcuaagucaaacugaaagaggaaggauucuuuucuuucaggaugaagagaagucgaacuacaucaaacuacauuguaaaggguaaacagagggacggauguagguggagagaaaagugacuagugcuggaguugagaaagguuucugggauuagugcugaauugcgaguuuuggccagugagacuccucuggaggaacuuuugcauugaagaauguacaaaggggcuuuuuggaaguguuugaguuauaaauuaaauucucuuuaauaguuuuuaagacaaaugaauaaauuacuuuuuucuuuaauuacuuuugcuauguuuaaaaauguuacuagcauuugagucauacgcccuccagauucauuaugguuccaaaguauugauaaggaagcuaauaacuucuaaaagugugcauguacaugcugugcaauuacugggaacauauacacacaugcacauagaugauauuucuccugauauaguuguguguuuauuggccauuugaauuucuaguaaauucguuaaugacuuuggcucauuuuuaauucaccuguuaaauuugaauuuuacaauuuuuguuauggacuggcaaaugaauauuacaggauuaaaauaaucuuauacauauucuaccauggaaauaaacacuaauaaaacuuuguucugcuuugcaaaauauuuuuguauuauuucaauugauccucaaagcaauuuugugagcuuaucuggacauuauccccauuuuauagaugcagaaacugaaacuuaauugcaucugagacuuguccaaggucacaaagcuauuaagugguauaggcagaacuggauuauagcucuccauaaccuacccccuacaccagggcuuguuacacuauaccuugcugccucauuaaaugacuguacuauagaauuaucuguucauauuugcugcuaaagugugaaugaagcuaaaauaauguaaaagagaaauuuaaaucaguauucuccuaccuuuaacaucacucauauuuagcuuuuuaagauuguuagucucugaacucuuuggggaaugaauaagaagccuaaauugauaugguuucuuuuucacuaguuuuaaaauuugauuuucuaauuuguuauagaugcuguaguuaacaagggaagugaugaguccauaggcaaaggagaugguaagaacuacuuagaaguauuuucgugaaaaugaaaagugaauuguauuaucuaugcuguguaacaaaucucuccaacacuuugaggcuuaaaaaaauaaacauuuaucgucucauaauuucuguguauuaagaacugagcaugacuuggcugaguaccuuugccuucaagucuaucuuccugcuucaaucaggaugucaaccagagcuucauucaacuuaagacucaacugggcagggaacuguuuccaagcucauuccuauggcuguuggcuggagauaucaguuccaugccaaugagcuucuuuauauauggggcagccaacaacauggcagcugguuuaccucagagccggugaacaagagaauucgagagggcauccaaaauggaagcccucucuuaagauuauguuaauaaccuuaaucuugguagugacaucucacuacuuuuucauauuacuuuuguuagaagcaaguuacuagguccaagccacguucaaagggaggagauuacccaaggauagcgacgccaaaggcaggggucauuagaagccaucucagaaauugccuuccaagauacauaccacagauauauaccaaauuaacaauuuucaguuaucaagaacuaauacugacuaaaacauuguguuuugcuguuuucaaaguauuuucacaaauaauaucuuugaagccuuaccacucugggagauggauaucaucauuuacauuuguagaucgggaaauagucacagaaaguuuaagacuuuugcccaaaaauacacaucaauugcgggguguaucugagaaacaaaccagucuucagaaugcagauccauaucuucuuccauguuaaucugccuaucauguuaaaugcuuuucuucaauguccaaaauuggaggacaccauaugcacaugcaguuuuucccuuuuccaggcuuugacuuucuaccgcaguugaacucaguguuuccuccaagaaaaaauccaguaacuucaaguacuucaguauugcauucuaguccucuuaauguuuuuaugggaucuccagggaaagaggaaaaugaaaaccgugaucuaacagcugagucuaagaaaauauauaugggaaaacaggaaucuaaagacuccuucaaacagguauuugccugaaaaugauacugaacucacuguauguguuuaucaguagaaaguggguggcugccagugcauguauccuaauuauuagcauugcuaugcacuuauucauaagucuugaugucagauuuuaauaacuacagaauacuuugaaaucucgcuuuggauauguugaagguuacagcagauggaaaguugcaguauuuuucuaagaugagauacuugauauaucuugauaaagugugcaagaacaguuuaucccugaauccuuuuaaaguguauuucauugcaguauacaacaucaaguuggugguuaaaucauuagagcaaacugauggugcugagaauggaauuuaucauuguuacuuucugcuaaaauauauauauauaauacagaauuuaauuuuuuauguaaggguucaaaaugaucaaaaauuaccaggaaggccaagccaguuggguauacaauaugucuguauuuucguauuuauuguuuagaaugauauugaaaagauaccauguaagaaguacaaaaacaucuuuugauuuauuuugcaaauauuauugacugguuaccacaugcaugguguuuuuguuuuuguuuugccaguuaucucuauuuuaaaugauacuuaacagcaggugcuuaguaaaugagcuuuuccucauguuauuguugagauuguuuuugauuaguaaguguuacuuuauuuugccuccaguucucuuuuucuuuuucuucuucuauaucucuuccuauuuuccuucauuucuauuaaccuacauacugggacaaaagagagaaguaggcaaaaauuauauggguaauaugaguaaaaaaauuguauauuaaagucauuauuuauuuuaaauauaaaguuagcaaaguuggucacaucuggugcugaaaguggaaaucuaaauaccucuccaucaucuaaccaaacaagaaauucugagaaauuugaaaagccagagaaugaaauugaagcccaguugauaugugaacccccaaucaauggauccucaacuccaaguaaguacaugaaacuuccugauguuugaaaguguuugauugaaaaaucauccccauuauuuaacuuguaaaggagaaauagaguaaucauagacuaaaaauguucaaagaguuuaaaguuuguggacacuucuguugugugaguguuacuaaagacaaugaaauggauaugaaucguuaaauucagguacguugauuugaucuuuuggugugaauuagauuuucaguguaauaugugucuuuaauaugguagagauagaauuauuauguaggacccuuugaaaaggguugguuaacuaccugaaaaugucuuuuucucuuucauauuaaagucuuauccuuagaguuugugcugcagacccauacaaacuucaucacauuuaaaggaauauuugguuuaacucuaagaguuaucuacacaaagcaacucuuuguuuacaaucaacucucauauaaauaucuauauuuugcuugaaguuuucuguggauauauauugcauuagcuuaaacucuaaggcuuuuccuguagcaguacuuuacuccuauuuuccuucgguuuguuuuuaauagucuugguuuaucuaguuuauggugcagcuugucacauucaucuuuuauaagaggaaaugguucauagauucuucaagauuaaucccucugucaugugguauuacauuagacagcuggcaguuuauauauauagauaaaugacuauuagaaauaauguuauagaaaguuucuaagauuuguauuccagacagugaauuuuucuaaaugucacaggaacacucuucuuugccaguuuuucaaguuugcacaugccaaaucuuauuuagaaauguuugaugucucucaguccaaguugacuauuaauauuuucuucauucuuuauuuuagauccaaagauagcaucuucugucacugcuggaguugccaguucacucucagaaaaaauagccgacagcauuggaaauaaccggcaaaaugcaccauugacuuccauucaaauucguuuuauucagaacaugauacaggaaacguuggaugacuuuagguaguaauugagaaacuacuccuucuaucuagaccuuacuuguuuuuuuuuuagauguaaaaccagaacuauagauaauguuguugguuacuauugucuagguucugguaauccuaaagccauagaaaacauaaugaguuuuguugaucuuuucguacugcauuuauugauuaugagccaggaaaaggcacauuuaccuagggcaauuauuagguaacucagcagggcagucuagcagguagacugccauugugaacuuuuuuuauuauuaaaauguggacaaguucugguaagcuuaaauuggguucuuaaccugcaguauguucauagaucuauuagguaugcugugugcaauaauguaguagaaaaagauacuuuaaagcacaauucugaauguuuuccaauagaaugcaucagaauguaauacuuaaucuaaaaaaaauucuuucucagacuuauccuugucugucucauccuucgaauugugaacauucuaagaauguguucuacaaugcugcuuucuuuuaucaucucaauauuuuuggaagcuaucuucaauuauuaaaaucauuggugccuuuuuuccuuucuaaccuauaguuaauguuguagcucagauuuggauuaccguaagcaagaauguuggagaaaaugugcaguuuuuguuggugcaugcuuccuuuuaauguuuuaaaauacuuuuaaaauauauuuuuaaaugucgaaaaauacuuuuuaaagaaaaauuguaauuuuggcauuuacccuaccuaguauauguaccagauacuaaggauacaucaaaugaucugccacaaaggccuugugauguaguugggcuaggugcaguguguucugccauguguguuucucuuaaugugaauuaauucauuugggaucaguagaauagaacacuguugacaauaugaugaggaaauuuuguuuguucguguaauagcagccaaaauaaaguacaccugaacacagcugaaugcagcaaaccccgucagcauccaucucuuuuuauucacuuccucuuggcuuggcuguguggucuguuagaaguacuuauuuugugauuauuucccaucuuugggcauuuugcucuugccucuguaacuugauagccgcaauccuucuauccucuuccauuaagugaccaucacuucuucacaguaaggguauuauucaauaauuaucuauuagauuuuuacuaugucuuuuuaacuauguuaguauuuuuauuaggauuuaauuguuuuuguugugcucugguuacaaaguugcauagguuuuugagugcuuugcccuaauccuuuuucccuaaguucuguuauuuuuaauacacaguguuaaagaauauacguuuuuuucaggagugcauaaauauuuauggcauaauaguagaacugucuggauacagcugacuauaauacagugugagcaaagugauguugaaaucacagaaagggagcaguucuucugugggggcagauuuagaaagguacacugaagagauuuuauuuuauacugaugugugugggaacagcuugagcagagacaugaucauacauucuaggaauguuugcagagagaaggcaccgugguaagagaccaggccugagggacaguugugaaggucuuaacacacagguaauggagagccaucagaguuuuuaagcacaggaguaaugggugcugucuauuuauuacccauuuauucaacaagcauuugggugucaguucaccacuggcuucagaugauuugaggacagugggcucagggccuuuccuucagcagacccagggaucugagugcuggagcaacucugaaaucgcugugcauuucugcccugcugccagcuuucgggguggcuggagcuuguuuuucacuaucuaaccuguuccuggcuuucugugccucaggagaagugugucugucccacuuucagcccugcagagcugcugcagcacguuuggugaagacguacagucagugccucuugguuuugcugcccugugcugcaugucugcaccuaggagugguggguagggacuucucucagcucuucugcccuuugaccauaggcagccucugccugggacgcagugaagacccagaguggcucagaggauuuccauaaauucacuuguuuugccauuugccuagguguucaucagacuagguguucaucuacaccuaucauuggcaggacagagaggguauugaggaccucuuucucagccauccucccguggcugccaucuucuccaugagagccuggagugccuuagagggguuacucucaguucuucucugcugcccuaagguuucaccaggcucugugcaucuguaucuuagggagucucccucagcccuccuguuacacuugucccuacuuuuuuuacaugagcgcugaaugaaggcuugugggaaaaaguuggugaguaaauugagacucuccuuguggcugggaccccuuggaauucuaaacuaucaagcaguguuuacuuggcuuuuaaaaaucuuauuaaaauuucagcuaguucuuuuuacucugucaagggcaugaagaugggucucuuuucuccuagucaugggucucuuuucuccuaagaggaacuccucauuuucuggauuuuaguucauuuagauuucuuuccauucucagcucucgguugaauuuaaaauaauaugauuuuauagguuaucagguuuguuuucguuauuagaguugagaaauuauacuuuugcaccaaccuaauacauccuaaguggaaaucugugcaucuguuucuguugucuauuaagaagauuuaaguuucuuuuggcaagcagaucccuuugauccuuugguuacuagguucagguuuucuuagcacuaguuuguuuccaguuugccuuuauuccuaguguguagucuuuucuaggacaucagcugaaugucuggaguauucacugucuuuuuuaccuuggugggucccaaacuucagccucuauuuugccagcaucacaagacuuccagaauacuuucucugcucuuuaguuacuuguuuuuugguugguuuccugccaucuaacccagggggagcauugcuuagaagucaacagaugucuugaggggaaauuccacaguuucaggcuuaguuuucugcaggccuccucucuucaagaccuuggcucuuacagccuuggcuaccuugguaggcccaaacucuuaauacucccccacccagcgagacuaucucaaccuccaggccacugcuucagcucgguuucuucuccacacuguggaaucagcacauacucuagaaggaaaaacagagguaaaugaagagcuuaccuaguagucuuucguuugcaagaucauggcccuucaaguccuggcuaccucaaugguucccugauacaguguuuuuguuuguuuucaauacaguuuuuacuauaauugaaaguagaagaggaaauuuuuaaaaauacccucauaguuagaacagaaaaacaauaaguuacuugggaauaaaucuaccaaagguagugaagauuuuuguagaaaaacauuaaaaauuuuuuuuguuuaaaagcauuaacauuuaaauaaauggagagauuauaaagauauuaguucaccuaaauaggucaguagauugaaugcaauuccaauuaaaaucccagcugggauuuggaagaagaugaugaagugauuccaaaauauguauggaaggaaaaaaaucuaagaauaacuaagacauuucagagaagaauaagguugaaggggacuuauuugucagaugaauacacuuaauuauuaaaguauaauuaagauauauagcauggcacagggaugacauacuggccaaaggaaugaaauaagcuggaaagaaaccuaugcauauauggaaauaauagagagguagcauugcagauuuaugugcaaaaaauggaauaaucaguaaguuguguugugacauuuguuuuuuccuguaaaaaauaaguauagauuccaugcaauugagaaaaaucaguuccauguagauuaaaaguugacuuuauaaaaguuuauaacuucaugguaggaaaucauuaaaaauaaaauaaugcacugccuauaaaaauacauugguaaauuugacugcauuauuaguauauuugagcacauuaauaagaacuauuuaucacacaauaucacagagugaagggauaagaagauaccugcaguucucauauaaauaacaaaggaucagauuauguaaagaaugcuuauaaaugaauaagaaaaagauaugaaaaagcauuucaaggaagaggaaugguauaugaacacaggaaagauauucaacuucacaauuaaucagagaacuaaaaaugcaaugagauaccgugucacaccgaguaaaugggaaaauauaaaaaaucugguaauacuaagucuugaugauauagagcaagaagaacucuguuauacuggugacauccauugauaacuaccuuuggaaaacaauuugcaugauuuuguaaaaguauacacuugaguuacaguugguuauaucaucaauggacauuggcacauguggguuuggagauaauacaugauuguuuauaacaacguuggaauaguaaaaacuugaaaacagucaaaauauuaacaggaaaauagauacaccaguacaaacuaaugauauacagauauauaaaacaugaaucuucaaaacaauauugaauuauuucuuaaauauaagcuauaugguacccuuuuuuguaaugcucaaaaacaugcacaaugaaaacauugacuacagauuauauguuauacaaauguauuaaaaaagcaaaagcauuucuuuguccaacaaaauucaggagaguaaugacuucuuucuugggcuuuuucccaagaguuaagugauagaaucagacaggaacacacaggaagcuucuauuauuugguaauguucuaguucauaaguuguguggugggugacugaguguuucuuuuguuauuauacuuaauaauuuuuacauauucuuuuguaggcaugaauuaauuguauuuuauugaguaagccaugcuauauccacccaaauugccacuuuauacugaaaguacauuuuuucaauagcuaaacugauaauaauaaaaugaucuuucuaaccuagugaauuuucuguauuucauuguaagauaaguuugugucuuaaugacaauuucuauauaaaggaauauaguaucggagaguucagggguuaaacagccuggguuuacauccuagcuccaucauuuacugguugugugacuuugaacaaguuauaucuacucugguuaaguuauuucuuuuguaaaauggaccuguaauaauugcaucuacuugugaagauauuuuaaacgaguucuuacauuuaaaguaaaggaaacagugccuagcacauagugaauaaaugcucagugcauugguauuuuuauuauuauaguaauuauuaacauucaguaauuuggcaaaugaaaaaguuuagugaguuucuugaaugaccuagaauugguuaaacuauuguaauucuaaaaaguauuuuacauucuuccuagagaagcaugccauagggacauugugaauuugcaaguggagaugauuaaacaguuucauaugcaacugguauguauggcaaauuuuauuuuaauauuuuaaaugaaaguagaguugugugaauuuuuaaaaauccaugaaagguaauauauuuuaguuguuuuguuuaguuucuaagauaaauagggaguuuuauagacuaaauaaguaaaauagauuuuaacuggucaccuccuuuuuaaccucugagauacuuaagccuucuuuuuuccauggcuuucuuccugauaaguaagcaaaaagcauuuuaaaugugcaaauauaaauuuuccaaauauacuaauuucaccaacgaucuuccauuuauauuaacaaacuaguaaguuguuaaguacaagaaauaucauucaccuaguuaauugaacaugagagaaaugauagcugaaaguauauuaaacauagccugccaaauaaaugugaaauaucaauaauuuaaaaagcauuuuccuguuuuucuagaaugaaaugcauucuuugcuggaaagauacucagugaaugaagguuuaguggcugaaauugaaagacuacgagaagaaaacaaaagauuacgggcccacuuuugaaauuucagugaauaccuuaauguucuguaauuugggaaguuucuggcaacacagaacuacauagaaucaguauuguuuucauggccuccagggaaaaaauguuuuucaaguaagaguaaaaggaugaugggauuuuauaccaacaacuguuucaucuuaaaaauauguauauuuuuauauuaaaaauuguacaguaugucaucuacccaauaggaaagucaacaggaucuuuauuuuuugaaagcuuuagccauccacuaagugcccuuuuucauaagagaagaaaauugugcauaaaaauugguuauguuuguuuuuuagucaucuuuuuuaacauauauuuuugauugacaaauugccuuucaaauuuuu

SEQ ID NO: 14527 - RNA, 5982 nt, Homo sapiens
uaugggagggcucuggcguccuggauggaggugcguuccuuucuguggcuggcgcuggauccacccugggucuccaaccagggcugcagagaggguagagccguuucuuaggccagaguggagugggacaggaggugccgagagaggacugagguggcuugggacauggaagcgcugcagccuucgagcccggcauccagcauugcagccgccgcggcggccuaagagcucgaacccuuucacacgcgcgcaggaggaggagcggcggcggcagaacaagacgacccucacuuacguggccgcugucgccgugggcaugcugggggcguccuacgcugccguaccccuuuaucggcucuauugccagguaggggccggcgccgcccgcaggguggcgcagacgcgagaggugggggugcaagacaaaucccgggacaagcccucgcucugcgggucguagguggaagagguuuccgauauuaucuaccuaagaggagagagguucaaaacagucacuuaacacccaaagucaccaaagaaauuggugacaaaacugcaaguagcauccaguucuuagugauugugcuuauaccaugcugcagagugaaaccccugaucuaugaacugcaccucgccaaaaaaaaaaaaaaagguccgcagccucuaaccggguaucuagcagucugccuuacccuccugcgcacacacgcuuuuaaaauguauuauucauacauucacucugcaaaccacaugugguuuaugugccaaggguaacucuggaaauuggacuacucguguuucuugggcuuaaacugggauuagcaguuccuccguacaaagaggcaugaauuaggccuuugaggcucucucgccccaccccuguuaauauauaacuguaauguacuuaaccuggaaacuguuaaguacauugcaacgguucugggaguguggcgcccaggaccggcagcaucagcaucacccgggaaccuguuaaaagugcaaauucuagggcccgacuccaggacugagucagaaacacgggguggggggguggggcggggagaagaaggggagugggaccagcacucuauauuuuaguuaaguccuguaguugauuuugagggcaaguuuugagaaccacaggcaaagacaaguuucacguauuuuagagauuucuccuuuguucuuagcuaauaauuugcagcuuuggcuggccauuaggaucaccuauggagcuuaacguuaaauacacguuccagggauccccuaccccagagauucugguuaggaagucuaggguagggacaggaauuucgguuuaaaaaucaugccacaagugauucaguaaguguuuaagauaguggcucccaaaauucauuguacagcaacauugggaaucaccuggacagcuucuaaaaauccacacacauuacccauuuuaucacaaggccacagugggaaccaggcaucaguaauugucaaguauguuuuaggugauuccagcgugcaggaaaguuugggaauuguuuuuuuaacaccaugacugguauucuuagcuggaguucacucuuuccgugugugugugugugugugugugugugugugcgcgcgcgcgcacguuuauuuauuuaaauuuguagagacgaggucucccuauguugcucaggcuggucucaacuccugggcucaagugacccuccugccuuggccucccaaagugcugggauuacaggcgugagccaccaugcccguggaaaucaauuuaccuuucuuuuagaugaugaagcagaagacaaaaggacuuuucuuuucuggcauagucuccuaaugccagcauuuaugugggaaugugcaauaguugauuuugaggaugaguauagaaugugaauuacuuuucaucagagaccaagcccaagcaugaauucuaaaacuaccaguugguuaaaucauaagcagaacugaauccaaaucagcaaaucuagauccuucucagaccgccaggagauuuuugccccucagggaacauuuagcgaugugugaagacauuuuugguugucacaacauggagguggggguauagggugcuacuggcaucuaauagguagaggcuaggaaugcuacuaaauaaccaacaaagcacugccucacccccaaacaacaaaaaauuauucagcccaaaauguccauaguucuaagauugagaaacccugccccaaacugaaauaacugauaauauugcgugugaaaugugcccacaugcaaucauagaucaggaagccaaauguaauuuguaaucuaucagguucuuagagcuaguagcacaacuagaauagagaccaggacaucuuuuuagugcuguuuucuagucuuuuugucuauuuuacuuuaggcauugaacuuagaaauuugaacccauauucaaagacuauauuggaaucuuuauugagggaggacacuuaaaaguauuuuuauuuaagugacuuaaauuuuuuaguaaaagaaguuacaucuuaaacacagcacucaggcagaaggauaaacaaggauaaaggcuugcccucugaugcaucuuuuagggauauaauguaauucaguaauguugcauggcagucaaaugaaguuaguugacuugcguaacaaacagagaaugcuaaaacacuguaucuugcugggagucuuccccuagccucaaauuuguuuuuuguuuuuucuuccuagcauaguaacaggcaaauuauccagaaaucagaauucuggcaaccucaaguaucagaagaaagaugaccuuggaaguaagggcguuuuuuuuuuucuuuugagauggagucuugcucuguugcccaggcuggagugcaguggugugaucucggcucacugcaaccuccgccucccggguucaagcaauucuucugccucagccucccgaguagaccugggacuacaggcgcgugucaccacacccggcuaauuuuuuucuauuuuuaauagagacggggguucacuguguuagccaggauggucuccaucuccugaccucaugauccgccccccguggcuucccaaagugcuggguaagggcuuuuuuuaaaagugaugucaaggaaauaacugucaugaauaaaagaaaugucagacauaaauacucuugaugcccuaugauuauuucuguggccauagggauuaggugcucugauuagugauuuauauaaaagcucuacuauacagagaaguacagaaaagauucaaaaccauuaaccaacgugggaaaauaccugugauaccuuagaaaagcagaauguuaauaaaagugaagcuacaaucuuauuuggauuauaaaagcugugauauggaaaaggaccagacaggaauauggaaaaauugaguuaaguauuuucaguggaauuacaaggucauggguaaauuuuauuucuauuaaugaaauacuagcaauaaagggaaauguguuuuuuauaaauggcuaagcuggaaauugugaguucgacuaucagugauaauaguugacuuaucuagugaaccugcuuuucccagacucauuuuugaccaugccagguaaccaagggauugcugaaaaauaggaaugacuuuaacaaauacaggcucaugacaucccaaaaguagucagauucuugacacaguuacagcaauggucaguuaccauauguaaacuuggcuccaaauggauuauaaauacuacauuguuuuuaaacuuuuaucaaauaaauagaucaucaacaccuaaaaguauuguuuaacauauuugguaucuuuuucuagacuacuggacuuggaggaucagcaguugcaggucaugccucagacaagauugaaaacauggugccuguuaaagaucgaaucauuaaaauuagcuuuaaugcagaugugcaugcaagucuccaguggaacuuuagaccucagcaaacagaaauauauguaagugacuaaccagucauuaaaagauuacuuuauuaauguaaauuccuuucuuucaucacuuaaacugucagaggacuaauuuuaacacuaugauucuaauaaaacauggcauuuuccauuguuccaaauugacuuuuacuaucauguaacuuaaaaguuaaaguauaaauucuguuacauuagguguaaagcacuauuaaaaaguagucuaugggaauaaaaaaauuuauaguaauggaacccgucaguauuuugaaauuaaguuuagaugagugaaacaguugggaguagcaguaaccgucaggcuauauagcuuccugacuuuuccucaggcauagaagacaugggaaaaauguggaaaagcauugguuacaaugaguaguuuacugguuuauaucaaaaguaucccuguccuucuaaaagaaaacaaauugagggccuuugaaauaaucaauaaguaguaaauaguuauguuauacuccagugagacugagacuauaccuaaacgcuuuccuaaaauuuuaaccaacuguaagaaagauuuuaacugaaaucucauuaauugaggauuagccagagugaguuaauuucaacccauauuggaaaagccuuauaaauauuagugcuugcccaguuuaguaaacaugacugaaucucuuaauaaagauuuuauagguuaugauuaugaaucuucuccaauuacgugguaguauacaaagguauuaguggcugaauugguacaagugacagaauauccuuuggaaaauuuuuuuaagccucgcuauucccuuauuuucuccaaaguauuaacacuuuguggcauaauaaagguucuagucagucaguuuuauucugauuuuaagguaaguuuaauguugguaucuuuuuaaaaaaaauagucaaucaugacauucagguauaaguguuacagaaaaguugggcuagggcugugauaugauuggcuuggacacauuuuaaauaauguaauuugccgauuauuccuugaagaccucaaauauacaagaggacaguucauaacuaauuauggauauuagaacauugguucuucauugacauaugcaaguaaguuuuuaaacucagauauguuuauggguaauauucacaauuuauuuugcugaacccuacauuagauuagguauuauggucugaugaauaggcaaaauaaugagacuaauuuagcagggaaaagaggaacuuugugagauucaaaguauugauaauauauauauucuuuaaaacagguggugccaggagagacugcacuggcguuuuacagagcuaagaauccuacugacaaaccaguaauuggaauuucuacauacaauauuguuccauuugaagcuggacaguauuucaauaaaauacagguacaucaaaguguaaacuuuacagaauaugauaaagauacaugaaacgguuuaguaugaaacuuaguguuuuaguagaucuugugauuucugaaaacgaauuucuucuaaacaucaagcuauuuuucuucacuaucuauaccugcuaugcagagauugagaaccaaaccaaauggauaucugcuuuuaagauuagaauuuguucuucauccuuaaagcagaacucauugagaugaaaagaugcucuuaauuuaucacagaacuguguauuuaauaguaugcuuauuaaaaucacgaaguguacuggaaugcuaagauaaaagaacuguauaguuucuguuauguaauacgagaauagaaauguuauuaaaaucuuucuauaauuuccagugcuucuguuuugaagaacaaaggcuuaauccccaagaggaaguagauaugccaguguuuuucuacauugauccugaauuugcugaagauccaagaaugauuaaaguugaucuuaucacucuuucuuacacuuuuuuugaagcaaaggaagggcacaaguugccaguuccaggauauaauugaagucagcaacuaagucuuccuucaaaguugugauuuuugggaaaaucauauauccuaucuucucaaa

SEQ ID NO: 14528 - RNA, 4816 nt, Homo sapiens
gaacacaaaguaaaacuucugcuguucccaguccugcagccccagcccagccgucccccgcgggcguggcagguccugagucagggccuguccguggccagcaucccugcugggcgauugagcagcgggaagcugcuuggacccagucucaaacuuaacccucaucuagcacccgggcaggccuccuggguugcagggacuugagaaaaggcagaguucucagguccuaggaagcuggggcacgcuggcgugacaagcgucccggagaaagccaagcccucggggagcuggggaccgcagcagggcugcagucacauccugcgcgggugggcggcgggccaggccuucaguuguuucgggacgcgccgagcuucgccgcucuuccagcggcuccgcugccagagcuagcccgagcccgguucuggggcgaaaaugccugcccuucacaucgaagauuugccagagaaggaaaaacugaaaauggaaguugagcagcuucgcaaagaagugaaguugcagagacaacaaguaaguuggcuguuccggaauauuuccuucucugaaaugaagcaggguccgauuuuuccugcuuaguaacaguaaagcaaauaguuuagcuuauuuuucccccuuuuuguagcuucucuucucaccacccuuuggcagugccuggggacugccagcugauguggggaaauccuaggagguagaggagggagcaaggaucugauaaguaauuuaaggccaaauguccuaacuuuuaagaugccuaggaaggggaaaauagacaagaaaucuugcuuuccauuagacagcuguuuuucaaaacucacuuguaggaaaaaagcggauagcuacuugguucuuugaucuuuuacacuacuagaaaggaugauauuugaaagaaauuuucuaaaaccguauuuuaaagucuuacaaguacauuauuuaauuuugaauuucaccaguggccuucagugauaugcaaagaacaguccaccgaaauuugggaacaaaauauuagaauuucuauauuuauuuguaaaucucaucccuuuauaauuuucacuuuauguuuuauuaguaugcgauuaauacaguaguaucuguacuuauuuauaaauaauuauacauacacuguggugcauaugaaaaauuuuuuuagugaucacaauuuuaaaguuuuagagacuauugauagagauuaccauuucauugagaacauaugacccaguauucaauauucuccacugaaacgucucgggaguuuuauaaguuuuacuucaauuucuuacuggucaucaagaccuuccuucagacacuaaucccucuuccuguuuuaacucaaucaggcauccuguagacuaggaaaggucuuugaauagauauuguuuaaagauaauuaaccuuuccucuucagcaagaaaauuuugaacugaucuuauuuauuaugguuuagcacuagaaaaaauuaagaaaaacaauggaaaugaagcguuauaauaugcucacuugccuuccuguucuaguuauaauaaaucuguuaagggcaagagucuucacuguugagugaugauuagaagaugcaggcauuuuuguguuuuacuuuuuacauauuucuuuucucaaauuuaaccuuucacauccaaaucccggcucuuccuagcuuuuauaaugagcugucccuucuaucauguuaaggguuuguagcuuuaaaaacaccaacgcguuuaaaggggaaaaaaaggaaguuacacuacccaaucaauaagcacgcuucuugaaaccuuaagggacccauuuuauggauggcgaaguucccaguacagcaagugcuggccacuuagauauguucacacaauaaaccuuaggaguuacauauuaaacagaguuucauaugcugaaguacagcauugucuaugcaagguucuaauaucuuaauauuugguaucacuguguagaacuuaggaaaaaagacaagcgucuucuacuuacucagaguuuuaaguuaagugauguggaugcaaccgacuauguaaaaauugacuguaucauucauuagcaguuucucccugcuagccagccugacccuuuaggacacggccuguggcaucaacuucccaccuccagaaaccucaaguguaugccagagggagaaaaaacuuuggauauauguaaccuuaggaaauacagaaagaggcaucuaaaucucaacaauaauauuaagacauuugauuauacacuuggaauuauacauuauuauugcuaggcaagcauuggaauguuuagagaucauucaucucccucacuuuaaggauuaaaaaaaacuugagucccacaaaggcuaacuagcuccacauuuaagaccacagagauagauagugauagggcagguacuaaaacauucuucuucucauucccaguccauuauucagucaauaaauaguuaacaucugggcuacguguucaguccuuaacuuaggcccagacaaaacuugcaaguugcauucuggcuguaguuaaauguuuaucaaacauguccucuugauuauggaaggaaauguaucagaggagcaauuacucacauuuggagguuacagaccucuucugaaaccuaaugaaaaaaccuuguaagaaaagauucaauguagggagcauguaucuugcugagaaauuaaccugggacgacagacccuaaauuaugacacgugcauuaucaacucuaaaaauucacuuaaaaugcaugcacucugaaugucaacaaacgagagcaaauguuaccugaaagaauuguauuugaaagauuuuauuuugccagauuuuaagucacacaacuacaucaccuaguuuucaauuugaggucagaggcuuccacacugauuugcagaggauaaucauuugggguguggaaguaaaauguuaacauugcuauuucuguuuaguuuuaaaccucacccauuuauaauuuccaguuuauguuuuauaauuuugcaugauguauuaacaaagcagugucuguacuuauuuguaguuaaaaauuauauucauuuugggauacacaugcaaacauguuuuaguaguaaccguuaaaacaguuugagguuacuaauuuagauuacuaauucaaugggaacauuugcccaguuuucauaggucuccauuuaaauuugcuggugcggccuggcgcggugucccacgccuguaaucccagcacuuugggaggccaaggcgggcggaucacgaggucaggagaucaagaccaugcuggcuaacguggugaaaccccgucucuacuaaaaauacaaaaaauuagccaggcgugguggugggcgccuguagucccagcuacuugggaggcugaggcaggagaauggcuagaauccgggaggcggagcuugcagugagccgagauccugccacugcacuccagccugggcaauagagcaagacuccaucucaaaaagaaauaaauaauuaaauuaaauuaaauuugcugguacuucuguaauuuuuacuuuaaauuucuuacuagcaauacaggccuucauuaaaacccuaauuucuuuucuuuuguuuuuauucuuuuuuuaauucauucuugcaaccugucuuuuaaggauagauagacuuuuugaagaaacucuucuuuuaagaauagacuuuuugaagacacuauucaauuuuuucuccaucucagaaaaaaauuuauucucagauaagccuaauaagucucagauaagucuuuuauuaugaucauugcccucaugcagcaggaagaaauucugaggagcaacacagagugcgauauuuggacaauuccaaucuuuccagaaucaggcuuuuuccaaagcuucuaucauuucgugaaauuucagaacauggcacacacccauaagugagaaucguggcauuacacaccccaaaacauuuggggauuaucuacuacugcaccugcucacuagcauggaaaauuaaaauaagaguauauuucaguuccuaaaauauuguagacauggcauaauuguauuuuagcagaggaaggaaaucauaugagacacaauggaaaaaaacugcuggagaugauuuauuuaaugcagugacuuucaaacauuuuuuaauuugaccaacgaccaacaguaagaaauauauuuuacauagguugcaucauagguauaguaauagaauaaaaauauuagagugcagagcccagauuuuauauauguauuauauauauaauauauacacacacacaugcacauauauauguaaauguaaaaaaauguuuaaaaacuuauuguauucaauuauacuuauuucauuaaggcguagggacaaaguuuaaacaacccuaaccuaauguauucucuuuuuuuucuauacuuaaggugucuaaauguucugaagaaauaaagaacuauauugaagaacguucuggagaggauccucuaguaaagggaauuccagaagacaagaaccccuuuaaagaaaaaggcagcuguguuauuucauaaauaacuugggagaaacugcauccuaaguggaagaacuaguuuguuuuaguuuucccagauaaaaccaacaugcuuuuuaaggaaggaagaaugaaauuaaaaggagacuuucuuaagcaccauauagauaggguuauguauaaaagcauaugugcuacucaucuuugcucacuaugcagucuuuuuuaagagagcagagaguaucagauguacaauuauggaaauaagaacauuacuugagcaugacacuucuuucaguauauugcuugaugcuucaaauaaaguuuugucuugggaagaugagu

SEQ ID NO: 14529 - RNA, 37393 nt, Homo sapiens
ggggggcucacgggaggguugaaggguccaggcucaggguagaacugguaaauccagacaaggagcccauggagaaggggaggggagacuggaaaccaugaaagaucccccaccgcagccucagaaaggagagacugagaaauaaguucucggucuccaggucgguuggagucgugucggagugccagaccaucccccaaaagacccucuuuggaaugagccucagcaaaggcaagcuaggaggucgaaggacuuccccaggugacucggucuagucuagaguucgcaaagccuauccucccuguagccgggugccaagcagccucgagccugcuccccagcccaccugccaacaaaaggcgcccuccgacugcaacccagcccuccacagacaggacccgcccuuucccgaagucauaagacaaagagagugcaucacugcugaaacagugggcgcacacgagccccaaagcuagagaaaagcuggacggggcugggggcggggugcagggguggaggggcggggaggcgggcuccggcugcgccacgcuaucgagucuucccucccuccuucucugcccccuccgcucccgcuggagcccuccacccuacaaguggccuacagggcacaggugaggcgggacuggacagcuccugcuuugaucgccggagaucugcaaauucugcccaugucggggcugcagagcacuccgacgugucccauaguguuuccaaacuuggaaagggcgggggagggcgggaggaugcggagggcggagguaugcagacaacgagucagaguuuccccuugaaagccucaaaaguguccacguccucaaaaagaauggaaccaauuuaagaagccagccccguggccacgucccuucccccauucgcucccuccucugcgcccccgcaggcuccucccagcuguggcugcccgggcccccagccccagcccucccauugguggaggcccuuuuggaggcacccuagggccagggaaacuuuugccguauaaauagggcagauccgggcuuuauuauuuuagcaccacggcagcaggagguuucggcuaaguuggagguacuggccacgacugcaugcccgcgcccgccaggugauaccuccgccggugacccaggggcucugcgacacaaggagucugcaugucuaagugcuagacaugcucagcuuuguggauacgcggacuuuguugcugcuugcaguaaccuuaugccuagcaacaugccaauguaagugccuucagcuuguuugggggagacuggguagagagguuagaugggagggcacccugcccugaaaaggaaaaccuguaaccugaauuccagguacacuuggagggcagacucucaggcaugugggaaaacgccggaauugauaagaaacauggaaauuacuuuaaaaaaugaaaacauaaaagccuugccaaaaguuagggaacuuuuccucuaaguucagagugagacaguuaacucggucuggcuccucagcuuaguaacccccaaagggagcggaaggucuuuuucccuaaggaugagauauuaacgaccaaugugguggaggaagucaagggccugcaccccacaggccccauaaccgcacugauguccaccuuguaaaacuugaggccugcguuagaaagcccuucaacugaguaauguaaaacucaccuccuaagagcuuuuaucuucugggcauuguaaggcuuguccggaggaggaggaugacgaugcugauaugaugaugguuauaaggcgcccucuggaggaaggaaaaugaaaguacaggggacagggccuuaagcagauggaaucccaauuaaagcuucuacggauuuauacagauuaaugaucagcauuucugguuggagccuuucccaguggcuagucagugaacccuggaaagaagaauggaugcuacuuggaguggguacauucugaaaaguaauauaagugucucaauucacuuucuagucauggaaaugguaacauuuuuuaacucaaaucugcucuaaauuuuguuugagccugagaauuaccccuuugacauguucccagugauaagcaaacauuaugaacgcagcaaguugagaaauaucaacauugagaugagacucaagagaccgggguuuuucccaugagucugacaccaauuugcugcgugacuuugggcaagucaaacggccuuuucuaaaaugugagacagagauuaaagggaccccaaggccacuuuccagcucuagguuccauggccagacuuucaugucaacagagaaugaagaagaucaguccguuuucaucuugaaaauggcugccaaagugcuagacaaagauauugacuagaugggggaugguauugucugaccacacccaguacuccaaaaaguuguuccacccacacagcacggugucuaccacugcauaauuucuaaugcauuugugugcuugugugugugugugugugugugugugugucugugugucugugugucucuucccccuucauucacuuuuaguauacauacuguggauacuaaggaguaauugcagugaacaaauucacauuaccgaguucauauuuuuaaugagaucuugagagugggaggaaagagucggcuccuagagaauaaaaugaaggcagacuuagggaaauuugaagguacaaaggcaacuuaccuucugaucaacagccaaccacagucuggaauaaauguuaucaaacacacauucuucaaaaugguccaugucugaguaauuaaaaggcaaauuuccaaaaucauaaggacuuccguuaaucaagucaggcauaauuauucuuccuacugauggacacaaugaaguaaacauaucauucuuguaauuuaacaguaauucucguaaauugcccuuaaaugucagugcuggaugugguccacccuccuaaauugugacuguugcaacagauguucucacuucaaauaacgcacuucuuggccaccuaauuaaagcaauuuuuggggugauucauccuacugcaagcuuggccacacuuguauccuguauuaaccuauaauuuuuguaccguaggagaagaauucacucuuuaaggacuuauaacaauuauggcaaaaggggggauaguacuuuuguuuauuuuuucuauuauuuuucaagaucuuuaauccgguuuuuccauuuauacaaaacucuuucuccgagacaaaaaugauacauauugguaaaaugaucuuaccuaauuuaagugaacuaauuuaaagcaaaauucagaugucugaauuaauccauuuucauaguuaauaaugugcaaauuagaccuuuugaaaaaggauauuaagaaugguacaaacucaaugaaguacuagguaacuucaauguuuuauaaaaaaguaagucagcuucaauguuucauaaaaaacaaauucaauauagaauuuuaagguaacauacuuuccuaaauuuuaccuuuuuucgauauuuagguauuaaaaaugaucaaaaucauaaauuauuuccucaucaaucuacuagucuuacauucagcgauucaucugugcacuuuaccagcuuaauugcuaagcauucaaaauauccuucagacacauuaauauuucacaacaguuauaaaauaguaaauaauuaauaauuuaauucaaaauacauuuacauauuaauauugcaaacaaaucacccugcugaucccugccauacuuuugaccugcauaauuucuaggucauuaaaauauucuuaaaaaaauauaauugguccuuaauuagguaauucaauucuauaaacuuguuucucuauuuguuaauuauugcuauugauccaugaagugauacuaauaauuguuuccuacuuuuucuuuuuuuuuucuacagcuuuacaagaggugaguaaaacuuuuuuuagaauuuuuaaaaauacuuugauucccuuggcuacagugaugucuucucuuggaagggaagaaguuacauuaauauugaccauccuagauucccaagaaaauugugaagaauuaugauagucaaaaccuuucuggcugccuuagaaaguacccacccaauuuuccaaaauaggcggggcuacugaauaagacuagguuuauaaaauauucauaagaaauauagaguaaauaauccaauagaaguuugaguuuuaggaucagcuucuaugaagcagaagauuucacugagcuagagaaucuuuucacuccuuuggaauuauuugcaaaagcacuuauuguuaacacauucuuagcucaugaguugaauuugaggcauaaguacagguacguauugcuauguauuuuuuguucuguagguacauauuuuuauuugacauguugguaaaauuuuaaauuguaguuugaaauauuaaacugagauaauaguaaaugcauaauguaaugaauugugaagguauauuuguauacuacaccaaaauggaagcuguuuuuaaauauauauauacaauuuucuucauaauaaucuuugauuuauucuuuucuaggaaacuguaagaaagguaagaguacacuacuucuccauaaauaucuaaaauuaucagggauaacauaauuuaacuaaauuuauaguagacuauagaaggaaaauacuuuaucaaaauuuuguucauaugaauauacauuagcuaaagcauaaaauaaaguagcuuugauguuuaagauaacaaaguuuaauuaucuucuggaaucaucuguaauuacauuuaugugauacaaacuggugauuuacauacaaaaggaaaaaaaaagacuuguuuuuauucuggagauggaaggcauauuauguuaauuauagggaguaaaaaaaguuuauuuuaaagggcuuugacuauauaaaugugcuguuaaaaauguaacaaaaugaucauuuaaucuacaguuaucaucuuauucaaaaugcuaugcauaguauugaccuaauagcugaagacuauagcagcuuccaauccuccagcugaaaaaaaauuacguauaauuacaauuaaaauauauacuuuuaucuauugcauugugucaauuuuuuauaugcuaucuaauaacauuguaguuacaucagucuuaccaacuaauuauuaucaagaaugauuuguuuguucacuggaaauuacuucuuaggcauuuauuauuguccuguuuguaucuuuccuguagggcccagccggagauagaggaccacguggagaaaggguguguaauuuuugaacuauaaagggcuucgucccguauuugaauaacuauauguuagaaacuacaggaacuggcaauuuauaagaauauuauguauccagauaauuguacaccccuuuaaacagguaaugcacugcagaagaagcgaaugagcauuauuauauaugaucaauauuuguuuuaggucaaaauuaccguuaaaaaagaaaaacuguuacagucauauucuuugcauggucuacuuucuuuauuuguaauugacccauccaacacaugcauaauggaaauauaucuaccuaccaccacaguccucuuuuuaacacauuucauuugcuuuugaacuaagaucccuuagguagcuuggaaauaauagugaauuaguagucaguaacauguuucucugcucaaauucaugcauguacaagucaggcuuacauuuuauuuguggcauucuuaaaucucccugcuaugcuuauuugacauuuauaacuaugugguuuugcauuguauaacacuuuugccaauauaugaauaccuauaucuuauaucuauuaggaagaggagacuuacauguauuucacucaauuuauuagaaauagaauuaaaucaguuaauuauuuuaacaauacaaguaguuaaugauaguaaaucugcaggauuuucucuccuaugauaaagugaccuuauuaacugucacaucaguuaauucauucacauguaacauaccaaaacaauugaaucaguuugucacagucagagaucggcaauaaaaauacgauguaaguccuugugcacuguuaaacauaugaagcacguggaaccauacauuuuggcuauaauuuuuauauuugaauacuggagcuucaguaugaauuaauauucaauggccgagauaguucuuuaggaaaacuacccugugauaucuuaagaguuauuaacccucuuucuaaaauagacucauaagugaauuucaaucaaugacaaauauaguauauuaaauuuccacccuacuugcacauagaaaggucugaacaacugaucuuaccacauauaauucuuagguuucuacagggccugucuaaccugaccuuacucacuuuuuacauaacaggguccaccaggccccccaggcagagauggugaagauggucccacaggcccuccugguccaccugguccuccuggccccccuggucucggugggguaaggugucuuacguauugcuaacuuuuagcuaacuucaguugaaagaagguuuauuguggaauuuauuuuuagcaguuaagggauaauucuuccauuugaaaauuaguauauuuuauuucauuuauuugguuuuuucacucaagauucugcuuuacccauucucuuugugagcccuugucaauuacaggacuggucuuugugugcacugaaguuagcuguggccaucauuaccauuauuuaauuuggagauuuaauaucuuuuauuaguaaggcacaaauaagagguguugcauuauuaaggauuuugauuagauugaacuguguaagugaaaucccugaucuuaagcaauuuuacaaacauccuacgcuuuuuauucuccuugacuugaagucugcugaaccaacauucaaagcgguuuuagguuuaauuugcuugaaacuaauuugagaaaaguacauuucccuuuuucauuaauaucuucuuuuagcuucaugucuuuaacaaugguaugagugccaaaugaccucacugcaggaaggaaaacauauuugcuuaauugguuagcacuaugaaucagaagccugauucuaauacccaacuguaugucaguaaaauaagaccuuucucccccaaagaucuuauuaugauugcuuaucuaugaauugcauuaaaaagcagcuucuuuaauagagcuaccacuauaagagagaucuuuaacaguaaaguuauuacugugaacuaguuuuuagaaguuuuaucuuccaagggguauuuuaauuuaauuuuccucuaaacuugaaaacucuuuaugcccuuccugaaacuccagcaagaaaaagaucucuuagucauuuuguguagcuccgguggggaagggcaacaggugaaaaugugaagauguccucuugagcucugucuaauuugucaggagcccuuaguaacauuaaaaguuuagaaagcuucccuuccucagaguagagguaaaaggugggaguggagacaccgaguuaaggcagaggaagggcucaaaaaguaaaguagggaaguucuccauuucaaagaggugucggccaaguuuuugacguacagcucucauaacuuuuuaggaauuuaguucaauauagaauuuuaaacuaauaauuauaucaaaaacauugcccucuuuuaaauaacaacagaaaaauauuuacaaguagaaugagaaaaugaacuacaugacuaguaacuaaaaauauuuuauauauauauauaauuuuuuuuuuuuacuucucuagaacuuugcugcucaguaugauggaaaaggaguuggacuuggcccuggaccaaugguaugcuuaucuguuuaucuuagccaaaaaaauugcuaaauaaaucauucauuuuaugucacauuuuaccacgccauuuauuuagcuaccuaaguuaacacucaauacuuagauuauauaaaaacaacucuuuuuguuuucaaauuuaugaaaacauaaguuaaggaguucacuuuucuuuacaaaagaaagauuaauugaucuuuuaugauuauaugaucuuuuugauuauaugauccucauuaagauagaucauauacuuauguccaagaaauaaucuuuggacauaguaaccauaacuugggcaaaucaauuuaauuuaaaacaguaaucacucugauuaauuuuuuaauauucuuuaacauugcuuagaauuuuaagcaacacuuagaggcauagaacuauuuauuaaguucucugaacuuguuggaaaggaucaacaaguucuaucuaguccagcuaacucauuuuaaaaugggagaguuuaagcccuuuucucaaagucauccagguaacuaaugacauaacuagaacuagaugccaggcaagaugucuaauauuugcuuacaucaugguuuauguaccuaguccuugaauaaaccacucauuuagucaacagauauuaaucagaugccuucaaugggcccuaaacuguauuaggaacuggggaaauuacaaggaauaugacagauucugauccuuccucaaggaguuaacaauauaggaaauguuucuuuuucugaauuuugaccaaaaaaauccuuuuuuagucuauugauuguaaaucuauauagaagagaguaugaguaaaaaucuagcauuuaugucacucaguacaaauauucagcaccauacccuaucaguggagcaccgcuuagaaacauucccuauaugaugaugaugaugaugaugacuauuaacaaaugaagcuucuaacaagcauuagagagaaguuugaagggaaaaaugcuaauacgagcaugcaaaauguauacuagcauauaugaaauagaggggaaaacugccagaagucaaaguguuagguugauuaagcacuacagaauuuaauguauacacacacacgcaauuuagugauuuuaauuaauuguuucaaaacaaagguauuuaucugcccaaagucaacaaggucuuuaaaauguaaauuuuaccugggcagugcacuuagugcucuaucuucaaaagaagauguucugcuggagcuaauggcccacaguaagcuaauauacucuaagggugagauaauauuuucuguaaauuaaaacucccacuugagaaauaauguaccuuuaauugacgacuucuaauucccuaauuuuuucugguaguuuaaaauguucauaucugaaaugaaaaaguagaguguuucuuuuggcuuuguuuauauuggauuuuugaaauuagcuguuucagcuaaugcuggacauuagucaguuuuaaagcaguaccuacaucucaagaagaagcaagggggcggaaaguaaagagcuacuaaaugucauuuuuaaaaagcccacuaagcugggaaaauuaauauggauuucagauaccccuguuuucggaacaucugucuuggcauaaagcagaguauuuuacuuugaaauaucagugaaauauaauuuaagcuugcacauccacacacaugcacagacauauguaaucaacagauaucuguuucacaaauagggaagauaggcagcaauaaaguauuaaaauaauuuccauguuggaaaaucaauaacuauaaaaccccacaggguucuucucugaauuaaugaguaaucacagccuccaugaaauacacuacauuuuauguaaaugaaauuguugcaaauacaugaaaaaauaaauauaauuagaaauucaugaugucaaagaaaauuauuuuuuaauguaugccuaaaaagcuauugugauggaaaagugacaguuucuuuuaaugucagagcaauuucuaaaaccaaaugaauaauucuuauaauuaaaaugacauacauuuuagauaaaauccauguuauuucacucuaggcauuaauacaguaagguagguuugacugcagaguccccacagcugaugucaugaacaaauuacuugagacugguacaugaaauauuuucagcauuaugaggaacagacccuacggaugagcuuacacaggcacugauuacugcaaagaggagucaagaaaguguauuuagcuuacaaacuauuaacagccuguuuuacccuacuuuugugcuauggaaacaacaaaggggaaaacaaucuuccaucauuugggccauauuuucaacaauaauaucauauaauagacucuuccagaaggcuguuucaauaauguuuuauuuuuccuucaccccucauuacauccacuuuuguuugacauuuucaucagucaccaauaacccuuagaggagcgauaagguuauaacaaacuucucucuaaucauuaagaaggacuuuugauucuuuucaauuuauguccuuuguggcaauaaaaauaccaauuucuuagcuaaauaugacauaggaagaugacauaugaucaaagauauccaaauggacaugcuucaucugcuguauagaagacaauuguauauucugcacuucugcaaagacugauucacuucauugcaucagaacaaucucaauaugcccaauugugcacaacuuuaaggaaccuaucugccccgucuaauucucauugauuucuguugauaaggauugggagaaaaggaaaagcaaagggagagaacuagugcaggaaguuugaguccuuaaauucuuccuugggaggaauaaaaacuauggaaucaaaccacaacaauggcacugcuaaguuggucauaucugaccccagccaacaccaugacaacuuaucagugcuaacuguugauauaucugcuuucuuuacagggcuuaaugggaccuagaggcccaccuggugcagcuggagccccaguaaguacugaaagcuuguaaugccucuuauguaaaaagacagagaauuaagaaauaaaggcuuggaguaugacauucuuuuuuucuuuuagggcccucaagguuuccaaggaccugcuggugagccuggugaaccuggucaaacugugaguacauuuuuccaccuuugugauaaguuuuuuuccaggaaguuuaugaauauaaccuuagugaaaugaugggucucccauuuucuuaggguccugcaggugcucgugguccagcuggcccuccuggcaaggcuggugaagauguaaguauuuacucuuaagcacuuucaaaaugcuauuuaaauacucuugccucaacaagauuuucuagauucaaauuaaguauucugccaaaagcugaauaugccugacagaacucuuaauguaugggaaauauuauuuuaaugaaauauuaacuaaccuacuuguauuaagggaaagauuaaauauauaucuggauccauauuuuuaugugauaacuuucuccccuuuuguaaaaaccaagauucccccauuuugucugauaguuuaccaagaagaaguugacucuacaauguuuucauguuuagggucacccuggaaaacccggacgaccuggugagagaggaguuguuggaccacaggugagacuuuuuacauugguagauagcacaaacaucauaggccuauaagauaguugcuaaaacuagcaucaaucuaaaugacaacauagaugucacccaaacucauaacaugaaucgaaggcaucuaauaaagaaaaaagccuaguuaaaaaaaaaugcauauacauuuuauucaugcaaauaauggaauauaaaugacagcaagcauaccauaagcaacuaaauuguguuuucuacaaauaccguauuauuaguuacucacauuagagcaaguuaauuugucacucugugcuuagagguauacuagacuuugguucaaagcuugaacuuugaugagaauaaauacuuuggagggaagaagucacugucuuuuuauuuaugguaaaacauuauucaccaucuucuguauuucuuucuaagggugcucgugguuucccuggaacuccuggacuuccuggcuucaaaggcauuagggugagcacauucuuuacucagaagagagaaaaugccuauuaauuuuuggaaaaaacucaaguauguuuaaaaucuugggugacauauacucacuuucaaaucccuggaguuugccaaagggaagaaagaguuaaagagucagauuucuugaaaguaaaguggggugcaauuuuuucagucuguucauagcuaccaaaaaacaggcucacuacagagaaaauuauauagaacauguauuacuuauugaguauuuacaaccgucugaaaaucauaaaauuauuaaggauggaaaagaugugagagaacaccuaguccuccauccuucucucucaauggcaagaaaguuaagugaccuaucuagggcaauagacugaguuugcugggaccuggaacacuggacuucuuucuacugcagcagacaagacuuacccaagagagauuaauggcaaagauauacaauacaauuuuuauuugaccaaacacuaucauggaacagcauuuuauaauaaggcuuuccuuucagggacacaauggucuggauggauugaagggacagcccggugcuccuggugugaagguaaauauuaaauuagaagcacuguuuuuaagcacuugauugaaauuccccaugaccuccaaaaaaguauauuauacugaagacuacccauauuacaaaaaguauuuuuauuuuuuuucuuuccuguacuucaaaucccucaaggauggggacuaugagagucugugaaaaaaggucaauuauuaauauuuauuaaaauucaauaucuauuaaacaauugagauaaaaauaauauuaauaguuucuuguuccauuuccuuuccucccucuauaauuccaguguaucucugcagccaaaauaaaaguaaauaaacauauaaucagagauuacgacacucuguauuauuuuaaacuguaaauucuccuuugccacacacuaauuagauagguacauucaugucgcuauacacuuuucaaccucuuuccugugauuuaucugugcacacucaaaaaaauuuuaauuagguaauuaaagucucagaaguguguuaucucuuggcuaggcucuucucugacagcguuuucaacuauaaaauguucucuuuccuauuaaggagauaaugugauauuaaagugaauaccaacguaauuacaaauuaaugaguaacgaauacuagcgggaccagaaaugaacaugaauauggagaaucuauucuaacuuuccagcugccacacaaauggauaaggucaaacucauucucccaagagcccgauauaacagcucagacuacuaaucacuguaucauaaaauguuagagcugcaaggagcuuuggagacccccucauuuugcagaggugggaaacugaggcuucgugagagcaauugacuugcccaaagucacacaucuagagguuagaaagucauaggcuagaaaugauccccccuugccacuucaaugcuuauucccaaagaauagacuucacauagaauccuggaaauuaaggguccuuaugaggucucuuaaaccauauuuccccuauaucuaaaucagauuaucuuuaaaaaaaguucuuuuacaugugccauaguauuaaaucccacuacuacuacuacuacuacccugguuuuuacucaggauaagaauauagauuggaaauaaauaugauggcucuaaaaaauaccaugaagcuucaauuuuucaugcacauuuuaugaaagugauaacacugaguguucaaaauaacuuuaaaaaggauaaauaugguuacauugaaagcaaauuuauccuuugccaucucuuuuuaugauauuguuucuaguauauaauugauauccugaaucuaagggagaaauuggggaggagguacacucaaauaaccacaucuccuuagaaccuggauaugugguacuaucugaauaaaaacucauguuagcacauuuuaaaaucugugugucuggcauaauugaaaaacaaucuauauguguaagaaauauuaugaaguauaugaaugguucaaaguaaaaaaaauagaguaaaauugcacuaucaggaaaaauaauuguuauauuuaaugaacaaaaacucaauccuucuccauguagggugaaccuggugccccuggugaaaauggaacuccaggucaaacaguaaguauugacuacuucauuguaaauuuaaauguguacacucuuuaugagauggaacuucuuuaauguuuuugcuaaucacuguauccuucagcauuguauucuuugauguuuuucuaauagccuucugauacuuaauugaaauccacuacuguuuaguuggaauuagaaggcaacuuauuuauuuuuaguguauucuuguacagguuggaaacugaacaaagcaaaugaugccugugacuuuuuuuaaauuagcauucuggauuuuauugaaaauauuucugcuucuagggagcccgugggcuuccuggugagagaggacguguuggugccccuggcccagcuguaagugcuuccauuuuuguucaguuucauccuuuuaaaaaaucuucuaauggcugucauuuaaguuuccaccugaucuucccuuuauuuucuucuuagggugcccguggcagugauggaagugugggucccguggguccugcuguaaguuuugacacuggggaguuugaaaggaguugagaauguggggugggugcugucuucuucauuaaucucuuacgaaauagcaucauuucagacacuuuaccaaauguucugugaggucuuuugaaggcuccauuuauaaguaguguaagccauuuauaaguaccugaacuuuugauugauguauaaagcaaaauauccccacccuggauaccaugaaugucuugccuuugaugagauccuaacgacaacagacugguugucaguuuuuuucuuuacuaauauaaacagugucaugccacuguaagcaacuucaaucuucugccauuguuauuguuuucuuaauuuacuuggaggaaauuucuuaccaccuucugcuuugauuucagggucccauugggucugcuggcccuccaggcuucccaggugccccuggccccaagguaaaaacacuggugaccauugucacuacuuugauaaacuuuuuacugugaugugaaagauuggaacuguguuugcagauaaagagauaauuacgaaacaguuaccuuaauuauuccuucccuucaaaauggacauagaaugaccaguuuucucacucuacauuugaaauagaucauuucucugcacugugcacugugcccaucgauauagaugacaacauggaaauugucucuaggacuaguuaguuaggacugacugagaaccagagucaaccacagagagacagaaggagagggaagguaguaacaguagccaagauggcagaaucaagcaaggaaaauaggaaaccaaacucaaaucuuguaauaaaacggauaagaaaaauaauugcaauuuugaaguuuuaugaagacauuucauaaaacuuggcaucuuaaaaacagauaugcuguuucauuauuugcugguuaauuccuugguuuaauuuccucuuuuagggugaaauuggagcuguugguaacgcugguccugcuggucccgccgguccccguggugaagugggucuuccaggccucuccggccccguuggaccuccuguaaguagccacugucuuuaaacuuuauugaguaaaagaaaacaaagguggaguauggggaagaagaagaaugaagauggggucaaagaagaaccgaaauauuccaauuaacugauauccuucuccuuuccuuuuccucauaggguaauccuggagcaaacggccuuacuggugccaagggugcugcugugaguauaccugcguagcuaaaaugugcugcuaugauuuuaaaggcauuuaaugugugcugccucuacagcccaucaccucccuaauggaccacacugcauuuuccuucacagggccuucccggcguugcuggggcucccggccucccuggaccccgcgguauuccuggcccuguuggugcugccggugcuacuggugccagaggacuuguuguaaguggucaugacugugguucucaucauccugaaauaccaccucugccaucauuucaucacuaucuagacuuccacuuguaguuuuauuauuccuauuuuucucuuccuuagcauuuuuaguuuauauuucuuauauauauauguacacucccgucugcuauaugcacacagacaugcccuuccuguuaucuuaaaucauuaccucaagguaaaugaggcaaaguucuacaauaucaguuuugucccuucgaccaauaauaccauuccccuguacucaauuuaaauaugaacaggguacauuuccuagagaacuugagcuucucuuuaccuugacccacaaauauucuaagagauuugucugcaagagaguuucaacaaauguuuguccuuugaccacuguucuguauugaacccuagggugagccugguccagcuggcuccaaaggagagagcgguaacaagggugagcccguaaguagcucuaucaucacacuuuuauaaaguuaauuguuuuucucauuccaguuucuccagcuggacauaguauuaaaauuauuuuuuuacucccucuucuuuuguucuuuucauuaaacagggcucugcugggccccaagguccuccuggucccaguggugaagaaggaaagagaggcccuaauggggaagcuggaucugccggcccuccaggaccuccugggcugagaguagguuucaaaugcucccaacacccuaacacaccagaggcagauuaugauaccccuucacugggaauuggucaaaauuacugacuguguuuucuuaggcaaaaaaagcaucugcuuuccaucugccuuauuaaaucagugacucucaauuuaauauguuauaaaauuggccuggaaacaauguugaccuacuuuugcaggaugcucaucuaugaauuccucuagggguugggugaaguguuuuggcuugguuugugucuguaucuccccuguaaggagaucaugcuauuuuuuacaaacucuaccuuaucaaagccaagagauuucuuuaauucucucuauuucauguacuuucuugcaggguaguccugguucucguggucuuccuggagcugauggcagagcuggcgucaugguaagcugucuaucacuuacuuccuagaaaggggcuugcugcuucugguggugggugugucauuagcuuuagcauccuccuccucuaucuguuuuuuuuuuuuuuuugaauagggcccuccugguagucguggugcaaguggcccugcuggaguccgaggaccuaauggagaugcuggucgcccuggggagccuggucucaugggacccagaguaaguuucaaacugauucugagcaaaucacaccuggcauuacuuccuucuuuaaaggguugguuaauauugaagauaacaauaaaaacaucaaaaguaaauuuguuaguagucuugcugacaguugcauuuuugacuuuaucaaagcucaguagauauuuucaugcauuuaauuaguucauaaauuuucuauuuauuacuugauacaauggcuaugagguuuuuggaagaauagaucuauuuuaauauauccaaauuagauugguccuccuaucagcaugaaucuuuuaucuuaauuugugaguuuuauauaagguguucaugaaauauauuaggacuauacauuuuugguuuauuagauucauaagugaagucuuuuuccuagcaaucacaaagugcuguaauguauucagcaucacacuagcuauggagaaauaaccucuagguccauagacacacuaauccauagcaauagaguaauuuuuuugccuccauugccucuuaugggugaauaucaacuguaauuguaccauaaacaaguaauagggacaccaaauauagcaauaagaaauccacuuuggaaauuguuuacuaaaaguauuaguuuuucuauuaugagguaaauaacgugauacauuuugcccauauacauguugcuuaacaguuucuugagauaucuauaaaaggaugaguugcacuaaauuucaauaaaaggaaagccacaaaaaaauagaagaaaaauuucagaacucuuuucacacuucccagcuaguggcuaauauuccuaaugauuuacccuaggcaacaaacaaaaagucgggggaaaaggugccuuuguuagacuucaguuaaucuaaggcuugaguauguaaguuaaagugccaauauaaaaacauccucauuuauuuuauagggucuuccugguuccccuggaaauaucggccccgcuggaaaagaagguccugucguaaguauugcucauuuuccauuauauuuucaaggacacuuauugcacccuuaucaagucuauuuuguggcuuauuuauacaugaacacauugaaaauaaauaucagacacauacaucaucugggaaugcagaguaauagauuguaauuauggaguccaaaugaauacaggacugaaagcagagcaggggagagaaaaacauggcagggaaaauugaagcaggugacaaggggaugcaagagaagggaaugagggaaauugcauacauacgagauugaauuggcuauguguguacugacauccuaguuagaaaaggaaaauggauucauaauuuauuaacgcuuuauacaagaagcucuaugcauucagaaaacuauucuguuucauccguggcagcaucauaagcuugagguugugagaauauguugacacugaguaaacuugaaauaacucugcuuucagggccucccuggcaucgacggcaggccuggcccaauuggcccagcuggagcaagaggagagccuggcaacauuggauucccuggacccaaaggccccacuguaagaaucaccacaacuuucuuacccucagcacuuucuguagccaaauuuuaccaaacucuaguauuuaucuccugcgaaucaguccagucucagggaguuuccuuucaacacaggaaaacugcaggccacuuaucacauuaaaaguuuaccucuaguguauccuuauaucccugcuaaaaauccaucuccugagccccaugcuuccacagacacagggacaucuuacuguacauggagcugcauggugauggaucauccuuagauaacagaaaccacagacuagggaucucaaaagaacacaaaaacaagcaggauucaacauugcaaaaucaccgugguuaauuugacauuaaaugugcaaagcuguucuuuguuuuguuuuucauuuuuacucuagggugauccuggcaaaaacggugauaaaggucaugcuggucuugcuggugcucggguaggugcuaacuuguguacagaucuauucacauagcauucaucuaagaaccacacuuuuuuuuuuacaccaucugauaucauuuugucacuuucuuuucaagauggcauccccagggguccuuuuacuaucauaaaaugccuuuuuaaaaaccaaacuuauaaaacagugagcaaaaacaaaucagaauauacauuaggucaaaaauacagaagcacuuggcuuuuauuuuauucauuuuguaauuaaaaggguaugaauauguaguagcauucucuggccuuuauaaauugccuugugucgcauacuucgcuugagucauaucaaaaguuaguaggcaaacccauaaauauauauaccuacuauguacccacacaaauuaaaaauuuaaaaaguuaguaggcaguauuugggcuuucgugggaacccacaaugaguuuaauucaugcuaaaaugacaaacuuguuuuaaggaaguaauaccugaggcuuugagacaucuuaaacuaccuggcuugcagcuaaccaucagccuuucuguuaaauauuuuuagggugcuccagguccugauggaaacaauggugcucagggaccuccuggaccacaggugaguauuucucccacucuugugcucuucugcacuagaauguauauaguccucaaacuggccaucuccauuuucaguccaaaaguuauacagcuagacaacaguggugacauacguugcuauuuaugcucucuuuccugucacuuucaggguguucaagguggaaaaggugaacagggucccccugguccuccaggcuuccagguaagucaacucaaacauauacaauacugccuuuggucagccuauugagcuguaaaucaccauaccguaccucucuucuccaccacaauaaacaugauuucaggacugaagcaaagaaaggugcauuuuuuucaaacaaacuuuuguguaaugcuuaauaacauacaaucgugcucauguugauauuugguagccaccacccccaaacucaauuauuagcaaaucuccugaacguagccaugggauugagauuuguauuucuuuucauuuuuagggucugccuggccccucaggucccgcuggugaaguuggcaaaccaggagaaagggugaguaaaacaaguaauaguaaguaguaacuacuaaacuugagaauuucccccuguuuaauaccccacugcuaugcaauuauaauauguaaaagaaaauuucguauuucauauguuaaugauaguguuuuacauacuuuggugcugauggagagaaugagccaaauuacuuuaguucugauuacuuuguuuuacagauuuaaugaaacaucaccuuaugaaaguaaaaucuaucaaugaauauuuuauuuaauagccuuacuuuuuguauuguucuugauaacguuaagauacaaauuauuuccuuccccauagugaaaaaguaaaugcacaauuuucaaucaaacuagaucccgaaaaauuccuuuuguguuuuucuuggcauucagacaugacacuacuauacacaaucagggcaugaguucugagucauuuucucucuaauugugaugaaugugccccuauuuaguuacauucuguggccuggucuccuuugucaacaguaggacauauuaaggagacagcuggucaguaauaaaagagauacacuuggguauacaauuaacuaggcaauguacagaauaugauaauuucucuuaagaagacgaucuguuauacagcuaaaaauaggcaaugucuaauauucauuauuauuuaucuuauuauugaaggaaauagucugucacuuuuuaaaaagcaauaaacuaaauaaugggaaacaaauuuuuugauaccaaguucugggauggauacauuuuugucaccaauaaaauucucucuuucuguaucuuuccauacuaaaaguuguucuuauuagccuguguacuuaugcacucauguagauacugccagguuuauuucacucuuuccaaauuuuucaaauauuuuaaucauaagugaauuuagagaucacacacagauuucaugcuuuauucucauguuuugucuagggucuccauggugaguuuggucucccugguccugcugguccaagaguaaguguuacuucauuaacuuucauaaacucuggcaauguguuuuuaaaaguaguagugcuuucuccuuaaagccacugaugacccugcaacaagucucugaugcucuucuauagucaaauguaaucuguagaaagcauuagauuucuaaguugauaguagaauuuuuuguuucauugcucauauuuccuauucaauaauuacauaguuauaagaaacacauaaaucaauauauauuauagucagugauuuauauagacaacuaugcuacauuugugacaguggcucaacuugagcuaaggaaaaauaauauguuacuaagauauaaaguuaauuuuggccauguguguugauguucaaagccuaaagccgaacuuaugaguagucauauaaagaaaaaaaaacuuaguuucucuauggguauuagcaucacugaaaugauuaauuugcccugaaaguauuccaucaugucacuaguuaacacauauguaggaagcucaaagaaccaacuuauaacaagguccuuugaaacaguuacaacguggaccuaugugauaaauauuuugggcuauagaaugcuaugcucuagugauauuuagauguaaauugggagauauuuagauagacagacauauauauauauacacaaauacauauaucaaauauacauaugaauauuguaacuguuauaucauuauuacacaggguuauaaaaagggggcauagauaggagaauaucuaauguuaucuacaccugccauugcuauucaacuaaaaugacacaaucuuuucuuugaauacuacacauaacuggcaucuguuuuuaccuauggauuuaucacagaaaagacuccucaaagaaggggaaugaauugcaaaaauugaauauuauacucuagaagcaacgaauucuggagucguagucauggaacauuagagcuaagugacacuuuagagaauaucucaucaaucucuucauuuuacuaguggagagauuaggaacaaaagaaauuuuaauuugcuaauaaaugcaaaccagggcucggaagcuacacaaauguaaacucucauauguaaaacaguaucacugaaagugaugaauggugcaacacuucuucuaaucacuuuuuucagggggaacgcggucccccaggugagaguggugcugccgguccuacugguccuauuggaagccgagguccuucuggacccccagggccugauggaaacaagguaaaaucuuauguuuucuauauugcugguuuggcccagucugccuggaauaaguagacccuuuacaauagaaagauaauuguuuuucagauuuuuauuuauuuccaguucugugaugacuucccucucaguaaacagcaauccgauuccaguggaccugaauuauucuaaacaaacaaacaauagcaacaaacugugggggaaaauucagaguucccaaaacauaaaugaauuaguauggguugucacucuuuucuccucacgcuguuuaugcuuuuguuuuaaucuagaaacauuguauucauuggacauuauuuucagagaaaauaacuuuuuaucuuaacaucucaucccauagaguaaaauuucaacaaguagucugacuuuuaauaauaagaguuuaugaugaugaaaauucauugggcaauacauucacccccaaaaauuugucuggaaacuuguguuccaaaauagaaucugugguuuagauuuuaaaauagauuuaauauacauuccugaaaaagagauuaccuuaaccacaauaaaaagaagacaacacauauuauuuucauucuuaacucuaggggaaaaaauguaaacauuaguugcaaaaagcuauuuuaguguauggaaggauguucuugggaaaaaaauaaaaacauaaaagggagagaggaaauaaagaaaccacgguuuugugagguaguacuuucaaagggaucuauguaucucagaagcuagucaacagguuuuaaguauguggaauuguaggguuuuauauaaaaauggaagauacagucucuacucuuaaggagauuaaaacacaaacaucuccucaauugacaaggucucuuuccaugcuuucuaucugggcuaagagacuuauccuugaaaaauguuuguggguaaacauuuuuuacucucugcuucccauuguccuauccucuucuccaugccugccauccuuaagaggacugaagcagguuauagaggaaucgcagcugugcacucccacuacccucaucucuucagucaccaugucauuaacagcaucucucucugcuauauucucccuccuuucaauagcccagccuucuuuguguuucaaagcaggcaagaagccugucuagcuagcuguuuaaauuggaauucuucuagaguuugauucuucauuuucuucuuucuccacuaaaauugauuucacauguguuugacucaagggugaaccuggugugguuggugcugugggcacugcugguccaucugguccuaguggacucccaggagagaggggugcugcuggcauaccuggaggcaagggagaaaagguacguguugaccccuauuacauauuguugaugaacucuaguaaagaaggcugcacaaggaugcccaaguuuucacaauucuuggcagguggucugguagcauuuucauaucuaucuauauacauuucccucugccaccuagcaccuacacauuucuaaacucacuaaucuggcaaaauuccuugcuaccauggaauuucacacaaacagaugguguugaguaauacaugaggcucauuuuaaugccacuaacaauaaugccucauccuguccuaauuaaugggaagaagcuacauugaacagcugucaaccaugcugcugcauuaguuaugccguaagagugaucaggcgcugcagcccauugugauguugccuuacaauucuguccacaugaaucuguaccuugcuugauuaugcuucaggagaguguacggaaauuagaaaagauuguuuaacaauaaucuggaaauggccuugaauuauuuuuuccucauuauuuuucucgauuaacauucuacagaaugguaaggaaucgagacauugcuaaaaaucuuaaaugacugaagguaucauagcaucuucuguaaaaaagaaaaaaacuucauauuaauuucgauucaaaauuuuggucagaaaacaaaaaguugcucuugcuuuauacuuucagggugaaccuggucucagaggugaaauugguaacccuggcagagauggugcucgugugaguagaauuuuguuuguauguuucuucguacuuggauuuuuuuuuuauguuugaauugagaaguuuuccaaauuagaacuacacacacuuuauuuaucaaguuuaauaaaauaauauuccuuucucuccugggucuaugacuaauaauaucauuuuacauguuccaaaggaaaaauuaaaugggauuuaaccucuuugaaaauaauauccugaauuuucuaacuucccuagugucaaugauaccaacuacaaacuauagaccaaaagcuuuagguuuaauagaauauuaaaugauugcuucaagugauaacagagauuaaaauaaauaaauaaauaagucuccuaugcuuuaggaagccgggaccucuaacaagauucuauaguuauucaaaccuacucccuagaaauuuaucacccaaagagcagccccaaagauuagcuguuaaugccaugaagaugccaaagauaaucccaugacagucuaauuaccuuaucucguaugucagccucaugggucuucuaggccacagucggccuggauuccuuuauucaccucuccuucagagcugaaaacugacuguagcacaucuguaauagucuuucuuuugaaucacguaguucuaacaguuucaaacaaggcuacucauuugcugcucuccagggaauuuuacaauagcggaaaguucagaucucccaaauuucugaccugcuauugacuuacacauuuccauaaccuuuauuacuggaguacccuccuucugagaguggcuucuaauagucuuguuaauuagaaccaaaauacaucagaggccuucuagauauccaaccagagugcagugaaaguguucagucacuguauaagcacagaaaaaaagaaugacaagguucacuuuugaugauacgggguguuauuaauaagacauguuuccuuuuugguacuagggugcuccuggugcuguaggugccccugguccugcuggagccacaggugaccggguaagcaugcauuuucacuaagccaacagcaauaucuaaaauuucccgccuucccuagucccaaagagccccagcaauucauuuuuauggcuugguauaaagccuacuuauuuaaaaaccuagcuauugugauagagcagcaggaaacaaaugcuguguguuuaaaauuacuuuucccuuccuauagauuugccagcuaucugaucuauacucuaaucccuagcauuuguuuuaaagucucuccauguugcgcauuaacaauauccuaaugcacugaggcuucucaaagccuucaauuauuaccaaaaaaucaauaaaauacauagugugcccauuucacauugaacucuccacuuaaaauagaucuuauuuauuguauugcaaagauugccacaaauagaucagccccguguccaucuaaaaauuaaaauguccuccuccugguauuguaggcacugauuuauaguguuuucucaaguguauaacccauacuacuuaacccccaaaaugaauauagcauuaaguaaaaauccacuucauuuuacucugugagaugugcgucaguuaucucuuccaaggcaacuacagacucugucuguccaccacuguucucucucccucccaguucuuugagcaucuaugucaggcacauuaacagauucaucuuuggucccauuauagggcgaagcuggggcugcugguccugcugguccugcugguccucggggaagcccuguaaguaagaaccugggucauuuuguauacucacaccucacaauguuuagacauugaugaaccuaggauugauaacacauuuuuaaaucccuucucccaccuagggugaacguggugaggucgguccugcuggccccaauggauuugcugguccugcugugaguaucacauaaugaagauuaaucugaaaacauccuaaguuggggaguagagugggucggaauaccagagcuguaacuguuuauuuccaacagggugcugcuggucaaccuggugcuaaaggagaaagaggagccaaagggccuaagggugaaaacgguguuguuggucccacaggccccguuggagcugcuggcccagcuguaaguugaauucacuggugguccacacagcagcuacccauuagaucuuccaauuaaauauauauccgucaagugccugcuaugcaacagggaauauaccagauagaagauggaaaauaacggaaggauuaacauuugcacacugcuuuacaaaguauaaaaguuucaugaauauuguuuuauuuuaauucucugauaaccucauaagggugguaauauugaagaacauucugacacagauagucauuuuuuauuucuauauuuucuucuaagagaugcgggaaugauccacuugaagaaaagaguagcauuuacaaggguuuguuugugauuugacuccaucuuuuuguuugcauuuaggguccaaaugguccccccgguccugcuggaagucguggugauggaggccccccugugaguauuuacaauggacucucgccgcuuuucuuuuuucagaaucuauuaaggacacuugaaaguuuugaaauuuuugguaaauuuggacuaccaugaggaaacuuuugagauucaaguucauucuauucagagcaauuccgauauugauguuaacuugaacucagcuggaacucaguguauguugcuaucagcucacuugagguaauaaccaaggugggcccuaggcaguuuaauuguaaagucggaaaaaauauuccuuuuggcguuuauuaauaugccccuucuucugccugaccauguccuucuccuuugcaggcaaugcuaucacaacaauucucuagagacccagagcuccccaaaaaugaacuuuacugacuucuucucucacuggacagugcugaauuaucuaggucauuuguuauucuuuuguccaugaacaccauuaccuauuaaguguccauuuccuuaccacucagccaggugguaaagauaguuauuaauguauacacauuaauguguaauaaugacauagugucuuaucuucauaccuuuacaaccauaagauaauaugucagcauuucagaaaggaccauccaaaccuuaacgcaaaauaugggcauugcaacugguaauaugcugguaaggaagauguguggagaaggagggccuucaggguccuggcuaaauaaugcccuauaugaagcugccuaccuccuacuccuuggucuauuccuggucacauguacugauuuuccaaaacaaagaaauucccaucuuacccaaauucuuggaguugauguugacuguggaauucuaaugugcuuggcucuuaggguaugacugguuucccuggugcugcuggacggacuggucccccaggacccucuguaaguaaaucacuguaaacgugucuucauuuacucuagccaaaaggccuggcuucugauaggaaacugguaagaaacucuucaugaaaacacaucacuaauauucgcuauuacucuccuggucugaagucagcuuuucugaaccauuaagguauuucaucacaaguuauauuuuauaauaucaguuuaagaggcuuuuauucaugugaacaccaguccccuuucaggggcauggucuuuuugaaaaaaaaaaaacaaaaaaacgaacaguuuuagccacauaucagauauuucuauaucuaauuauccuuuauggcuaacauucugccuccauuguuaagguauaauuguuccugaauuuaaaggugguuuggccucuaauuuaauucugauucagacucuccugucaggacucaagaaaauuuaauuaauuaccaaggauuaagucuucugguuaagguuucugggaaaaaaaaauagcaaagauguugauuucuuggaauccuuuuacagguucauaacagaaaaaucuucauucccuguaggcauuuaauuaaaccuaguugagaagugugugggauuccucaauuaugaacaaaacacguauauuggcuuucuuuaaaaaaaaaaaaaaagaagaaaaaagaaaaggcaaaguccuucgaaacucagagucccauucauuuaucauuaacuccuaucauucuacauaguucugauuccaauaugccaggguaccaguggcaugacauuguuuuuccucauagaaauuugccauagucucuccuccauuauuugguugguuacagccucauaaaggaagacaggaguugcuucuuucugcaagaaagaagguuaaaaacuauaaauauuucccccaaauggccaggguauuauuuuauugcaucacauuguuugcaucuuaagaucuagaaucuuugcugcucucuuccaggcccuuggugauuaacagaaaggaaaugaccuuguacauuugcucauaggguauuucuggcccuccuggucccccugguccugcugggaaagaagggcuucgugguccucguggugaccaagguccaguuggccgaacuggagaaguaggugcaguuggucccccuggcuucgcuggugagaagggucccucuggagaggcugguacugcuguaagugauuuccaacuccucuuucuuaauaccuuaugcugaauuaaaauaaagccccuacacaaaucuucaaguggcaucuauuuguugaugaguauugcaggcucucaaguagagcucaguugagccaggaaaucuguccagcacacacugaggggcuguggcuuccaagaugcucagaaagcacaaaaucgggaagacaauaaaugagggaacucaguuuuaucacaaagcccuuaaagcuauugaaggcaccuuacugguaccaggauuagaacagagucccauugcuguggccauccuacuacauauuaaucaaucucaguaggcuaccaauuucuuaaacauacacuguccaguauuagugcuacucugaaaggugccccuauuagaccuuagaggccaaagucaaaauuugcuuccuuuugauauacugauuuuacugauuuccuuuuuguuuuuguuuuuuguuuuuguuuuuguuuuuuuguuuugggauggaguuccccucuguugcccaggcuggagugcaguggcacgaucucagcucacugcgacuuccgccuccccaguuuaaguaauuaucuugucucagccucccgaguagcugggacuacaggcacacaccaucaugccuagcuaauuuuuguauuuuuaguaaagacgggguuucaccauauuggucaggcuggucucgaucuccugaccucaggugauccacccaccuugaccuccuaaagugcugggauuacacaugugagccaccccacccagccugauuuccuuuccuuuguguauauacccagcagugugauugcuggaucuuaugguaguucuauuuuuaguuuuuugaggaaccccuccuacuauguacaacuauuauguauccauaacaauuuaaauuuuuuuauuuguuucccugccuagaggcuauaaaaacucuauuucaccaccccaagugucuuuauaaaucucaaccacauauuuuuaaauguugugccauuggucucaaggaugaaucagauacaaaaguauucaugccaagauguaaacucaccgucaucacuagagaaaagauauccaaggauauguccuaguaauaggaggucauuagccuuuuucuaagcugaagacaguuuauucucacaaucuucaagccaaccuguguuaucaccuagggucuuacccauaauacucaguauuuuuucucuauuuagggaccuccuggcacuccagguccucagggucuucuuggugcuccugguauucugggucucccuggcucgagaggugaacguggucuaccagguguugcuggugcuguggugagugcuugacaguauucugacuccauuaacauaagaaaagauuuuaaaagcugccacuucaaaugugacagauugaucacugaauaacuucacuuaagauuuuuauucauggcauuuucuuuauacagaucacaugucacuuaucuaagaagcuuuaauaccaccuuacuuagacacacacuauaaagacacagcuuaaaauuaugcagaaugauuuuuguucuuuccacgcacuuaggaaugauacaaucucuaauugcguuuacuccucugcaauaugaaaugcuggcaucauuuauccuguaggaagaaugaaacucuggaaguucugaaucguuccauuaaaccuuauacgugacaacaacuagaaaccaucucaucuccauaaaauauaucaacuuuuugaauucauuucauuugggauacugaaugacacgaggcucacuuuuuacagagcaacaucccgugauuacauaaagcuggccaucuacauguggagaaggagggcagagaugauacuaaugauacuucuuaccauugugugacccauucacauucaauuuaccuucuuccuucaaacuagaaucuccugaguaggguuguuuuggaggggaagguuagcauuccaucgaauaaggggaaugucauuuuaucuucucugccuguuuagggugaaccugguccucuuggcauugccggcccuccuggggcccgugguccuccuggugcuguggguaguccuggagucaacggugcuccuggugaagcuggucgugaugugaguccaacacuugguuuguaaaauaaaacugagcaggauuucauugugugaaacuuuauguccugagcugagguucucuucuuccaaauuucugaacaagauggucagcuucuccauaguaucuacaccuaguacugaaaauaugaaaauugcuuaggccaaagaaugggcuuuucaauagcacacugcaaaacugggcccaaguauuuaaaacaucucuaaaaaauaucuagguuggcagguuuuuaucccuaguuuuaacagucugaaagaggguucguuacugagcacuggaagugaugaagacagaguagcuacaacauaggggcugguaggcagcagagccucaccaacagccuuaauuuguguggugucuucacagggcaacccugggaacgauggucccccaggucgcgauggucaacccggacacaaggucaguacacuuuucaucuuucucuaauucaaaagugauuaaaaugcaacccagauugaugcuaagcuucauuuugccuuugguagggagagcgcgguuacccuggcaauauuggucccguuggugcugcaggugcaccugguccucauggccccguggguccugcuggcaaacauggaaaccguggugaaacuguaaguuugugaauaccagucccucagugcagcauucucgugggcuucacuucugacuuccccacacuuggggaugguggaggaguggggagggguaucuugggccuagcuaaguuguguuuuucuuuuucauuucacaggguccuucugguccuguugguccugcuggugcuguuggcccaagagguccuaguguauguacaugcugaagauuucuuugcaacacuaacauuuagagagaaucaguccaaaacaucuguuaagaaaauaaacaauauaucagcuagacuuaauauuuuuuaaaaauuucaguccaugcugagaauugauacaaauaacuugagcuauuuuaaaucucuuaugcuuguuuguauuaaacaauuacaaggaucuagccacuuuacagauagcacaacuaaagcagauuaccagcagaggugagagccuagcuaaaccauuacauguccugaguuaccuuuguaaacgaauuaagcaguauuuguggugaagugagugccauuuuuuuaaaacgguaagucuuauccauccuucuguuucuuuauagggcccacaaggcauucguggcgauaagggagagcccggugaaaaggggcccagaggucuuccuggcuuaaagggacacaauggauugcaaggucugccugguaucgcuguaaguaaacuguagccaucucgcacauaaacugauccugaaggccuucagcucagaaggauuuucauauuuucacugcuauuguuccaguauagccuauauaauauccauuucccauucucuggcuaacuccaucucacucuuggagguaaugcuauuucauaccaacaugaaaggugaggauuaagggagauagaaauagacauacaauaaaaucuccugguaacaauguccuucaaccccacuuaaaauaaacauaauuagaggaaugacuaauauugcacugcugaaauagguugugaaaaaaaaauugaauauaauagacauaaugggagaaaagagccccacuuuacauuuucaauuuucucaauccggaguccauuuaacuaaaguuucccauucaauuuggaaaaaaaaaaaaaauaugucucuugacaugugcucugaaagugugauuuuccucuucugucuuuaaagggucaccauggugaucaaggugcuccuggcuccguggguccugcugguccuaggguagguggacucaagagaagacaguucaucucugaaauagaggcuaaagcgagcagugagccccaggcugcugcucccuuggugggauucaccagcucacauguaccuggugucugucuuccuuagggcccugcugguccuucuggcccugcuggaaaagauggucgcacuggacauccugguacaguuggaccugcuggcauucgaggcccucagggucaccaaggcccugcuguaaguaugauuuggggaaauaauaaagaagaucacggaccuaaggaauguuuucuucagacuaaaccaagacaacuuugacaacccauuaaaguuagccccauuucaauauauccucuaaaauaucuggaaauugucuauaugcaaugggcuuguuaaguccaucccugcaagugugccugggggcucguuauuuauuuaugugaacuugauuauuuuuuacugaugagaacaugcuuccgugugaagcucaacugaaaaucugcugccauggaugucucucacuguaacaaaauauaaagccucuccuaucucacuuucaccuuugcagggccccccuggucccccuggcccuccuggaccuccagguguaagcgguggugguuaugacuuugguuacgauggagacuucuacagggcugaccagccucgcucagcaccuucucucagacccaaggacuaugaaguugaugcuacucugaagucucucaacaaccagauugagacccuucuuacuccugaaggcucuagaaagaacccagcucgcacaugccgugacuugagacucagccacccagaguggagcagugguaggucaagauguccagaccagacugacccuucucacaaguugagcuuuucaaaauuaguuuccauugacauuuagagugaaaaugcauuuggguaaagauuacauuaugugaaaucacacccaauuaauggagcgucaucuucucccaaccagcacccaaccucauuucccuuaaaauguauuuuugcacuuuucauaguaauaaguacccugauuugauuuuucauggaggaggggagggaaggaacugucuaaucuuaaaaauagccacccucuuccucuuaaauaugggguagacaaucaaaaauguuacuuaugagagucaguaucuuucauuaguuauuauuagaaucuguguucugcucaaugagaaguuucaugaucugaauguuauuuucuuaaaagguuacuacuggauugacccuaaccaaggaugcacuauggaugcuaucaaaguauacugugauuucucuacuggcgaaaccuguauccgggcccaaccugaaaacaucccagccaagaacugguauaggagcuccaaggacaagaaacacgucuggcuaggagaaacuaucaaugcuggcagccaggugaggaaucccacaaacaccucuccuucugcuaaauaauauuuugguaggacuguuuguuaauuaucugcauuuuaaucucugacaaaaaugggcuuauuaaaaaaagaccuguuccuuuccuggguuccaauuuuguccuaaauugcacauuagaagauggauugauuggacacauccauguaauucaaaguuauuauucaaauuugacuuaauugguaaucauugaaaaaacugacuaaugucauuuagugugaaggagcacuggccagcuauaugccacacucauacauaugcauuuucagaaugugagcagcuuuucugaauuuuuaaucaaaccuuuucaccaacuuuacugaaugccuacuggaauuccauaaauuacaaaaugacagaaaaagaaaaaugucagaauuucuaccuccucauucucuuauucuaaagaagaagcauaugcaaaaaggauuaauugaaacagauaacuuuuuuagaugaccuugccucagucuaguaggucuuauguucaucuagguaacugauacuucaaagacaagugaauuaaguuuucuuuaaaaguacccuuuuccuaagcuuggaucugagucuacucuuccugagaucuuuuuuuuucuuuuuuuuuuuuuucauguuugacucuuaguaucugaguccuucuccacuuaacuggaauuucauccuauuuucuguaguuugaauauaauguagaaggagugacuuccaaggaaauggcuacccaacuugccuucaugcgccugcuggccaacuaugccucucagaacaucaccuaccacugcaagaacagcauugcauacauggaugaggagacuggcaaccugaaaaaggcugucauucuacagggcucuaaugauguugaacuuguugcugagggcaacagcagguucacuuacacuguucuuguagauggcugcucuguaaguaauagugaaauaugggaauagcuuugggaagugggauggaggggguucuaacuuagacugcccccaagggggggucuaaagggggguuaaaagaacagaagaaugagagaacuaacuuauuucauaaguaaauucaguuuuuguauguauuuuauauuuauuuauuuauacguauuaauuucguacuuaaauucagaugauaaauucagaguauucuuaucagauagugccuucugaaaugcugaaauguauacuauguccaugcauuguuuuuucuuuagcauguuuuuuaaaugguaaugugugcccagaacuuaaaauuucuugagacuucaguggccuaaacuauaauuuauaguuauguguauuuuauuuuacuuauuaguauggccuacauuuaacuuuuaaugcuuuuucuacaauaugcuauaaauauaagaaaaauuaaaauucacuaacagcaagacuacauacccacccaggucccgcucccaaagacacacauagagggacauacacacaacaauccuaaaaaugacuuuguagagauaggucacuuggaauguguguugaaauguuguugguuuuuuugguuuguuuguuuguuuguuuuuuguuagacugauagggagccccucccacuaaagacacccuugauacuguuauuucaaggaugaacuuauuuaucugggacagacaucuucagaaugacacaugccaaacagugguucuuauuaaaucaaagguucagauauuaucagauucagaaauagugaugcuuuguguaucuauuuucuucucuuuaaacagaaaaagacaaaugaauggggaaagacaaucauugaauacaaaacaaauaagccaucacgccugcccuuccuugauauugcaccuuuggacaucgguggugcugaccaggaauucuuuguggacauuggcccagucuguuucaaauaaaugaacucaaucuaaauuaaaaaagaaagaaauuugaaaaaacuuucucuuugccauuucuucuucuucuuuuuuaacugaaagcugaauccuuccauuucuucugcacaucuacuugcuuaaauugugggcaaaagagaaaaagaaggauugaucagagcauugugcaauacaguuucauuaacuccuucccccgcucccccaaaaauuugaauuuuuuuuucaacacucuuacaccuguuauggaaaaugucaaccuuuguaagaaaaccaaaauaaaaauugaaaaauaaaaaccauaaacauuugcaccacuuguggcuuuugaauaucuuccacagagggaaguuuaaaacccaaacuuccaaagguuuaaacuaccucaaaacacuuucccaugagugugauccacauuguuaggugcugaccuagacagagaugaacugagguccuuguuuuguuuuguucauaauacaaaggugcuaauuaauaguauuucagauacuugaagaauguugauggugcuagaagaauuugagaagaaauacuccuguauugaguuguaucgugugguguauuuuuuaaaaaauuugauuuagcauucauauuuuccaucuuauucccaauuaaaaguaugcagauuauuugcccaaaucuucuucagauucagcauuuguucuuugccagucucauuuucaucuucuuccaugguuccacagaagcuuuguuucuugggcaagcagaaaaauuaaauuguaccuauuuuguauaugugagauguuuaaauaaauugugaaaaaaaugaaauaaagcauguuugguuuuccaaaagaacauauugagua

SEQ ID NO: 14530 - RNA, 37393 nt, Homo sapiens
uacucaauauguucuuuuggaaaaccaaacaugcuuuauuucauuuuuuucacaauuuauuuaaacaucucacauauacaaaauagguacaauuuaauuuuucugcuugcccaagaaacaaagcuucuguggaaccauggaagaagaugaaaaugagacuggcaaagaacaaaugcugaaucugaagaagauuugggcaaauaaucugcauacuuuuaauugggaauaagauggaaaauaugaaugcuaaaucaaauuuuuuaaaaaauacaccacacgauacaacucaauacaggaguauuucuucucaaauucuucuagcaccaucaacauucuucaaguaucugaaauacuauuaauuagcaccuuuguauuaugaacaaaacaaaacaaggaccucaguucaucucugucuaggucagcaccuaacaauguggaucacacucaugggaaaguguuuugagguaguuuaaaccuuuggaaguuuggguuuuaaacuucccucuguggaagauauucaaaagccacaaguggugcaaauguuuaugguuuuuauuuuucaauuuuuauuuugguuuucuuacaaagguugacauuuuccauaacagguguaagaguguugaaaaaaaaauucaaauuuuugggggagcgggggaaggaguuaaugaaacuguauugcacaaugcucugaucaauccuucuuuuucucuuuugcccacaauuuaagcaaguagaugugcagaagaaauggaaggauucagcuuucaguuaaaaaagaagaagaagaaauggcaaagagaaaguuuuuucaaauuucuuucuuuuuuaauuuagauugaguucauuuauuugaaacagacugggccaauguccacaaagaauuccuggucagcaccaccgauguccaaaggugcaauaucaaggaagggcaggcgugauggcuuauuuguuuuguauucaaugauugucuuuccccauucauuugucuuuuucuguuuaaagagaagaaaauagauacacaaagcaucacuauuucugaaucugauaauaucugaaccuuugauuuaauaagaaccacuguuuggcaugugucauucugaagaugucugucccagauaaauaaguucauccuugaaauaacaguaucaagggugucuuuagugggaggggcucccuaucagucuaacaaaaaacaaacaaacaaacaaaccaaaaaaaccaacaacauuucaacacacauuccaagugaccuaucucuacaaagucauuuuuaggauuguuguguguaugucccucuaugugugucuuugggagcgggaccuggguggguauguagucuugcuguuagugaauuuuaauuuuucuuauauuuauagcauauuguagaaaaagcauuaaaaguuaaauguaggccauacuaauaaguaaaauaaaauacacauaacuauaaauuauaguuuaggccacugaagucucaagaaauuuuaaguucugggcacacauuaccauuuaaaaaacaugcuaaagaaaaaacaaugcauggacauaguauacauuucagcauuucagaaggcacuaucugauaagaauacucugaauuuaucaucugaauuuaaguacgaaauuaauacguauaaauaaauaaauauaaaauacauacaaaaacugaauuuacuuaugaaauaaguuaguucucucauucuucuguucuuuuaaccccccuuuagacccccccuugggggcagucuaaguuagaacccccuccaucccacuucccaaagcuauucccauauuucacuauuacuuacagagcagccaucuacaagaacaguguaagugaaccugcuguugcccucagcaacaaguucaacaucauuagagcccuguagaaugacagccuuuuucagguugccagucuccucauccauguaugcaaugcuguucuugcagugguaggugauguucugagaggcauaguuggccagcaggcgcaugaaggcaaguuggguagccauuuccuuggaagucacuccuucuacauuauauucaaacuacagaaaauaggaugaaauuccaguuaaguggagaaggacucagauacuaagagucaaacaugaaaaaaaaaaaaaagaaaaaaaaagaucucaggaagaguagacucagauccaagcuuaggaaaaggguacuuuuaaagaaaacuuaauucacuugucuuugaaguaucaguuaccuagaugaacauaagaccuacuagacugaggcaaggucaucuaaaaaaguuaucuguuucaauuaauccuuuuugcauaugcuucuucuuuagaauaagagaaugaggagguagaaauucugacauuuuucuuuuucugucauuuuguaauuuauggaauuccaguaggcauucaguaaaguuggugaaaagguuugauuaaaaauucagaaaagcugcucacauucugaaaaugcauauguaugaguguggcauauagcuggccagugcuccuucacacuaaaugacauuagucaguuuuuucaaugauuaccaauuaagucaaauuugaauaauaacuuugaauuacauggauguguccaaucaauccaucuucuaaugugcaauuuaggacaaaauuggaacccaggaaaggaacaggucuuuuuuuaauaagcccauuuuugucagagauuaaaaugcagauaauuaacaaacaguccuaccaaaauauuauuuagcagaaggagagguguuugugggauuccucaccuggcugccagcauugauaguuucuccuagccagacguguuucuuguccuuggagcuccuauaccaguucuuggcugggauguuuucagguugggcccggauacagguuucgccaguagagaaaucacaguauacuuugauagcauccauagugcauccuugguuagggucaauccaguaguaaccuuuuaagaaaauaacauucagaucaugaaacuucucauugagcagaacacagauucuaauaauaacuaaugaaagauacugacucucauaaguaacauuuuugauugucuaccccauauuuaagaggaagaggguggcuauuuuuaagauuagacaguuccuucccuccccuccuccaugaaaaaucaaaucaggguacuuauuacuaugaaaagugcaaaaauacauuuuaagggaaaugagguugggugcugguugggagaagaugacgcuccauuaauugggugugauuucacauaauguaaucuuuacccaaaugcauuuucacucuaaaugucaauggaaacuaauuuugaaaagcucaacuugugagaagggucagucuggucuggacaucuugaccuaccacugcuccacucuggguggcugagucucaagucacggcaugugcgagcuggguucuuucuagagccuucaggaguaagaagggucucaaucugguuguugagagacuucagaguagcaucaacuucauaguccuugggucugagagaaggugcugagcgaggcuggucagcccuguagaagucuccaucguaaccaaagucauaaccaccaccgcuuacaccuggagguccaggagggccagggggaccaggggggcccugcaaaggugaaagugagauaggagaggcuuuauauuuuguuacagugagagacauccauggcagcagauuuucaguugagcuucacacggaagcauguucucaucaguaaaaaauaaucaaguucacauaaauaaauaacgagcccccaggcacacuugcagggauggacuuaacaagcccauugcauauagacaauuuccagauauuuuagaggauauauugaaauggggcuaacuuuaauggguugucaaaguugucuugguuuagucugaagaaaacauuccuuagguccgugaucuucuuuauuauuuccccaaaucauacuuacagcagggccuuggugacccugagggccucgaaugccagcagguccaacuguaccaggauguccagugcgaccaucuuuuccagcagggccagaaggaccagcagggcccuaaggaagacagacaccagguacaugugagcuggugaaucccaccaagggagcagcagccuggggcucacugcucgcuuuagccucuauuucagagaugaacugucuucucuugaguccaccuacccuaggaccagcaggacccacggagccaggagcaccuugaucaccauggugacccuuuaaagacagaagaggaaaaucacacuuucagagcacaugucaagagacauauuuuuuuuuuuuuuccaaauugaaugggaaacuuuaguuaaauggacuccggauugagaaaauugaaaauguaaaguggggcucuuuucucccauuaugucuauuauauucaauuuuuuuuucacaaccuauuucagcagugcaauauuagucauuccucuaauuauguuuauuuuaagugggguugaaggacauuguuaccaggagauuuuauuguaugucuauuucuaucucccuuaauccucaccuuucauguugguaugaaauagcauuaccuccaagagugagauggaguuagccagagaaugggaaauggauauuauauaggcuauacuggaacaauagcagugaaaauaugaaaauccuucugagcugaaggccuucaggaucaguuuaugugcgagauggcuacaguuuacuuacagcgauaccaggcagaccuugcaauccauugugucccuuuaagccaggaagaccucugggccccuuuucaccgggcucucccuuaucgccacgaaugccuugugggcccuauaaagaaacagaaggauggauaagacuuaccguuuuaaaaaaauggcacucacuucaccacaaauacugcuuaauucguuuacaaagguaacucaggacauguaaugguuuagcuaggcucucaccucugcugguaaucugcuuuaguugugcuaucuguaaaguggcuagauccuuguaauuguuuaauacaaacaagcauaagagauuuaaaauagcucaaguuauuuguaucaauucucagcauggacugaaauuuuuaaaaaauauuaagucuagcugauauauuguuuauuuucuuaacagauguuuuggacugauucucucuaaauguuaguguugcaaagaaaucuucagcauguacauacacuaggaccucuugggccaacagcaccagcaggaccaacaggaccagaaggacccugugaaaugaaaaagaaaaacacaacuuagcuaggcccaagauaccccuccccacuccuccaccauccccaaguguggggaagucagaagugaagcccacgagaaugcugcacugagggacugguauucacaaacuuacaguuucaccacgguuuccauguuugccagcaggacccacggggccaugaggaccaggugcaccugcagcaccaacgggaccaauauugccaggguaaccgcgcucucccuaccaaaggcaaaaugaagcuuagcaucaaucuggguugcauuuuaaucacuuuugaauuagagaaagaugaaaaguguacugaccuuguguccggguugaccaucgcgaccugggggaccaucguucccaggguugcccugugaagacaccacacaaauuaaggcuguuggugaggcucugcugccuaccagccccuauguuguagcuacucugucuucaucacuuccagugcucaguaacgaacccucuuucagacuguuaaaacuagggauaaaaaccugccaaccuagauauuuuuuagagauguuuuaaauacuugggcccaguuuugcagugugcuauugaaaagcccauucuuuggccuaagcaauuuucauauuuucaguacuagguguagauacuauggagaagcugaccaucuuguucagaaauuuggaagaagagaaccucagcucaggacauaaaguuucacacaaugaaauccugcucaguuuuauuuuacaaaccaaguguuggacucacaucacgaccagcuucaccaggagcaccguugacuccaggacuacccacagcaccaggaggaccacgggccccaggagggccggcaaugccaagaggaccagguucacccuaaacaggcagagaagauaaaaugacauuccccuuauucgauggaaugcuaaccuuccccuccaaaacaacccuacucaggagauucuaguuugaaggaagaagguaaauugaaugugaaugggucacacaaugguaagaaguaucauuaguaucaucucugcccuccuucuccacauguagauggccagcuuuauguaaucacgggauguugcucuguaaaaagugagccucgugucauucaguaucccaaaugaaaugaauucaaaaaguugauauauuuuauggagaugagaugguuucuaguuguugucacguauaagguuuaauggaacgauucagaacuuccagaguuucauucuuccuacaggauaaaugaugccagcauuucauauugcagaggaguaaacgcaauuagagauuguaucauuccuaagugcguggaaagaacaaaaaucauucugcauaauuuuaagcugugucuuuauagugugugucuaaguaaggugguauuaaagcuucuuagauaagugacaugugaucuguauaaagaaaaugccaugaauaaaaaucuuaagugaaguuauucagugaucaaucugucacauuugaaguggcagcuuuuaaaaucuuuucuuauguuaauggagucagaauacugucaagcacucaccacagcaccagcaacaccugguagaccacguucaccucucgagccagggagacccagaauaccaggagcaccaagaagacccugaggaccuggagugccaggaggucccuaaauagagaaaaaauacugaguauuauggguaagacccuaggugauaacacagguuggcuugaagauugugagaauaaacugucuucagcuuagaaaaaggcuaaugaccuccuauuacuaggacauauccuuggauaucuuuucucuagugaugacggugaguuuacaucuuggcaugaauacuuuuguaucugauucauccuugagaccaauggcacaacauuuaaaaauaugugguugagauuuauaaagacacuugggguggugaaauagaguuuuuauagccucuaggcagggaaacaaauaaaaaaauuuaaauuguuauggauacauaauaguuguacauaguaggagggguuccucaaaaaacuaaaaauagaacuaccauaagauccagcaaucacacugcuggguauauacacaaaggaaaggaaaucaggcugggugggguggcucacauguguaaucccagcacuuuaggaggucaagguggguggaucaccugaggucaggagaucgagaccagccugaccaauauggugaaaccccgucuuuacuaaaaauacaaaaauuagcuaggcaugauggugugugccuguagucccagcuacucgggaggcugagacaagauaauuacuuaaacuggggaggcggaagucgcagugagcugagaucgugccacugcacuccagccugggcaacagaggggaacuccaucccaaaacaaaaaaacaaaaacaaaaacaaaaaacaaaaacaaaaaggaaaucaguaaaaucaguauaucaaaaggaagcaaauuuugacuuuggccucuaaggucuaauaggggcaccuuucagaguagcacuaauacuggacaguguauguuuaagaaauugguagccuacugagauugauuaauauguaguaggauggccacagcaaugggacucuguucuaauccugguaccaguaaggugccuucaauagcuuuaagggcuuugugauaaaacugaguucccucauuuauugucuucccgauuuugugcuuucugagcaucuuggaagccacagccccucagugugugcuggacagauuuccuggcucaacugagcucuacuugagagccugcaauacucaucaacaaauagaugccacuugaagauuuguguaggggcuuuauuuuaauucagcauaagguauuaagaaagaggaguuggaaaucacuuacagcaguaccagccucuccagagggacccuucucaccagcgaagccagggggaccaacugcaccuacuucuccaguucggccaacuggaccuuggucaccacgaggaccacgaagcccuucuuucccagcaggaccagggggaccaggagggccagaaauacccuaugagcaaauguacaaggucauuuccuuucuguuaaucaccaagggccuggaagagagcagcaaagauucuagaucuuaagaugcaaacaaugugaugcaauaaaauaauacccuggccauuugggggaaauauuuauaguuuuuaaccuucuuucuugcagaaagaagcaacuccugucuuccuuuaugaggcuguaaccaaccaaauaauggaggagagacuauggcaaauuucuaugaggaaaaacaaugucaugccacugguacccuggcauauuggaaucagaacuauguagaaugauaggaguuaaugauaaaugaaugggacucugaguuucgaaggacuuugccuuuucuuuuuucuucuuuuuuuuuuuuuuuaaagaaagccaauauacguguuuuguucauaauugaggaaucccacacacuucucaacuagguuuaauuaaaugccuacagggaaugaagauuuuucuguuaugaaccuguaaaaggauuccaagaaaucaacaucuuugcuauuuuuuuuucccagaaaccuuaaccagaagacuuaauccuugguaauuaauuaaauuuucuugaguccugacaggagagucugaaucagaauuaaauuagaggccaaaccaccuuuaaauucaggaacaauuauaccuuaacaauggaggcagaauguuagccauaaaggauaauuagauauagaaauaucugauauguggcuaaaacuguucguuuuuuuguuuuuuuuuuuucaaaaagaccaugccccugaaaggggacugguguucacaugaauaaaagccucuuaaacugauauuauaaaauauaacuugugaugaaauaccuuaaugguucagaaaagcugacuucagaccaggagaguaauagcgaauauuagugauguguuuucaugaagaguuucuuaccaguuuccuaucagaagccaggccuuuuggcuagaguaaaugaagacacguuuacagugauuuacuuacagaggguccugggggaccaguccguccagcagcaccagggaaaccagucauacccuaagagccaagcacauuagaauuccacagucaacaucaacuccaagaauuuggguaagaugggaauuucuuuguuuuggaaaaucaguacaugugaccaggaauagaccaaggaguaggagguaggcagcuucauauagggcauuauuuagccaggacccugaaggcccuccuucuccacacaucuuccuuaccagcauauuaccaguugcaaugcccauauuuugcguuaagguuuggaugguccuuucugaaaugcugacauauuaucuuaugguuguaaagguaugaagauaagacacuaugucauuauuacacauuaauguguauacauuaauaacuaucuuuaccaccuggcugagugguaaggaaauggacacuuaauagguaaugguguucauggacaaaagaauaacaaaugaccuagauaauucagcacuguccagugagagaagaagucaguaaaguucauuuuuggggagcucugggucucuagagaauuguugugauagcauugccugcaaaggagaaggacauggucaggcagaagaaggggcauauuaauaaacgccaaaaggaauauuuuuuccgacuuuacaauuaaacugccuagggcccaccuugguuauuaccucaagugagcugauagcaacauacacugaguuccagcugaguucaaguuaacaucaauaucggaauugcucugaauagaaugaacuugaaucucaaaaguuuccucaugguaguccaaauuuaccaaaaauuucaaaacuuucaaguguccuuaauagauucugaaaaaagaaaagcggcgagaguccauuguaaauacucacaggggggccuccaucaccacgacuuccagcaggaccggggggaccauuuggacccuaaaugcaaacaaaaagauggagucaaaucacaaacaaacccuuguaaaugcuacucuuuucuucaaguggaucauucccgcaucucuuagaagaaaauauagaaauaaaaaaugacuaucugugucagaauguucuucaauauuaccacccuuaugagguuaucagagaauuaaaauaaaacaauauucaugaaacuuuuauacuuuguaaagcagugugcaaauguuaauccuuccguuauuuuccaucuucuaucugguauauucccuguugcauagcaggcacuugacggauauauauuuaauuggaagaucuaauggguagcugcuguguggaccaccagugaauucaacuuacagcugggccagcagcuccaacggggccugugggaccaacaacaccguuuucacccuuaggcccuuuggcuccucuuucuccuuuagcaccagguugaccagcagcacccuguuggaaauaaacaguuacagcucugguauuccgacccacucuacuccccaacuuaggauguuuucagauuaaucuucauuaugugauacucacagcaggaccagcaaauccauuggggccagcaggaccgaccucaccacguucacccuaggugggagaagggauuuaaaaauguguuaucaauccuagguucaucaaugucuaaacauugugaggugugaguauacaaaaugacccagguucuuacuuacagggcuuccccgaggaccagcaggaccagcaggaccagcagccccagcuucgcccuauaaugggaccaaagaugaaucuguuaaugugccugacauagaugcucaaagaacugggagggagagagaacagugguggacagacagagucuguaguugccuuggaagagauaacugacgcacaucucacagaguaaaaugaaguggauuuuuacuuaaugcuauauucauuuuggggguuaaguaguauggguuauacacuugagaaaacacuauaaaucagugccuacaauaccaggaggaggacauuuuaauuuuuagauggacacggggcugaucuauuuguggcaaucuuugcaauacaauaaauaagaucuauuuuaaguggagaguucaaugugaaaugggcacacuauguauuuuauugauuuuuugguaauaauugaaggcuuugagaagccucagugcauuaggauauuguuaaugcgcaacauggagagacuuuaaaacaaaugcuagggauuagaguauagaucagauagcuggcaaaucuauaggaagggaaaaguaauuuuaaacacacagcauuuguuuccugcugcucuaucacaauagcuagguuuuuaaauaaguaggcuuuauaccaagccauaaaaaugaauugcuggggcucuuugggacuagggaaggcgggaaauuuuagauauugcuguuggcuuagugaaaaugcaugcuuacccggucaccuguggcuccagcaggaccaggggcaccuacagcaccaggagcacccuaguaccaaaaaggaaacaugucuuauuaauaacaccccguaucaucaaaagugaaccuugucauucuuuuuuucugugcuuauacagugacugaacacuuucacugcacucugguuggauaucuagaaggccucugauguauuuugguucuaauuaacaagacuauuagaagccacucucagaaggaggguacuccaguaauaaagguuauggaaauguguaagucaauagcaggucagaaauuugggagaucugaacuuuccgcuauuguaaaauucccuggagagcagcaaaugaguagccuuguuugaaacuguuagaacuacgugauucaaaagaaagacuauuacagaugugcuacagucaguuuucagcucugaaggagaggugaauaaaggaauccaggccgacuguggccuagaagacccaugaggcugacauacgagauaagguaauuagacugucaugggauuaucuuuggcaucuucauggcauuaacagcuaaucuuuggggcugcucuuugggugauaaauuucuagggaguagguuugaauaacuauagaaucuuguuagaggucccggcuuccuaaagcauaggagacuuauuuauuuauuuauuuuaaucucuguuaucacuugaagcaaucauuuaauauucuauuaaaccuaaagcuuuuggucuauaguuuguaguugguaucauugacacuagggaaguuagaaaauucaggauauuauuuucaaagagguuaaaucccauuuaauuuuuccuuuggaacauguaaaaugauauuauuagucauagacccaggagagaaaggaauauuauuuuauuaaacuugauaaauaaaguguguguaguucuaauuuggaaaacuucucaauucaaacauaaaaaaaaaauccaaguacgaagaaacauacaaacaaaauucuacucacacgagcaccaucucugccaggguuaccaauuucaccucugagaccagguucacccugaaaguauaaagcaagagcaacuuuuuguuuucugaccaaaauuuugaaucgaaauuaauaugaaguuuuuuucuuuuuuacagaagaugcuaugauaccuucagucauuuaagauuuuuagcaaugucucgauuccuuaccauucuguagaauguuaaucgagaaaaauaaugaggaaaaaauaauucaaggccauuuccagauuauuguuaaacaaucuuuucuaauuuccguacacucuccugaagcauaaucaagcaagguacagauucauguggacagaauuguaaggcaacaucacaaugggcugcagcgccugaucacucuuacggcauaacuaaugcagcagcaugguugacagcuguucaauguagcuucuucccauuaauuaggacaggaugaggcauuauuguuaguggcauuaaaaugagccucauguauuacucaacaccaucuguuugugugaaauuccaugguagcaaggaauuuugccagauuagugaguuuagaaauguguaggugcuagguggcagagggaaauguauauagauagauaugaaaaugcuaccagaccaccugccaagaauugugaaaacuugggcauccuugugcagccuucuuuacuagaguucaucaacaauauguaauaggggucaacacguaccuuuucucccuugccuccagguaugccagcagcaccccucucuccugggaguccacuaggaccagauggaccagcagugcccacagcaccaaccacaccagguucacccuugagucaaacacaugugaaaucaauuuuaguggagaaagaagaaaaugaagaaucaaacucuagaagaauuccaauuuaaacagcuagcuagacaggcuucuugccugcuuugaaacacaaagaaggcugggcuauugaaaggagggagaauauagcagagagagaugcuguuaaugacauggugacugaagagaugaggguagugggagugcacagcugcgauuccucuauaaccugcuucaguccucuuaaggauggcaggcauggagaagaggauaggacaaugggaagcagagaguaaaaaauguuuacccacaaacauuuuucaaggauaagucucuuagcccagauagaaagcauggaaagagaccuugucaauugaggagauguuuguguuuuaaucuccuuaagaguagagacuguaucuuccauuuuuauauaaaacccuacaauuccacauacuuaaaaccuguugacuagcuucugagauacauagaucccuuugaaaguacuaccucacaaaaccgugguuucuuuauuuccucucucccuuuuauguuuuuauuuuuuucccaagaacauccuuccauacacuaaaauagcuuuuugcaacuaauguuuacauuuuuuccccuagaguuaagaaugaaaauaauauguguugucuucuuuuuauugugguuaagguaaucucuuuuucaggaauguauauuaaaucuauuuuaaaaucuaaaccacagauucuauuuuggaacacaaguuuccagacaaauuuuugggggugaauguauugcccaaugaauuuucaucaucauaaacucuuauuauuaaaagucagacuacuuguugaaauuuuacucuaugggaugagauguuaagauaaaaaguuauuuucucugaaaauaauguccaaugaauacaauguuucuagauuaaaacaaaagcauaaacagcgugaggagaaaagagugacaacccauacuaauucauuuauguuuugggaacucugaauuuucccccacaguuuguugcuauuguuuguuuguuuagaauaauucagguccacuggaaucggauugcuguuuacugagagggaagucaucacagaacuggaaauaaauaaaaaucugaaaaacaauuaucuuucuauuguaaagggucuacuuauuccaggcagacugggccaaaccagcaauauagaaaacauaagauuuuaccuuguuuccaucaggcccuggggguccagaaggaccucggcuuccaauaggaccaguaggaccggcagcaccacucucaccugggggaccgcguucccccugaaaaaagugauuagaagaaguguugcaccauucaucacuuucagugauacuguuuuacauaugagaguuuacauuuguguagcuuccgagcccugguuugcauuuauuagcaaauuaaaauuucuuuuguuccuaaucucuccacuaguaaaaugaagagauugaugagauauucucuaaagugucacuuagcucuaauguuccaugacuacgacuccagaauucguugcuucuagaguauaauauucaauuuuugcaauucauuccccuucuuugaggagucuuuucugugauaaauccauagguaaaaacagaugccaguuauguguaguauucaaagaaaagauugugucauuuuaguugaauagcaauggcagguguagauaacauuagauauucuccuaucuaugcccccuuuuuauaacccuguguaauaaugauauaacaguuacaauauucauauguauauuugauauauguauuuguguauauauauauaugucugucuaucuaaauaucucccaauuuacaucuaaauaucacuagagcauagcauucuauagcccaaaauauuuaucacauagguccacguuguaacuguuucaaaggaccuuguuauaaguugguucuuugagcuuccuacauauguguuaacuagugacaugauggaauacuuucagggcaaauuaaucauuucagugaugcuaauacccauagagaaacuaaguuuuuuuuucuuuauaugacuacucauaaguucggcuuuaggcuuugaacaucaacacacauggccaaaauuaacuuuauaucuuaguaacauauuauuuuuccuuagcucaaguugagccacugucacaaauguagcauaguugucuauauaaaucacugacuauaauauauauugauuuauguguuucuuauaacuauguaauuauugaauaggaaauaugagcaaugaaacaaaaaauucuacuaucaacuuagaaaucuaaugcuuucuacagauuacauuugacuauagaagagcaucagagacuuguugcagggucaucaguggcuuuaaggagaaagcacuacuacuuuuaaaaacacauugccagaguuuaugaaaguuaaugaaguaacacuuacucuuggaccagcaggaccagggagaccaaacucaccauggagacccuagacaaaacaugagaauaaagcaugaaaucugugugugaucucuaaauucacuuaugauuaaaauauuugaaaaauuuggaaagagugaaauaaaccuggcaguaucuacaugagugcauaaguacacaggcuaauaagaacaacuuuuaguauggaaagauacagaaagagagaauuuuauuggugacaaaaauguauccaucccagaacuugguaucaaaaaauuuguuucccauuauuuaguuuauugcuuuuuaaaaagugacagacuauuuccuucaauaauaagauaaauaauaaugaauauuagacauugccuauuuuuagcuguauaacagaucgucuucuuaagagaaauuaucauauucuguacauugccuaguuaauuguauacccaaguguaucucuuuuauuacugaccagcugucuccuuaauauguccuacuguugacaaaggagaccaggccacagaauguaacuaaauaggggcacauucaucacaauuagagagaaaaugacucagaacucaugcccugauuguguauaguagugucaugucugaaugccaagaaaaacacaaaaggaauuuuucgggaucuaguuugauugaaaauugugcauuuacuuuuucacuauggggaaggaaauaauuuguaucuuaacguuaucaagaacaauacaaaaaguaaggcuauuaaauaaaauauucauugauagauuuuacuuucauaaggugauguuucauuaaaucuguaaaacaaaguaaucagaacuaaaguaauuuggcucauucucuccaucagcaccaaaguauguaaaacacuaucauuaacauaugaaauacgaaauuuucuuuuacauauuauaauugcauagcagugggguauuaaacagggggaaauucucaaguuuaguaguuacuacuuacuauuacuuguuuuacucacccuuucuccugguuugccaacuucaccagcgggaccugaggggccaggcagacccuaaaaaugaaaagaaauacaaaucucaaucccauggcuacguucaggagauuugcuaauaauugaguuugggggugguggcuaccaaauaucaacaugagcacgauuguauguuauuaagcauuacacaaaaguuuguuugaaaaaaaugcaccuuucuuugcuucaguccugaaaucauguuuauugugguggagaagagagguacgguauggugauuuacagcucaauaggcugaccaaaggcaguauuguauauguuugaguugacuuaccuggaagccuggaggaccagggggacccuguucaccuuuuccaccuugaacacccugaaagugacaggaaagagagcauaaauagcaacguaugucaccacuguugucuagcuguauaacuuuuggacugaaaauggagauggccaguuugaggacuauauacauucuagugcagaagagcacaagagugggagaaauacucaccugugguccaggaggucccugagcaccauuguuuccaucaggaccuggagcacccuaaaaauauuuaacagaaaggcugaugguuagcugcaagccagguaguuuaagaugucucaaagccucagguauuacuuccuuaaaacaaguuugucauuuuagcaugaauuaaacucauuguggguucccacgaaagcccaaauacugccuacuaacuuuuuaaauuuuuaauuuguguggguacauaguagguauauauauuuauggguuugccuacuaacuuuugauaugacucaagcgaaguaugcgacacaaggcaauuuauaaaggccagagaaugcuacuacauauucauacccuuuuaauuacaaaaugaauaaaauaaaagccaagugcuucuguauuuuugaccuaauguauauucugauuuguuuuugcucacuguuuuauaaguuugguuuuuaaaaaggcauuuuaugauaguaaaaggaccccuggggaugccaucuugaaaagaaagugacaaaaugauaucagaugguguaaaaaaaaaagugugguucuuagaugaaugcuaugugaauagaucuguacacaaguuagcaccuacccgagcaccagcaagaccagcaugaccuuuaucaccguuuuugccaggaucacccuagaguaaaaaugaaaaacaaaacaaagaacagcuuugcacauuuaaugucaaauuaaccacggugauuuugcaauguugaauccugcuuguuuuuguguucuuuugagaucccuagucugugguuucuguuaucuaaggaugauccaucaccaugcagcuccauguacaguaagaugucccugugucuguggaagcauggggcucaggagauggauuuuuagcagggauauaaggauacacuagagguaaacuuuuaaugugauaaguggccugcaguuuuccuguguugaaaggaaacucccugagacuggacugauucgcaggagauaaauacuagaguuugguaaaauuuggcuacagaaagugcugaggguaagaaaguuguggugauucuuacaguggggccuuuggguccagggaauccaauguugccaggcucuccucuugcuccagcugggccaauugggccaggccugccgucgaugccagggaggcccugaaagcagaguuauuucaaguuuacucagugucaacauauucucacaaccucaagcuuaugaugcugccacggaugaaacagaauaguuuucugaaugcauagagcuucuuguauaaagcguuaauaaauuaugaauccauuuuccuuuucuaacuaggaugucaguacacacauagccaauucaaucucguauguaugcaauuucccucauucccuucucuugcauccccuugucaccugcuucaauuuucccugccauguuuuucucuccccugcucugcuuucaguccuguauucauuuggacuccauaauuacaaucuauuacucugcauucccagaugauguaugugucugauauuuauuuucaauguguucauguauaaauaagccacaaaauagacuugauaagggugcaauaaguguccuugaaaauauaauggaaaaugagcaauacuuacgacaggaccuucuuuuccagcggggccgauauuuccaggggaaccaggaagacccuauaaaauaaaugaggauguuuuuauauuggcacuuuaacuuacauacucaagccuuagauuaacugaagucuaacaaaggcaccuuuucccccgacuuuuuguuuguugccuaggguaaaucauuaggaauauuagccacuagcugggaagugugaaaagaguucugaaauuuuucuucuauuuuuuuguggcuuuccuuuuauugaaauuuagugcaacucauccuuuuauagauaucucaagaaacuguuaagcaacauguauaugggcaaaauguaucacguuauuuaccucauaauagaaaaacuaauacuuuuaguaaacaauuuccaaaguggauuucuuauugcuauauuuggugucccuauuacuuguuuaugguacaauuacaguugauauucacccauaagaggcaauggaggcaaaaaaauuacucuauugcuauggauuagugugucuauggaccuagagguuauuucuccauagcuagugugaugcugaauacauuacagcacuuugugauugcuaggaaaaagacuucacuuaugaaucuaauaaaccaaaaauguauaguccuaauauauuucaugaacaccuuauauaaaacucacaaauuaagauaaaagauucaugcugauaggaggaccaaucuaauuuggauauauuaaaauagaucuauucuuccaaaaaccucauagccauuguaucaaguaauaaauagaaaauuuaugaacuaauuaaaugcaugaaaauaucuacugagcuuugauaaagucaaaaaugcaacugucagcaagacuacuaacaaauuuacuuuugauguuuuuauuguuaucuucaauauuaaccaacccuuuaaagaaggaaguaaugccaggugugauuugcucagaaucaguuugaaacuuacucugggucccaugagaccaggcuccccagggcgaccagcaucuccauuagguccucggacuccagcagggccacuugcaccacgacuaccaggagggcccuauucaaaaaaaaaaaaaaaacagauagaggaggaggaugcuaaagcuaaugacacacccaccaccagaagcagcaagccccuuucuaggaaguaagugauagacagcuuaccaugacgccagcucugccaucagcuccaggaagaccacgagaaccaggacuacccugcaagaaaguacaugaaauagagagaauuaaagaaaucucuuggcuuugauaagguagaguuuguaaaaaauagcaugaucuccuuacaggggagauacagacacaaaccaagccaaaacacuucacccaaccccuagaggaauucauagaugagcauccugcaaaaguaggucaacauuguuuccaggccaauuuuauaacauauuaaauugagagucacugauuuaauaaggcagauggaaagcagaugcuuuuuuugccuaagaaaacacagucaguaauuuugaccaauucccagugaagggguaucauaaucugccucugguguguuaggguguugggagcauuugaaaccuacucucagcccaggagguccuggagggccggcagauccagcuuccccauuagggccucucuuuccuucuucaccacugggaccaggaggaccuuggggcccagcagagcccuguuuaaugaaaagaacaaaagaagagggaguaaaaaaauaauuuuaauacuauguccagcuggagaaacuggaaugagaaaaacaauuaacuuuauaaaagugugaugauagagcuacuuacgggcucacccuuguuaccgcucucuccuuuggagccagcuggaccaggcucacccuaggguucaauacagaacaguggucaaaggacaaacauuuguugaaacucucuugcagacaaaucucuuagaauauuugugggucaagguaaagagaagcucaaguucucuaggaaauguacccuguucauauuuaaauugaguacaggggaaugguauuauuggucgaagggacaaaacugauauuguagaacuuugccucauuuaccuugagguaaugauuuaagauaacaggaagggcaugucugugugcauauagcagacgggaguguacauauauauauaagaaauauaaacuaaaaaugcuaaggaagagaaaaauaggaauaauaaaacuacaaguggaagucuagauagugaugaaaugauggcagaggugguauuucaggaugaugagaaccacagucaugaccacuuacaacaaguccucuggcaccaguagcaccggcagcaccaacagggccaggaauaccgcgggguccagggaggccgggagccccagcaacgccgggaaggcccugugaaggaaaaugcagugugguccauuagggaggugaugggcuguagaggcagcacacauuaaaugccuuuaaaaucauagcagcacauuuuagcuacgcagguauacucacagcagcacccuuggcaccaguaaggccguuugcuccaggauuacccuaugaggaaaaggaaaggagaaggauaucaguuaauuggaauauuucgguucuucuuugaccccaucuucauucuucuucuuccccauacuccaccuuuguuuucuuuuacucaauaaaguuuaaagacaguggcuacuuacaggagguccaacggggccggagaggccuggaagacccacuucaccacggggaccggcgggaccagcaggaccagcguuaccaacagcuccaauuucacccuaaaagaggaaauuaaaccaaggaauuaaccagcaaauaaugaaacagcauaucuguuuuuaagaugccaaguuuuaugaaaugucuucauaaaacuucaaaauugcaauuauuuuucuuauccguuuuauuacaagauuugaguuugguuuccuauuuuccuugcuugauucugccaucuuggcuacuguuacuaccuucccucuccuucugucucucugugguugacucugguucucagucaguccuaacuaacuaguccuagagacaauuuccauguugucaucuauaucgaugggcacagugcacagugcagagaaaugaucuauuucaaauguagagugagaaaacuggucauucuauguccauuuugaagggaaggaauaauuaagguaacuguuucguaauuaucucuuuaucugcaaacacaguuccaaucuuucacaucacaguaaaaaguuuaucaaaguagugacaauggucaccaguguuuuuaccuuggggccaggggcaccugggaagccuggagggccagcagacccaaugggacccugaaaucaaagcagaaggugguaagaaauuuccuccaaguaaauuaagaaaacaauaacaauggcagaagauugaaguugcuuacaguggcaugacacuguuuauauuaguaaagaaaaaaacugacaaccagucuguugucguuaggaucucaucaaaggcaagacauucaugguauccaggguggggauauuuugcuuuauacaucaaucaaaaguucagguacuuauaaauggcuuacacuacuuauaaauggagccuucaaaagaccucacagaacauuugguaaagugucugaaaugaugcuauuucguaagagauuaaugaagaagacagcacccaccccacauucucaacuccuuucaaacuccccagugucaaaacuuacagcaggacccacgggacccacacuuccaucacugccacgggcacccuaagaagaaaauaaagggaagaucagguggaaacuuaaaugacagccauuagaagauuuuuuaaaaggaugaaacugaacaaaaauggaagcacuuacagcugggccaggggcaccaacacguccucucucaccaggaagcccacgggcucccuagaagcagaaauauuuucaauaaaauccagaaugcuaauuuaaaaaaagucacaggcaucauuugcuuuguucaguuuccaaccuguacaagaauacacuaaaaauaaauaaguugccuucuaauuccaacuaaacaguaguggauuucaauuaaguaucagaaggcuauuagaaaaacaucaaagaauacaaugcugaaggauacagugauuagcaaaaacauuaaagaaguuccaucucauaaagaguguacacauuuaaauuuacaaugaaguagucaauacuuacuguuugaccuggaguuccauuuucaccaggggcaccagguucacccuacauggagaaggauugaguuuuuguucauuaaauauaacaauuauuuuuccugauagugcaauuuuacucuauuuuuuuuacuuugaaccauucauauacuucauaauauuucuuacacauauagauuguuuuucaauuaugccagacacacagauuuuaaaaugugcuaacaugaguuuuuauucagauaguaccacauauccagguucuaaggagaugugguuauuugaguguaccuccuccccaauuucucccuuagauucaggauaucaauuauauacuagaaacaauaucauaaaaagagauggcaaaggauaaauuugcuuucaauguaaccauauuuauccuuuuuaaaguuauuuugaacacucaguguuaucacuuucauaaaaugugcaugaaaaauugaagcuucaugguauuuuuuagagccaucauauuuauuuccaaucuauauucuuauccugaguaaaaaccaggguaguaguaguaguaguagugggauuuaauacuauggcacauguaaaagaacuuuuuuuaaagauaaucugauuuagauauaggggaaauaugguuuaagagaccucauaaggacccuuaauuuccaggauucuaugugaagucuauucuuugggaauaagcauugaaguggcaaggggggaucauuucuagccuaugacuuucuaaccucuagaugugugacuuugggcaagucaauugcucucacgaagccucaguuucccaccucugcaaaaugagggggucuccaaagcuccuugcagcucuaacauuuuaugauacagugauuaguagucugagcuguuauaucgggcucuugggagaaugaguuugaccuuauccauuuguguggcagcuggaaaguuagaauagauucuccauauucauguucauuucuggucccgcuaguauucguuacucauuaauuuguaauuacguugguauucacuuuaauaucacauuaucuccuuaauaggaaagagaacauuuuauaguugaaaacgcugucagagaagagccuagccaagagauaacacacuucugagacuuuaauuaccuaauuaaaauuuuuuugagugugcacagauaaaucacaggaaagagguugaaaaguguauagcgacaugaauguaccuaucuaauuaguguguggcaaaggagaauuuacaguuuaaaauaauacagagugucguaaucucugauuauauguuuauuuacuuuuauuuuggcugcagagauacacuggaauuauagagggaggaaaggaaauggaacaagaaacuauuaauauuauuuuuaucucaauuguuuaauagauauugaauuuuaauaaauauuaauaauugaccuuuuuucacagacucucauaguccccauccuugagggauuugaaguacaggaaagaaaaaaaauaaaaauacuuuuuguaauauggguagucuucaguauaauauacuuuuuuggaggucauggggaauuucaaucaagugcuuaaaaacagugcuucuaauuuaauauuuaccuucacaccaggagcaccgggcugucccuucaauccauccagaccauugugucccugaaaggaaagccuuauuauaaaaugcuguuccaugauaguguuuggucaaauaaaaauuguauuguauaucuuugccauuaaucucucuuggguaagucuugucugcugcaguagaaagaaguccaguguuccaggucccagcaaacucagucuauugcccuagauaggucacuuaacuuucuugccauugagagagaaggauggaggacuagguguucucucacaucuuuuccauccuuaauaauuuuaugauuuucagacgguuguaaauacucaauaaguaauacauguucuauauaauuuucucuguagugagccuguuuuuugguagcuaugaacagacugaaaaaauugcaccccacuuuacuuucaagaaaucugacucuuuaacucuuucuucccuuuggcaaacuccagggauuugaaagugaguauaugucacccaagauuuuaaacauacuugaguuuuuuccaaaaauuaauaggcauuuucucucuucugaguaaagaaugugcucacccuaaugccuuugaagccaggaaguccaggaguuccagggaaaccacgagcacccuuagaaagaaauacagaagauggugaauaauguuuuaccauaaauaaaaagacagugacuucuucccuccaaaguauuuauucucaucaaaguucaagcuuugaaccaaagucuaguauaccucuaagcacagagugacaaauuaacuugcucuaaugugaguaacuaauaauacgguauuuguagaaaacacaauuuaguugcuuaugguaugcuugcugucauuuauauuccauuauuugcaugaauaaaauguauaugcauuuuuuuuuaacuaggcuuuuuucuuuauuagaugccuucgauucauguuaugaguuugggugacaucuauguugucauuuagauugaugcuaguuuuagcaacuaucuuauaggccuaugauguuugugcuaucuaccaauguaaaaagucucaccugugguccaacaacuccucucucaccaggucguccggguuuuccagggugacccuaaacaugaaaacauuguagagucaacuucuucuugguaaacuaucagacaaaaugggggaaucuugguuuuuacaaaaggggagaaaguuaucacauaaaaauauggauccagauauauauuuaaucuuucccuuaauacaaguagguuaguuaauauuucauuaaaauaauauuucccauacauuaagaguucugucaggcauauucagcuuuuggcagaauacuuaauuugaaucuagaaaaucuuguugaggcaagaguauuuaaauagcauuuugaaagugcuuaagaguaaauacuuacaucuucaccagccuugccaggagggccagcuggaccacgagcaccugcaggacccuaagaaaaugggagacccaucauuucacuaagguuauauucauaaacuuccuggaaaaaaacuuaucacaaagguggaaaaauguacucacaguuugaccagguucaccaggcucaccagcagguccuuggaaaccuugagggcccuaaaagaaaaaaagaaugucauacuccaagccuuuauuucuuaauucucugucuuuuuacauaagaggcauuacaagcuuucaguacuuacuggggcuccagcugcaccaggugggccucuaggucccauuaagcccuguaaagaaagcagauauaucaacaguuagcacugauaaguugucaugguguuggcuggggucagauaugaccaacuuagcagugccauuguugugguuugauuccauaguuuuuauuccucccaaggaagaauuuaaggacucaaacuuccugcacuaguucucucccuuugcuuuuccuuuucucccaauccuuaucaacagaaaucaaugagaauuagacggggcagauagguuccuuaaaguugugcacaauugggcauauugagauuguucugaugcaaugaagugaaucagucuuugcagaagugcagaauauacaauugucuucuauacagcagaugaagcauguccauuuggauaucuuugaucauaugucaucuuccuaugucauauuuagcuaagaaauugguauuuuuauugccacaaaggacauaaauugaaaagaaucaaaaguccuucuuaaugauuagagagaaguuuguuauaaccuuaucgcuccucuaaggguuauuggugacugaugaaaaugucaaacaaaaguggauguaaugaggggugaaggaaaaauaaaacauuauugaaacagccuucuggaagagucuauuauaugauauuauuguugaaaauauggcccaaaugauggaagauuguuuuccccuuuguuguuuccauagcacaaaaguaggguaaaacaggcuguuaauaguuuguaagcuaaauacacuuucuugacuccucuuugcaguaaucagugccuguguaagcucauccguagggucuguuccucauaaugcugaaaauauuucauguaccagucucaaguaauuuguucaugacaucagcuguggggacucugcagucaaaccuaccuuacuguauuaaugccuagagugaaauaacauggauuuuaucuaaaauguaugucauuuuaauuauaagaauuauucauuugguuuuagaaauugcucugacauuaaaagaaacugucacuuuuccaucacaauagcuuuuuaggcauacauuaaaaaauaauuuucuuugacaucaugaauuucuaauuauauuuauuuuuucauguauuugcaacaauuucauuuacauaaaauguaguguauuucauggaggcugugauuacucauuaauucagagaagaacccugugggguuuuauaguuauugauuuuccaacauggaaauuauuuuaauacuuuauugcugccuaucuucccuauuugugaaacagauaucuguugauuacauaugucugugcauguguguggaugugcaagcuuaaauuauauuucacugauauuucaaaguaaaauacucugcuuuaugccaagacagauguuccgaaaacagggguaucugaaauccauauuaauuuucccagcuuagugggcuuuuuaaaaaugacauuuaguagcucuuuacuuuccgcccccuugcuucuucuugagauguagguacugcuuuaaaacugacuaauguccagcauuagcugaaacagcuaauuucaaaaauccaauauaaacaaagccaaaagaaacacucuacuuuuucauuucagauaugaacauuuuaaacuaccagaaaaaauuagggaauuagaagucgucaauuaaagguacauuauuucucaagugggaguuuuaauuuacagaaaauauuaucucacccuuagaguauauuagcuuacugugggccauuagcuccagcagaacaucuucuuuugaagauagagcacuaagugcacugcccagguaaaauuuacauuuuaaagaccuuguugacuuugggcagauaaauaccuuuguuuugaaacaauuaauuaaaaucacuaaauugcguguguguguauacauuaaauucuguagugcuuaaucaaccuaacacuuugacuucuggcaguuuuccccucuauuucauauaugcuaguauacauuuugcaugcucguauuagcauuuuucccuucaaacuucucucuaaugcuuguuagaagcuucauuuguuaauagucaucaucaucaucaucaucauauagggaauguuucuaagcggugcuccacugauaggguauggugcugaauauuuguacugagugacauaaaugcuagauuuuuacucauacucucuucuauauagauuuacaaucaauagacuaaaaaaggauuuuuuuggucaaaauucagaaaaagaaacauuuccuauauuguuaacuccuugaggaaggaucagaaucugucauauuccuuguaauuuccccaguuccuaauacaguuuagggcccauugaaggcaucugauuaauaucuguugacuaaaugagugguuuauucaaggacuagguacauaaaccaugauguaagcaaauauuagacaucuugccuggcaucuaguucuaguuaugucauuaguuaccuggaugacuuugagaaaagggcuuaaacucucccauuuuaaaaugaguuagcuggacuagauagaacuuguugauccuuuccaacaaguucagagaacuuaauaaauaguucuaugccucuaaguguugcuuaaaauucuaagcaauguuaaagaauauuaaaaaauuaaucagagugauuacuguuuuaaauuaaauugauuugcccaaguuaugguuacuauguccaaagauuauuucuuggacauaaguauaugaucuaucuuaaugaggaucauauaaucaaaaagaucauauaaucauaaaagaucaauuaaucuuucuuuuguaaagaaaagugaacuccuuaacuuauguuuucauaaauuugaaaacaaaaagaguuguuuuuauauaaucuaaguauugaguguuaacuuagguagcuaaauaaauggcgugguaaaaugugacauaaaaugaaugauuuauuuagcaauuuuuuuggcuaagauaaacagauaagcauaccauugguccagggccaaguccaacuccuuuuccaucauacugagcagcaaaguucuagagaaguaaaaaaaaaaaauuauauauauauauaaaauauuuuuaguuacuagucauguaguucauuuucucauucuacuuguaaauauuuuucuguuguuauuuaaaagagggcaauguuuuugauauaauuauuaguuuaaaauucuauauugaacuaaauuccuaaaaaguuaugagagcuguacgucaaaaacuuggccgacaccucuuugaaauggagaacuucccuacuuuacuuuuugagcccuuccucugccuuaacucggugucuccacucccaccuuuuaccucuacucugaggaagggaagcuuucuaaacuuuuaauguuacuaagggcuccugacaaauuagacagagcucaagaggacaucuucacauuuucaccuguugcccuuccccaccggagcuacacaaaaugacuaagagaucuuuuucuugcuggaguuucaggaagggcauaaagaguuuucaaguuuagaggaaaauuaaauuaaaauaccccuuggaagauaaaacuucuaaaaacuaguucacaguaauaacuuuacuguuaaagaucucucuuauagugguagcucuauuaaagaagcugcuuuuuaaugcaauucauagauaagcaaucauaauaagaucuuugggggagaaaggucuuauuuuacugacauacaguuggguauuagaaucaggcuucugauucauagugcuaaccaauuaagcaaauauguuuuccuuccugcagugaggucauuuggcacucauaccauuguuaaagacaugaagcuaaaagaagauauuaaugaaaaagggaaauguacuuuucucaaauuaguuucaagcaaauuaaaccuaaaaccgcuuugaauguugguucagcagacuucaagucaaggagaauaaaaagcguaggauguuuguaaaauugcuuaagaucagggauuucacuuacacaguucaaucuaaucaaaauccuuaauaaugcaacaccucuuauuugugccuuacuaauaaaagauauuaaaucuccaaauuaaauaaugguaaugauggccacagcuaacuucagugcacacaaagaccaguccuguaauugacaagggcucacaaagagaauggguaaagcagaaucuugagugaaaaaaccaaauaaaugaaauaaaauauacuaauuuucaaauggaagaauuaucccuuaacugcuaaaaauaaauuccacaauaaaccuucuuucaacugaaguuagcuaaaaguuagcaauacguaagacaccuuaccccaccgagaccaggggggccaggaggaccagguggaccaggagggccugugggaccaucuucaccaucucugccuggggggccugguggacccuguuauguaaaaagugaguaaggucagguuagacaggcccuguagaaaccuaagaauuauaugugguaagaucaguuguucagaccuuucuaugugcaaguaggguggaaauuuaauauacuauauuugucauugauugaaauucacuuaugagucuauuuuagaaagaggguuaauaacucuuaagauaucacaggguaguuuuccuaaagaacuaucucggccauugaauauuaauucauacugaagcuccaguauucaaauauaaaaauuauagccaaaauguaugguuccacgugcuucauauguuuaacagugcacaaggacuuacaucguauuuuuauugccgaucucugacugugacaaacugauucaauuguuuugguauguuacaugugaaugaauuaacugaugugacaguuaauaaggucacuuuaucauaggagagaaaauccugcagauuuacuaucauuaacuacuuguauuguuaaaauaauuaacugauuuaauucuauuucuaauaaauugagugaaauacauguaagucuccucuuccuaauagauauaagauauagguauucauauauuggcaaaaguguuauacaaugcaaaaccacauaguuauaaaugucaaauaagcauagcagggagauuuaagaaugccacaaauaaaauguaagccugacuuguacaugcaugaauuugagcagagaaacauguuacugacuacuaauucacuauuauuuccaagcuaccuaagggaucuuaguucaaaagcaaaugaaauguguuaaaaagaggacuguggugguagguagauauauuuccauuaugcauguguuggaugggucaauuacaaauaaagaaaguagaccaugcaaagaauaugacuguaacaguuuuucuuuuuuaacgguaauuuugaccuaaaacaaauauugaucauauauaauaaugcucauucgcuucuucugcagugcauuaccuguuuaaagggguguacaauuaucuggauacauaauauucuuauaaauugccaguuccuguaguuucuaacauauaguuauucaaauacgggacgaagcccuuuauaguucaaaaauuacacacccuuucuccacgugguccucuaucuccggcugggcccuacaggaaagauacaaacaggacaauaauaaaugccuaagaaguaauuuccagugaacaaacaaaucauucuugauaauaauuaguugguaagacugauguaacuacaauguuauuagauagcauauaaaaaauugacacaaugcaauagauaaaaguauauauuuuaauuguaauuauacguaauuuuuuuucagcuggaggauuggaagcugcuauagucuucagcuauuaggucaauacuaugcauagcauuuugaauaagaugauaacuguagauuaaaugaucauuuuguuacauuuuuaacagcacauuuauauagucaaagcccuuuaaaauaaacuuuuuuuacucccuauaauuaacauaauaugccuuccaucuccagaauaaaaacaagucuuuuuuuuuccuuuuguauguaaaucaccaguuuguaucacauaaauguaauuacagaugauuccagaagauaauuaaacuuuguuaucuuaaacaucaaagcuacuuuauuuuaugcuuuagcuaauguauauucauaugaacaaaauuuugauaaaguauuuuccuucuauagucuacuauaaauuuaguuaaauuauguuaucccugauaauuuuagauauuuauggagaaguaguguacucuuaccuuucuuacaguuuccuagaaaagaauaaaucaaagauuauuaugaagaaaauuguauauauauauuuaaaaacagcuuccauuuugguguaguauacaaauauaccuucacaauucauuacauuaugcauuuacuauuaucucaguuuaauauuucaaacuacaauuuaaaauuuuaccaacaugucaaauaaaaauauguaccuacagaacaaaaaauacauagcaauacguaccuguacuuaugccucaaauucaacucaugagcuaagaauguguuaacaauaagugcuuuugcaaauaauuccaaaggagugaaaagauucucuagcucagugaaaucuucugcuucauagaagcugauccuaaaacucaaacuucuauuggauuauuuacucuauauuucuuaugaauauuuuauaaaccuagucuuauucaguagccccgccuauuuuggaaaauuggguggguacuuucuaaggcagccagaaagguuuugacuaucauaauucuucacaauuuucuugggaaucuaggauggucaauauuaauguaacuucuucccuuccaagagaagacaucacuguagccaagggaaucaaaguauuuuuaaaaauucuaaaaaaaguuuuacucaccucuuguaaagcuguagaaaaaaaaaagaaaaaguaggaaacaauuauuaguaucacuucauggaucaauagcaauaauuaacaaauagagaaacaaguuuauagaauugaauuaccuaauuaaggaccaauuauauuuuuuuaagaauauuuuaaugaccuagaaauuaugcaggucaaaaguauggcagggaucagcagggugauuuguuugcaauauuaauauguaaauguauuuugaauuaaauuauuaauuauuuacuauuuuauaacuguugugaaauauuaaugugucugaaggauauuuugaaugcuuagcaauuaagcugguaaagugcacagaugaaucgcugaauguaagacuaguagauugaugaggaaauaauuuaugauuuugaucauuuuuaauaccuaaauaucgaaaaaagguaaaauuuaggaaaguauguuaccuuaaaauucuauauugaauuuguuuuuuaugaaacauugaagcugacuuacuuuuuuauaaaacauugaaguuaccuaguacuucauugaguuuguaccauucuuaauauccuuuuucaaaaggucuaauuugcacauuauuaacuaugaaaauggauuaauucagacaucugaauuuugcuuuaaauuaguucacuuaaauuagguaagaucauuuuaccaauauguaucauuuuugucucggagaaagaguuuuguauaaauggaaaaaccggauuaaagaucuugaaaaauaauagaaaaaauaaacaaaaguacuauccccccuuuugccauaauuguuauaaguccuuaaagagugaauucuucuccuacgguacaaaaauuauagguuaauacaggauacaaguguggccaagcuugcaguaggaugaaucaccccaaaaauugcuuuaauuagguggccaagaagugcguuauuugaagugagaacaucuguugcaacagucacaauuuaggaggguggaccacauccagcacugacauuuaagggcaauuuacgagaauuacuguuaaauuacaagaaugauauguuuacuucauuguguccaucaguaggaagaauaauuaugccugacuugauuaacggaaguccuuaugauuuuggaaauuugccuuuuaauuacucagacauggaccauuuugaagaauguguguuugauaacauuuauuccagacugugguuggcuguugaucagaagguaaguugccuuuguaccuucaaauuucccuaagucugccuucauuuuauucucuaggagccgacucuuuccucccacucucaagaucucauuaaaaauaugaacucgguaaugugaauuuguucacugcaauuacuccuuaguauccacaguauguauacuaaaagugaaugaagggggaagagacacacagacacacagacacacacacacacacacacacacacacaagcacacaaaugcauuagaaauuaugcagugguagacaccgugcuguguggguggaacaacuuuuuggaguacuggguguggucagacaauaccaucccccaucuagucaauaucuuugucuagcacuuuggcagccauuuucaagaugaaaacggacugaucuucuucauucucuguugacaugaaagucuggccauggaaccuagagcuggaaaguggccuuggggucccuuuaaucucugucucacauuuuagaaaaggccguuugacuugcccaaagucacgcagcaaauuggugucagacucaugggaaaaaccccggucucuugagucucaucucaauguugauauuucucaacuugcugcguucauaauguuugcuuaucacugggaacaugucaaagggguaauucucaggcucaaacaaaauuuagagcagauuugaguuaaaaaauguuaccauuuccaugacuagaaagugaauugagacacuuauauuacuuuucagaauguacccacuccaaguagcauccauucuucuuuccaggguucacugacuagccacugggaaaggcuccaaccagaaaugcugaucauuaaucuguauaaauccguagaagcuuuaauugggauuccaucugcuuaaggcccuguccccuguacuuucauuuuccuuccuccagagggcgccuuauaaccaucaucauaucagcaucgucauccuccuccuccggacaagccuuacaaugcccagaagauaaaagcucuuaggaggugaguuuuacauuacucaguugaagggcuuucuaacgcaggccucaaguuuuacaagguggacaucagugcgguuauggggccuguggggugcaggcccuugacuuccuccaccacauuggucguuaauaucucauccuuagggaaaaagaccuuccgcucccuuuggggguuacuaagcugaggagccagaccgaguuaacugucucacucugaacuuagaggaaaaguucccuaacuuuuggcaaggcuuuuauguuuucauuuuuuaaaguaauuuccauguuucuuaucaauuccggcguuuucccacaugccugagagucugcccuccaaguguaccuggaauucagguuacagguuuuccuuuucagggcagggugcccucccaucuaaccucucuacccagucucccccaaacaagcugaaggcacuuacauuggcauguugcuaggcauaagguuacugcaagcagcaacaaaguccgcguauccacaaagcugagcaugucuagcacuuagacaugcagacuccuugugucgcagagccccugggucaccggcggagguaucaccuggcgggcgcgggcaugcagucguggccaguaccuccaacuuagccgaaaccuccugcugccguggugcuaaaauaauaaagcccggaucugcccuauuuauacggcaaaaguuucccuggcccuagggugccuccaaaagggccuccaccaaugggagggcuggggcugggggcccgggcagccacagcugggaggagccugcgggggcgcagaggagggagcgaaugggggaagggacguggccacggggcuggcuucuuaaauugguuccauucuuuuugaggacguggacacuuuugaggcuuucaaggggaaacucugacucguugucugcauaccuccgcccuccgcauccucccgcccucccccgcccuuuccaaguuuggaaacacuaugggacacgucggagugcucugcagccccgacaugggcagaauuugcagaucuccggcgaucaaagcaggagcuguccagucccgccucaccugugcccuguaggccacuuguaggguggagggcuccagcgggagcggagggggcagagaaggagggagggaagacucgauagcguggcgcagccggagcccgccuccccgccccuccaccccugcaccccgcccccagccccguccagcuuuucucuagcuuuggggcucgugugcgcccacuguuucagcagugaugcacucucuuugucuuaugacuucgggaaagggcggguccugucuguggagggcuggguugcagucggagggcgccuuuuguuggcaggugggcuggggagcaggcucgaggcugcuuggcacccggcuacagggaggauaggcuuugcgaacucuagacuagaccgagucaccuggggaaguccuucgaccuccuagcuugccuuugcugaggcucauuccaaagagggucuuuugggggauggucuggcacuccgacacgacuccaaccgaccuggagaccgagaacuuauuucucagucucuccuuucugaggcugcggugggggaucuuucaugguuuccagucuccccuccccuucuccaugggcuccuugucuggauuuaccaguucuacccugagccuggacccuucaacccucccgugagcccccc

SEQ ID NO: 14531 - RNA, 16274 nt, Homo sapiens
uguaggguuuuauauaaaaauggaagauacagucucuacucuuaaggagauuaaaacacaaacaucuccucaauugacaaggucucuuuccaugcuuucuaucugggcuaagagacuuauccuugaaaaauguuuguggguaaacauuuuuuacucucugcuucccauuguccuauccucuucuccaugccugccauccuuaagaggacugaagcagguuauagaggaaucgcagcugugcacucccacuacccucaucucuucagucaccaugucauuaacagcaucucucucugcuauauucucccuccuuucaauagcccagccuucuuuguguuucaaagcaggcaagaagccugucuagcuagcuguuuaaauuggaauucuucuagaguuugauucuucauuuucuucuuucuccacuaaaauugauuucacauguguuugacucaagggugaaccuggugugguuggugcugugggcacugcugguccaucugguccuaguggacucccaggagagaggggugcugcuggcauaccuggaggcaagggagaaaagguacguguugaccccuauuacauauuguugaugaacucuaguaaagaaggcugcacaaggaugcccaaguuuucacaauucuuggcagguggucugguagcauuuucauaucuaucuauauacauuucccucugccaccuagcaccuacacauuucuaaacucacuaaucuggcaaaauuccuugcuaccauggaauuucacacaaacagaugguguugaguaauacaugaggcucauuuuaaugccacuaacaauaaugccucauccuguccuaauuaaugggaagaagcuacauugaacagcugucaaccaugcugcugcauuaguuaugccguaagagugaucaggcgcugcagcccauugugauguugccuuacaauucuguccacaugaaucuguaccuugcuugauuaugcuucaggagaguguacggaaauuagaaaagauuguuuaacaauaaucuggaaauggccuugaauuauuuuuuccucauuauuuuucucgauuaacauucuacagaaugguaaggaaucgagacauugcuaaaaaucuuaaaugacugaagguaucauagcaucuucuguaaaaaagaaaaaaacuucauauuaauuucgauucaaaauuuuggucagaaaacaaaaaguugcucuugcuuuauacuuucagggugaaccuggucucagaggugaaauugguaacccuggcagagauggugcucgugugaguagaauuuuguuuguauguuucuucguacuuggauuuuuuuuuuauguuugaauugagaaguuuuccaaauuagaacuacacacacuuuauuuaucaaguuuaauaaaauaauauuccuuucucuccugggucuaugacuaauaauaucauuuuacauguuccaaaggaaaaauuaaaugggauuuaaccucuuugaaaauaauauccugaauuuucuaacuucccuagugucaaugauaccaacuacaaacuauagaccaaaagcuuuagguuuaauagaauauuaaaugauugcuucaagugauaacagagauuaaaauaaauaaauaaauaagucuccuaugcuuuaggaagccgggaccucuaacaagauucuauaguuauucaaaccuacucccuagaaauuuaucacccaaagagcagccccaaagauuagcuguuaaugccaugaagaugccaaagauaaucccaugacagucuaauuaccuuaucucguaugucagccucaugggucuucuaggccacagucggccuggauuccuuuauucaccucuccuucagagcugaaaacugacuguagcacaucuguaauagucuuucuuuugaaucacguaguucuaacaguuucaaacaaggcuacucauuugcugcucuccagggaauuuuacaauagcggaaaguucagaucucccaaauuucugaccugcuauugacuuacacauuuccauaaccuuuauuacuggaguacccuccuucugagaguggcuucuaauagucuuguuaauuagaaccaaaauacaucagaggccuucuagauauccaaccagagugcagugaaaguguucagucacuguauaagcacagaaaaaaagaaugacaagguucacuuuugaugauacgggguguuauuaauaagacauguuuccuuuuugguacuagggugcuccuggugcuguaggugccccugguccugcuggagccacaggugaccggguaagcaugcauuuucacuaagccaacagcaauaucuaaaauuucccgccuucccuagucccaaagagccccagcaauucauuuuuauggcuugguauaaagccuacuuauuuaaaaaccuagcuauugugauagagcagcaggaaacaaaugcuguguguuuaaaauuacuuuucccuuccuauagauuugccagcuaucugaucuauacucuaaucccuagcauuuguuuuaaagucucuccauguugcgcauuaacaauauccuaaugcacugaggcuucucaaagccuucaauuauuaccaaaaaaucaauaaaauacauagugugcccauuucacauugaacucuccacuuaaaauagaucuuauuuauuguauugcaaagauugccacaaauagaucagccccguguccaucuaaaaauuaaaauguccuccuccugguauuguaggcacugauuuauaguguuuucucaaguguauaacccauacuacuuaacccccaaaaugaauauagcauuaaguaaaaauccacuucauuuuacucugugagaugugcgucaguuaucucuuccaaggcaacuacagacucugucuguccaccacuguucucucucccucccaguucuuugagcaucuaugucaggcacauuaacagauucaucuuuggucccauuauagggcgaagcuggggcugcugguccugcugguccugcugguccucggggaagcccuguaaguaagaaccugggucauuuuguauacucacaccucacaauguuuagacauugaugaaccuaggauugauaacacauuuuuaaaucccuucucccaccuagggugaacguggugaggucgguccugcuggccccaauggauuugcugguccugcugugaguaucacauaaugaagauuaaucugaaaacauccuaaguuggggaguagagugggucggaauaccagagcuguaacuguuuauuuccaacagggugcugcuggucaaccuggugcuaaaggagaaagaggagccaaagggccuaagggugaaaacgguguuguuggucccacaggccccguuggagcugcuggcccagcuguaaguugaauucacuggugguccacacagcagcuacccauuagaucuuccaauuaaauauauauccgucaagugccugcuaugcaacagggaauauaccagauagaagauggaaaauaacggaaggauuaacauuugcacacugcuuuacaaaguauaaaaguuucaugaauauuguuuuauuuuaauucucugauaaccucauaagggugguaauauugaagaacauucugacacagauagucauuuuuuauuucuauauuuucuucuaagagaugcgggaaugauccacuugaagaaaagaguagcauuuacaaggguuuguuugugauuugacuccaucuuuuuguuugcauuuaggguccaaaugguccccccgguccugcuggaagucguggugauggaggccccccugugaguauuuacaauggacucucgccgcuuuucuuuuuucagaaucuauuaaggacacuugaaaguuuugaaauuuuugguaaauuuggacuaccaugaggaaacuuuugagauucaaguucauucuauucagagcaauuccgauauugauguuaacuugaacucagcuggaacucaguguauguugcuaucagcucacuugagguaauaaccaaggugggcccuaggcaguuuaauuguaaagucggaaaaaauauuccuuuuggcguuuauuaauaugccccuucuucugccugaccauguccuucuccuuugcaggcaaugcuaucacaacaauucucuagagacccagagcuccccaaaaaugaacuuuacugacuucuucucucacuggacagugcugaauuaucuaggucauuuguuauucuuuuguccaugaacaccauuaccuauuaaguguccauuuccuuaccacucagccaggugguaaagauaguuauuaauguauacacauuaauguguaauaaugacauagugucuuaucuucauaccuuuacaaccauaagauaauaugucagcauuucagaaaggaccauccaaaccuuaacgcaaaauaugggcauugcaacugguaauaugcugguaaggaagauguguggagaaggagggccuucaggguccuggcuaaauaaugcccuauaugaagcugccuaccuccuacuccuuggucuauuccuggucacauguacugauuuuccaaaacaaagaaauucccaucuuacccaaauucuuggaguugauguugacuguggaauucuaaugugcuuggcucuuaggguaugacugguuucccuggugcugcuggacggacuggucccccaggacccucuguaaguaaaucacuguaaacgugucuucauuuacucuagccaaaaggccuggcuucugauaggaaacugguaagaaacucuucaugaaaacacaucacuaauauucgcuauuacucuccuggucugaagucagcuuuucugaaccauuaagguauuucaucacaaguuauauuuuauaauaucaguuuaagaggcuuuuauucaugugaacaccaguccccuuucaggggcauggucuuuuugaaaaaaaaaaaacaaaaaaacgaacaguuuuagccacauaucagauauuucuauaucuaauuauccuuuauggcuaacauucugccuccauuguuaagguauaauuguuccugaauuuaaaggugguuuggccucuaauuuaauucugauucagacucuccugucaggacucaagaaaauuuaauuaauuaccaaggauuaagucuucugguuaagguuucugggaaaaaaaaauagcaaagauguugauuucuuggaauccuuuuacagguucauaacagaaaaaucuucauucccuguaggcauuuaauuaaaccuaguugagaagugugugggauuccucaauuaugaacaaaacacguauauuggcuuucuuuaaaaaaaaaaaaaaagaagaaaaaagaaaaggcaaaguccuucgaaacucagagucccauucauuuaucauuaacuccuaucauucuacauaguucugauuccaauaugccaggguaccaguggcaugacauuguuuuuccucauagaaauuugccauagucucuccuccauuauuugguugguuacagccucauaaaggaagacaggaguugcuucuuucugcaagaaagaagguuaaaaacuauaaauauuucccccaaauggccaggguauuauuuuauugcaucacauuguuugcaucuuaagaucuagaaucuuugcugcucucuuccaggcccuuggugauuaacagaaaggaaaugaccuuguacauuugcucauaggguauuucuggcccuccuggucccccugguccugcugggaaagaagggcuucgugguccucguggugaccaagguccaguuggccgaacuggagaaguaggugcaguuggucccccuggcuucgcuggugagaagggucccucuggagaggcugguacugcuguaagugauuuccaacuccucuuucuuaauaccuuaugcugaauuaaaauaaagccccuacacaaaucuucaaguggcaucuauuuguugaugaguauugcaggcucucaaguagagcucaguugagccaggaaaucuguccagcacacacugaggggcuguggcuuccaagaugcucagaaagcacaaaaucgggaagacaauaaaugagggaacucaguuuuaucacaaagcccuuaaagcuauugaaggcaccuuacugguaccaggauuagaacagagucccauugcuguggccauccuacuacauauuaaucaaucucaguaggcuaccaauuucuuaaacauacacuguccaguauuagugcuacucugaaaggugccccuauuagaccuuagaggccaaagucaaaauuugcuuccuuuugauauacugauuuuacugauuuccuuuuuguuuuuguuuuuuguuuuuguuuuuguuuuuuuguuuugggauggaguuccccucuguugcccaggcuggagugcaguggcacgaucucagcucacugcgacuuccgccuccccaguuuaaguaauuaucuugucucagccucccgaguagcugggacuacaggcacacaccaucaugccuagcuaauuuuuguauuuuuaguaaagacgggguuucaccauauuggucaggcuggucucgaucuccugaccucaggugauccacccaccuugaccuccuaaagugcugggauuacacaugugagccaccccacccagccugauuuccuuuccuuuguguauauacccagcagugugauugcuggaucuuaugguaguucuauuuuuaguuuuuugaggaaccccuccuacuauguacaacuauuauguauccauaacaauuuaaauuuuuuuauuuguuucccugccuagaggcuauaaaaacucuauuucaccaccccaagugucuuuauaaaucucaaccacauauuuuuaaauguugugccauuggucucaaggaugaaucagauacaaaaguauucaugccaagauguaaacucaccgucaucacuagagaaaagauauccaaggauauguccuaguaauaggaggucauuagccuuuuucuaagcugaagacaguuuauucucacaaucuucaagccaaccuguguuaucaccuagggucuuacccauaauacucaguauuuuuucucuauuuagggaccuccuggcacuccagguccucagggucuucuuggugcuccugguauucugggucucccuggcucgagaggugaacguggucuaccagguguugcuggugcuguggugagugcuugacaguauucugacuccauuaacauaagaaaagauuuuaaaagcugccacuucaaaugugacagauugaucacugaauaacuucacuuaagauuuuuauucauggcauuuucuuuauacagaucacaugucacuuaucuaagaagcuuuaauaccaccuuacuuagacacacacuauaaagacacagcuuaaaauuaugcagaaugauuuuuguucuuuccacgcacuuaggaaugauacaaucucuaauugcguuuacuccucugcaauaugaaaugcuggcaucauuuauccuguaggaagaaugaaacucuggaaguucugaaucguuccauuaaaccuuauacgugacaacaacuagaaaccaucucaucuccauaaaauauaucaacuuuuugaauucauuucauuugggauacugaaugacacgaggcucacuuuuuacagagcaacaucccgugauuacauaaagcuggccaucuacauguggagaaggagggcagagaugauacuaaugauacuucuuaccauugugugacccauucacauucaauuuaccuucuuccuucaaacuagaaucuccugaguaggguuguuuuggaggggaagguuagcauuccaucgaauaaggggaaugucauuuuaucuucucugccuguuuagggugaaccugguccucuuggcauugccggcccuccuggggcccgugguccuccuggugcuguggguaguccuggagucaacggugcuccuggugaagcuggucgugaugugaguccaacacuugguuuguaaaauaaaacugagcaggauuucauugugugaaacuuuauguccugagcugagguucucuucuuccaaauuucugaacaagauggucagcuucuccauaguaucuacaccuaguacugaaaauaugaaaauugcuuaggccaaagaaugggcuuuucaauagcacacugcaaaacugggcccaaguauuuaaaacaucucuaaaaaauaucuagguuggcagguuuuuaucccuaguuuuaacagucugaaagaggguucguuacugagcacuggaagugaugaagacagaguagcuacaacauaggggcugguaggcagcagagccucaccaacagccuuaauuuguguggugucuucacagggcaacccugggaacgauggucccccaggucgcgauggucaacccggacacaaggucaguacacuuuucaucuuucucuaauucaaaagugauuaaaaugcaacccagauugaugcuaagcuucauuuugccuuugguagggagagcgcgguuacccuggcaauauuggucccguuggugcugcaggugcaccugguccucauggccccguggguccugcuggcaaacauggaaaccguggugaaacuguaaguuugugaauaccagucccucagugcagcauucucgugggcuucacuucugacuuccccacacuuggggaugguggaggaguggggagggguaucuugggccuagcuaaguuguguuuuucuuuuucauuucacaggguccuucugguccuguugguccugcuggugcuguuggcccaagagguccuaguguauguacaugcugaagauuucuuugcaacacuaacauuuagagagaaucaguccaaaacaucuguuaagaaaauaaacaauauaucagcuagacuuaauauuuuuuaaaaauuucaguccaugcugagaauugauacaaauaacuugagcuauuuuaaaucucuuaugcuuguuuguauuaaacaauuacaaggaucuagccacuuuacagauagcacaacuaaagcagauuaccagcagaggugagagccuagcuaaaccauuacauguccugaguuaccuuuguaaacgaauuaagcaguauuuguggugaagugagugccauuuuuuuaaaacgguaagucuuauccauccuucuguuucuuuauagggcccacaaggcauucguggcgauaagggagagcccggugaaaaggggcccagaggucuuccuggcuuaaagggacacaauggauugcaaggucugccugguaucgcuguaaguaaacuguagccaucucgcacauaaacugauccugaaggccuucagcucagaaggauuuucauauuuucacugcuauuguuccaguauagccuauauaauauccauuucccauucucuggcuaacuccaucucacucuuggagguaaugcuauuucauaccaacaugaaaggugaggauuaagggagauagaaauagacauacaauaaaaucuccugguaacaauguccuucaaccccacuuaaaauaaacauaauuagaggaaugacuaauauugcacugcugaaauagguugugaaaaaaaaauugaauauaauagacauaaugggagaaaagagccccacuuuacauuuucaauuuucucaauccggaguccauuuaacuaaaguuucccauucaauuuggaaaaaaaaaaaaaauaugucucuugacaugugcucugaaagugugauuuuccucuucugucuuuaaagggucaccauggugaucaaggugcuccuggcuccguggguccugcugguccuaggguagguggacucaagagaagacaguucaucucugaaauagaggcuaaagcgagcagugagccccaggcugcugcucccuuggugggauucaccagcucacauguaccuggugucugucuuccuuagggcccugcugguccuucuggcccugcuggaaaagauggucgcacuggacauccugguacaguuggaccugcuggcauucgaggcccucagggucaccaaggcccugcuguaaguaugauuuggggaaauaauaaagaagaucacggaccuaaggaauguuuucuucagacuaaaccaagacaacuuugacaacccauuaaaguuagccccauuucaauauauccucuaaaauaucuggaaauugucuauaugcaaugggcuuguuaaguccaucccugcaagugugccugggggcucguuauuuauuuaugugaacuugauuauuuuuuacugaugagaacaugcuuccgugugaagcucaacugaaaaucugcugccauggaugucucucacuguaacaaaauauaaagccucuccuaucucacuuucaccuuugcagggccccccuggucccccuggcccuccuggaccuccagguguaagcgguggugguuaugacuuugguuacgauggagacuucuacagggcugaccagccucgcucagcaccuucucucagacccaaggacuaugaaguugaugcuacucugaagucucucaacaaccagauugagacccuucuuacuccugaaggcucuagaaagaacccagcucgcacaugccgugacuugagacucagccacccagaguggagcagugguaggucaagauguccagaccagacugacccuucucacaaguugagcuuuucaaaauuaguuuccauugacauuuagagugaaaaugcauuuggguaaagauuacauuaugugaaaucacacccaauuaauggagcgucaucuucucccaaccagcacccaaccucauuucccuuaaaauguauuuuugcacuuuucauaguaauaaguacccugauuugauuuuucauggaggaggggagggaaggaacugucuaaucuuaaaaauagccacccucuuccucuuaaauaugggguagacaaucaaaaauguuacuuaugagagucaguaucuuucauuaguuauuauuagaaucuguguucugcucaaugagaaguuucaugaucugaauguuauuuucuuaaaagguuacuacuggauugacccuaaccaaggaugcacuauggaugcuaucaaaguauacugugauuucucuacuggcgaaaccuguauccgggcccaaccugaaaacaucccagccaagaacugguauaggagcuccaaggacaagaaacacgucuggcuaggagaaacuaucaaugcuggcagccaggugaggaaucccacaaacaccucuccuucugcuaaauaauauuuugguaggacuguuuguuaauuaucugcauuuuaaucucugacaaaaaugggcuuauuaaaaaaagaccuguuccuuuccuggguuccaauuuuguccuaaauugcacauuagaagauggauugauuggacacauccauguaauucaaaguuauuauucaaauuugacuuaauugguaaucauugaaaaaacugacuaaugucauuuagugugaaggagcacuggccagcuauaugccacacucauacauaugcauuuucagaaugugagcagcuuuucugaauuuuuaaucaaaccuuuucaccaacuuuacugaaugccuacuggaauuccauaaauuacaaaaugacagaaaaagaaaaaugucagaauuucuaccuccucauucucuuauucuaaagaagaagcauaugcaaaaaggauuaauugaaacagauaacuuuuuuagaugaccuugccucagucuaguaggucuuauguucaucuagguaacugauacuucaaagacaagugaauuaaguuuucuuuaaaaguacccuuuuccuaagcuuggaucugagucuacucuuccugagaucuuuuuuuuucuuuuuuuuuuuuuucauguuugacucuuaguaucugaguccuucuccacuuaacuggaauuucauccuauuuucuguaguuugaauauaauguagaaggagugacuuccaaggaaauggcuacccaacuugccuucaugcgccugcuggccaacuaugccucucagaacaucaccuaccacugcaagaacagcauugcauacauggaugaggagacuggcaaccugaaaaaggcugucauucuacagggcucuaaugauguugaacuuguugcugagggcaacagcagguucacuuacacuguucuuguagauggcugcucuguaaguaauagugaaauaugggaauagcuuugggaagugggauggaggggguucuaacuuagacugcccccaagggggggucuaaagggggguuaaaagaacagaagaaugagagaacuaacuuauuucauaaguaaauucaguuuuuguauguauuuuauauuuauuuauuuauacguauuaauuucguacuuaaauucagaugauaaauucagaguauucuuaucagauagugccuucugaaaugcugaaauguauacuauguccaugcauuguuuuuucuuuagcauguuuuuuaaaugguaaugugugcccagaacuuaaaauuucuugagacuucaguggccuaaacuauaauuuauaguuauguguauuuuauuuuacuuauuaguauggccuacauuuaacuuuuaaugcuuuuucuacaauaugcuauaaauauaagaaaaauuaaaauucacuaacagcaagacuacauacccacccaggucccgcucccaaagacacacauagagggacauacacacaacaauccuaaaaaugacuuuguagagauaggucacuuggaauguguguugaaauguuguugguuuuuuugguuuguuuguuuguuuguuuuuuguuagacugauagggagccccucccacuaaagacacccuugauacuguuauuucaaggaugaacuuauuuaucugggacagacaucuucagaaugacacaugccaaacagugguucuuauuaaaucaaagguucagauauuaucagauucagaaauagugaugcuuuguguaucuauuuucuucucuuuaaacagaaaaagacaaaugaauggggaaagacaaucauugaauacaaaacaaauaagccaucacgccugcccuuccuugauauugcaccuuuggacaucgguggugcugaccaggaauucuuuguggacauuggcccagucuguuucaaauaaaugaacucaaucuaaauuaaaaaagaaagaaauuugaaaaaacuuucucuuugccauuucuucuucuucuuuuuuaacugaaagcugaauccuuccauuucuucugcacaucuacuugcuuaaauugugggcaaaagagaaaaagaaggauugaucagagcauugugcaauacaguuucauuaacuccuucccccgcucccccaaaaauuugaauuuuuuuuucaacacucuuacaccuguuauggaaaaugucaaccuuuguaagaaaaccaaaauaaaaauugaaaaauaaaaaccauaaacauuugcaccacuuguggcuuuugaauaucuuccacagagggaaguuuaaaacccaaacuuccaaagguuuaaacuaccucaaaacacuuucccaugagugugauccacauuguuaggugcugaccuagacagagaugaacugagguccuuguuuuguuuuguucauaauacaaaggugcuaauuaauaguauuucagauacuugaagaauguugauggugcuagaagaauuugagaagaaauacuccuguauugaguuguaucgugugguguauuuuuuaaaaaauuugauuuagcauucauauuuuccaucuuauucccaauuaaaaguaugcagauuauuugcccaaaucuucuucagauucagcauuuguucuuugccagucucauuuucaucuucuuccaugguuccacagaagcuuuguuucuugggcaagcagaaaaauuaaauuguaccuauuuuguauaugugagauguuuaaauaaauugugaaaaaaaugaaauaaagcauguuugguuuuccaaaagaacauauugaguaaaauuccuugcuucaaugcucuuugcaauauaaauaugcaucucuaccagccauuagaccaagugccucugauuagauagaaauuaugcaaaaagggcaguuuggugugguagaaagagcagagaacgaggacccaggagagcugaacuccaguucuggcucuguuccuuguggcugagugaccuugaaacucugagccucugcauuucaguuuccauagcuauaauaugaaaaaauuccuuuucagcacuauuaagcauuugcccuacucaaaauauguaauauuuaagcaacauggcauuuuugaccuaauuuuacuauaaccaaaggucuauagaaacuugguuuauuauauauuaagcacuuuauaacaguggcugaaaguuggucuaugagcaauuaauacuauuaacuaaaacaguuucaaauauucaguaaaaaugccauacacuuaaaucugaggcaacugaauacaaugccuguuaagagguaaugugugugcugucaaucaggauagacaguuguggauaauaguaccacgaacaccuaccugccaaaucaaguucauuuuccuccccugcaccuuucaauaacaucuuuaauacacuuaaacauaguaaugugucaaguaaaauguuaagauucauuuagagcuuauuuccuguugcagaacauaauugugauuguaauauuugccuuguguuauaagucaucucaagauucaauuaguuuuaaaggcaaaagacugaacaugguaaaaauguaauauuaaccuuaaaaaguuagcaaggucuccuaaucaaaaugcagauuccugguccucaucugccaaauucagauuuaguaagaaauugcuauucuuacgcauccugugaaauucagaugugcaccaauugaaggaccaccugaugagguuacugccauaguccuuuguagcucuaauauucugugucugacaagaaggaauauauauaucugaccaaaccauauauaaagauaacuccugggauccgaaugcugguacucucuauaaauuaguaauuaaaaugaccaugcaaacuuacaugauaaaacagaaaucucuggaucaaauaugaacuauacccucagacuuauagcaaaaaaaaauaaaacgcauuuauugaguaccugcuagaggcaaaagccaugcuaaauaauaauaaugaccuuugucaaacugaaucugaauuagcagauuuccuaagccaaugcucacuuaauaaucacuuaaucaucaucagugugagacaacugaaaauagucaaauaaauaaugguacaccuaauggauuacaaugaggaaacaaauuaugguauauccaguaaacaaugaggaaacaaauuacaguauaucuaauagauaacgauaggaugaauagugaaauaaauuuugguaucccaauaacauuuauaaggaugauuuaacaaaagaaaaacuucuuagaauagaauuuucaaucuugaaaaucuaauauucaagaacacugucauuauaauuagauauuuuaaauauacauguaaaaaaaugcugagaguaggcacauuuguauagaaguuuaaggaugauuuuuaggccuaaaauuuucaaauuugcaacaauguagcuauauuacauuauuauuuacaacaaauuuacucuuaaaauauuaugaaagaagcagucaaaagugaaaagaaucugguucaggaguagccaucuccagggaaggaguggucaaccucccacccaccuguuuccugaagagaaggacaagccuggccuaagggucaucauccaccauggaccagccauccugagagaagcuugggaggguguacaaagcucuaccaggccacagcaucuucagggagcucagggagcuuauagugcgguuccagaggcagaauaaaauaaugugugaacagaauuuuaaauuacauauccucugaggauaacagaagacacuauuaauuaauuagagggagucucgggaaauuaaccuuugucucacacaguaacugauauuuggauugaacuggccucucuugauagagaucucauuucaccuucaagcucucuggcucaauccuucuucucuggaagucacauauuaaaacagccugguacuuaccaagccaggagguccacugugaguguucccagggccuagacucaaauguggacauagagcaauagacugaagacuuggcccuuccaugacgagcccacucuuuagaggcugaucaccaggcccaaagcauacuccucacaacauuucuugacccuugguggagugaaggucagc

SEQ ID NO: 14532 - RNA, 16274 nt, Homo sapiens
gcugaccuucacuccaccaagggucaagaaauguugugaggaguaugcuuugggccuggugaucagccucuaaagagugggcucgucauggaagggccaagucuucagucuauugcucuauguccacauuugagucuaggcccugggaacacucacaguggaccuccuggcuugguaaguaccaggcuguuuuaauaugugacuuccagagaagaaggauugagccagagagcuugaaggugaaaugagaucucuaucaagagaggccaguucaauccaaauaucaguuacugugugagacaaagguuaauuucccgagacucccucuaauuaauuaauagugucuucuguuauccucagaggauauguaauuuaaaauucuguucacacauuauuuuauucugccucuggaaccgcacuauaagcucccugagcucccugaagaugcuguggccugguagagcuuuguacacccucccaagcuucucucaggauggcugguccaugguggaugaugacccuuaggccaggcuuguccuucucuucaggaaacaggugggugggagguugaccacuccuucccuggagauggcuacuccugaaccagauucuuuucacuuuugacugcuucuuucauaauauuuuaagaguaaauuuguuguaaauaauaauguaauauagcuacauuguugcaaauuugaaaauuuuaggccuaaaaaucauccuuaaacuucuauacaaaugugccuacucucagcauuuuuuuacauguauauuuaaaauaucuaauuauaaugacaguguucuugaauauuagauuuucaagauugaaaauucuauucuaagaaguuuuucuuuuguuaaaucauccuuauaaauguuauugggauaccaaaauuuauuucacuauucauccuaucguuaucuauuagauauacuguaauuuguuuccucauuguuuacuggauauaccauaauuuguuuccucauuguaauccauuagguguaccauuauuuauuugacuauuuucaguugucucacacugaugaugauuaagugauuauuaagugagcauuggcuuaggaaaucugcuaauucagauucaguuugacaaaggucauuauuauuauuuagcauggcuuuugccucuagcagguacucaauaaaugcguuuuauuuuuuuuugcuauaagucugaggguauaguucauauuugauccagagauuucuguuuuaucauguaaguuugcauggucauuuuaauuacuaauuuauagagaguaccagcauucggaucccaggaguuaucuuuauauaugguuuggucagauauauauauuccuucuugucagacacagaauauuagagcuacaaaggacuauggcaguaaccucaucaggugguccuucaauuggugcacaucugaauuucacaggaugcguaagaauagcaauuucuuacuaaaucugaauuuggcagaugaggaccaggaaucugcauuuugauuaggagaccuugcuaacuuuuuaagguuaauauuacauuuuuaccauguucagucuuuugccuuuaaaacuaauugaaucuugagaugacuuauaacacaaggcaaauauuacaaucacaauuauguucugcaacaggaaauaagcucuaaaugaaucuuaacauuuuacuugacacauuacuauguuuaaguguauuaaagauguuauugaaaggugcaggggaggaaaaugaacuugauuuggcagguagguguucgugguacuauuauccacaacugucuauccugauugacagcacacacauuaccucuuaacaggcauuguauucaguugccucagauuuaaguguauggcauuuuuacugaauauuugaaacuguuuuaguuaauaguauuaauugcucauagaccaacuuucagccacuguuauaaagugcuuaauauauaauaaaccaaguuucuauagaccuuugguuauaguaaaauuaggucaaaaaugccauguugcuuaaauauuacauauuuugaguagggcaaaugcuuaauagugcugaaaaggaauuuuuucauauuauagcuauggaaacugaaaugcagaggcucagaguuucaaggucacucagccacaaggaacagagccagaacuggaguucagcucuccuggguccucguucucugcucuuucuaccacaccaaacugcccuuuuugcauaauuucuaucuaaucagaggcacuuggucuaauggcugguagagaugcauauuuauauugcaaagagcauugaagcaaggaauuuuacucaauauguucuuuuggaaaaccaaacaugcuuuauuucauuuuuuucacaauuuauuuaaacaucucacauauacaaaauagguacaauuuaauuuuucugcuugcccaagaaacaaagcuucuguggaaccauggaagaagaugaaaaugagacuggcaaagaacaaaugcugaaucugaagaagauuugggcaaauaaucugcauacuuuuaauugggaauaagauggaaaauaugaaugcuaaaucaaauuuuuuaaaaaauacaccacacgauacaacucaauacaggaguauuucuucucaaauucuucuagcaccaucaacauucuucaaguaucugaaauacuauuaauuagcaccuuuguauuaugaacaaaacaaaacaaggaccucaguucaucucugucuaggucagcaccuaacaauguggaucacacucaugggaaaguguuuugagguaguuuaaaccuuuggaaguuuggguuuuaaacuucccucuguggaagauauucaaaagccacaaguggugcaaauguuuaugguuuuuauuuuucaauuuuuauuuugguuuucuuacaaagguugacauuuuccauaacagguguaagaguguugaaaaaaaaauucaaauuuuugggggagcgggggaaggaguuaaugaaacuguauugcacaaugcucugaucaauccuucuuuuucucuuuugcccacaauuuaagcaaguagaugugcagaagaaauggaaggauucagcuuucaguuaaaaaagaagaagaagaaauggcaaagagaaaguuuuuucaaauuucuuucuuuuuuaauuuagauugaguucauuuauuugaaacagacugggccaauguccacaaagaauuccuggucagcaccaccgauguccaaaggugcaauaucaaggaagggcaggcgugauggcuuauuuguuuuguauucaaugauugucuuuccccauucauuugucuuuuucuguuuaaagagaagaaaauagauacacaaagcaucacuauuucugaaucugauaauaucugaaccuuugauuuaauaagaaccacuguuuggcaugugucauucugaagaugucugucccagauaaauaaguucauccuugaaauaacaguaucaagggugucuuuagugggaggggcucccuaucagucuaacaaaaaacaaacaaacaaacaaaccaaaaaaaccaacaacauuucaacacacauuccaagugaccuaucucuacaaagucauuuuuaggauuguuguguguaugucccucuaugugugucuuugggagcgggaccuggguggguauguagucuugcuguuagugaauuuuaauuuuucuuauauuuauagcauauuguagaaaaagcauuaaaaguuaaauguaggccauacuaauaaguaaaauaaaauacacauaacuauaaauuauaguuuaggccacugaagucucaagaaauuuuaaguucugggcacacauuaccauuuaaaaaacaugcuaaagaaaaaacaaugcauggacauaguauacauuucagcauuucagaaggcacuaucugauaagaauacucugaauuuaucaucugaauuuaaguacgaaauuaauacguauaaauaaauaaauauaaaauacauacaaaaacugaauuuacuuaugaaauaaguuaguucucucauucuucuguucuuuuaaccccccuuuagacccccccuugggggcagucuaaguuagaacccccuccaucccacuucccaaagcuauucccauauuucacuauuacuuacagagcagccaucuacaagaacaguguaagugaaccugcuguugcccucagcaacaaguucaacaucauuagagcccuguagaaugacagccuuuuucagguugccagucuccucauccauguaugcaaugcuguucuugcagugguaggugauguucugagaggcauaguuggccagcaggcgcaugaaggcaaguuggguagccauuuccuuggaagucacuccuucuacauuauauucaaacuacagaaaauaggaugaaauuccaguuaaguggagaaggacucagauacuaagagucaaacaugaaaaaaaaaaaaaagaaaaaaaaagaucucaggaagaguagacucagauccaagcuuaggaaaaggguacuuuuaaagaaaacuuaauucacuugucuuugaaguaucaguuaccuagaugaacauaagaccuacuagacugaggcaaggucaucuaaaaaaguuaucuguuucaauuaauccuuuuugcauaugcuucuucuuuagaauaagagaaugaggagguagaaauucugacauuuuucuuuuucugucauuuuguaauuuauggaauuccaguaggcauucaguaaaguuggugaaaagguuugauuaaaaauucagaaaagcugcucacauucugaaaaugcauauguaugaguguggcauauagcuggccagugcuccuucacacuaaaugacauuagucaguuuuuucaaugauuaccaauuaagucaaauuugaauaauaacuuugaauuacauggauguguccaaucaauccaucuucuaaugugcaauuuaggacaaaauuggaacccaggaaaggaacaggucuuuuuuuaauaagcccauuuuugucagagauuaaaaugcagauaauuaacaaacaguccuaccaaaauauuauuuagcagaaggagagguguuugugggauuccucaccuggcugccagcauugauaguuucuccuagccagacguguuucuuguccuuggagcuccuauaccaguucuuggcugggauguuuucagguugggcccggauacagguuucgccaguagagaaaucacaguauacuuugauagcauccauagugcauccuugguuagggucaauccaguaguaaccuuuuaagaaaauaacauucagaucaugaaacuucucauugagcagaacacagauucuaauaauaacuaaugaaagauacugacucucauaaguaacauuuuugauugucuaccccauauuuaagaggaagaggguggcuauuuuuaagauuagacaguuccuucccuccccuccuccaugaaaaaucaaaucaggguacuuauuacuaugaaaagugcaaaaauacauuuuaagggaaaugagguugggugcugguugggagaagaugacgcuccauuaauugggugugauuucacauaauguaaucuuuacccaaaugcauuuucacucuaaaugucaauggaaacuaauuuugaaaagcucaacuugugagaagggucagucuggucuggacaucuugaccuaccacugcuccacucuggguggcugagucucaagucacggcaugugcgagcuggguucuuucuagagccuucaggaguaagaagggucucaaucugguuguugagagacuucagaguagcaucaacuucauaguccuugggucugagagaaggugcugagcgaggcuggucagcccuguagaagucuccaucguaaccaaagucauaaccaccaccgcuuacaccuggagguccaggagggccagggggaccaggggggcccugcaaaggugaaagugagauaggagaggcuuuauauuuuguuacagugagagacauccauggcagcagauuuucaguugagcuucacacggaagcauguucucaucaguaaaaaauaaucaaguucacauaaauaaauaacgagcccccaggcacacuugcagggauggacuuaacaagcccauugcauauagacaauuuccagauauuuuagaggauauauugaaauggggcuaacuuuaauggguugucaaaguugucuugguuuagucugaagaaaacauuccuuagguccgugaucuucuuuauuauuuccccaaaucauacuuacagcagggccuuggugacccugagggccucgaaugccagcagguccaacuguaccaggauguccagugcgaccaucuuuuccagcagggccagaaggaccagcagggcccuaaggaagacagacaccagguacaugugagcuggugaaucccaccaagggagcagcagccuggggcucacugcucgcuuuagccucuauuucagagaugaacugucuucucuugaguccaccuacccuaggaccagcaggacccacggagccaggagcaccuugaucaccauggugacccuuuaaagacagaagaggaaaaucacacuuucagagcacaugucaagagacauauuuuuuuuuuuuuuccaaauugaaugggaaacuuuaguuaaauggacuccggauugagaaaauugaaaauguaaaguggggcucuuuucucccauuaugucuauuauauucaauuuuuuuuucacaaccuauuucagcagugcaauauuagucauuccucuaauuauguuuauuuuaagugggguugaaggacauuguuaccaggagauuuuauuguaugucuauuucuaucucccuuaauccucaccuuucauguugguaugaaauagcauuaccuccaagagugagauggaguuagccagagaaugggaaauggauauuauauaggcuauacuggaacaauagcagugaaaauaugaaaauccuucugagcugaaggccuucaggaucaguuuaugugcgagauggcuacaguuuacuuacagcgauaccaggcagaccuugcaauccauugugucccuuuaagccaggaagaccucugggccccuuuucaccgggcucucccuuaucgccacgaaugccuugugggcccuauaaagaaacagaaggauggauaagacuuaccguuuuaaaaaaauggcacucacuucaccacaaauacugcuuaauucguuuacaaagguaacucaggacauguaaugguuuagcuaggcucucaccucugcugguaaucugcuuuaguugugcuaucuguaaaguggcuagauccuuguaauuguuuaauacaaacaagcauaagagauuuaaaauagcucaaguuauuuguaucaauucucagcauggacugaaauuuuuaaaaaauauuaagucuagcugauauauuguuuauuuucuuaacagauguuuuggacugauucucucuaaauguuaguguugcaaagaaaucuucagcauguacauacacuaggaccucuugggccaacagcaccagcaggaccaacaggaccagaaggacccugugaaaugaaaaagaaaaacacaacuuagcuaggcccaagauaccccuccccacuccuccaccauccccaaguguggggaagucagaagugaagcccacgagaaugcugcacugagggacugguauucacaaacuuacaguuucaccacgguuuccauguuugccagcaggacccacggggccaugaggaccaggugcaccugcagcaccaacgggaccaauauugccaggguaaccgcgcucucccuaccaaaggcaaaaugaagcuuagcaucaaucuggguugcauuuuaaucacuuuugaauuagagaaagaugaaaaguguacugaccuuguguccggguugaccaucgcgaccugggggaccaucguucccaggguugcccugugaagacaccacacaaauuaaggcuguuggugaggcucugcugccuaccagccccuauguuguagcuacucugucuucaucacuuccagugcucaguaacgaacccucuuucagacuguuaaaacuagggauaaaaaccugccaaccuagauauuuuuuagagauguuuuaaauacuugggcccaguuuugcagugugcuauugaaaagcccauucuuuggccuaagcaauuuucauauuuucaguacuagguguagauacuauggagaagcugaccaucuuguucagaaauuuggaagaagagaaccucagcucaggacauaaaguuucacacaaugaaauccugcucaguuuuauuuuacaaaccaaguguuggacucacaucacgaccagcuucaccaggagcaccguugacuccaggacuacccacagcaccaggaggaccacgggccccaggagggccggcaaugccaagaggaccagguucacccuaaacaggcagagaagauaaaaugacauuccccuuauucgauggaaugcuaaccuuccccuccaaaacaacccuacucaggagauucuaguuugaaggaagaagguaaauugaaugugaaugggucacacaaugguaagaaguaucauuaguaucaucucugcccuccuucuccacauguagauggccagcuuuauguaaucacgggauguugcucuguaaaaagugagccucgugucauucaguaucccaaaugaaaugaauucaaaaaguugauauauuuuauggagaugagaugguuucuaguuguugucacguauaagguuuaauggaacgauucagaacuuccagaguuucauucuuccuacaggauaaaugaugccagcauuucauauugcagaggaguaaacgcaauuagagauuguaucauuccuaagugcguggaaagaacaaaaaucauucugcauaauuuuaagcugugucuuuauagugugugucuaaguaaggugguauuaaagcuucuuagauaagugacaugugaucuguauaaagaaaaugccaugaauaaaaaucuuaagugaaguuauucagugaucaaucugucacauuugaaguggcagcuuuuaaaaucuuuucuuauguuaauggagucagaauacugucaagcacucaccacagcaccagcaacaccugguagaccacguucaccucucgagccagggagacccagaauaccaggagcaccaagaagacccugaggaccuggagugccaggaggucccuaaauagagaaaaaauacugaguauuauggguaagacccuaggugauaacacagguuggcuugaagauugugagaauaaacugucuucagcuuagaaaaaggcuaaugaccuccuauuacuaggacauauccuuggauaucuuuucucuagugaugacggugaguuuacaucuuggcaugaauacuuuuguaucugauucauccuugagaccaauggcacaacauuuaaaaauaugugguugagauuuauaaagacacuugggguggugaaauagaguuuuuauagccucuaggcagggaaacaaauaaaaaaauuuaaauuguuauggauacauaauaguuguacauaguaggagggguuccucaaaaaacuaaaaauagaacuaccauaagauccagcaaucacacugcuggguauauacacaaaggaaaggaaaucaggcugggugggguggcucacauguguaaucccagcacuuuaggaggucaagguggguggaucaccugaggucaggagaucgagaccagccugaccaauauggugaaaccccgucuuuacuaaaaauacaaaaauuagcuaggcaugauggugugugccuguagucccagcuacucgggaggcugagacaagauaauuacuuaaacuggggaggcggaagucgcagugagcugagaucgugccacugcacuccagccugggcaacagaggggaacuccaucccaaaacaaaaaaacaaaaacaaaaacaaaaaacaaaaacaaaaaggaaaucaguaaaaucaguauaucaaaaggaagcaaauuuugacuuuggccucuaaggucuaauaggggcaccuuucagaguagcacuaauacuggacaguguauguuuaagaaauugguagccuacugagauugauuaauauguaguaggauggccacagcaaugggacucuguucuaauccugguaccaguaaggugccuucaauagcuuuaagggcuuugugauaaaacugaguucccucauuuauugucuucccgauuuugugcuuucugagcaucuuggaagccacagccccucagugugugcuggacagauuuccuggcucaacugagcucuacuugagagccugcaauacucaucaacaaauagaugccacuugaagauuuguguaggggcuuuauuuuaauucagcauaagguauuaagaaagaggaguuggaaaucacuuacagcaguaccagccucuccagagggacccuucucaccagcgaagccagggggaccaacugcaccuacuucuccaguucggccaacuggaccuuggucaccacgaggaccacgaagcccuucuuucccagcaggaccagggggaccaggagggccagaaauacccuaugagcaaauguacaaggucauuuccuuucuguuaaucaccaagggccuggaagagagcagcaaagauucuagaucuuaagaugcaaacaaugugaugcaauaaaauaauacccuggccauuugggggaaauauuuauaguuuuuaaccuucuuucuugcagaaagaagcaacuccugucuuccuuuaugaggcuguaaccaaccaaauaauggaggagagacuauggcaaauuucuaugaggaaaaacaaugucaugccacugguacccuggcauauuggaaucagaacuauguagaaugauaggaguuaaugauaaaugaaugggacucugaguuucgaaggacuuugccuuuucuuuuuucuucuuuuuuuuuuuuuuuaaagaaagccaauauacguguuuuguucauaauugaggaaucccacacacuucucaacuagguuuaauuaaaugccuacagggaaugaagauuuuucuguuaugaaccuguaaaaggauuccaagaaaucaacaucuuugcuauuuuuuuuucccagaaaccuuaaccagaagacuuaauccuugguaauuaauuaaauuuucuugaguccugacaggagagucugaaucagaauuaaauuagaggccaaaccaccuuuaaauucaggaacaauuauaccuuaacaauggaggcagaauguuagccauaaaggauaauuagauauagaaauaucugauauguggcuaaaacuguucguuuuuuuguuuuuuuuuuuucaaaaagaccaugccccugaaaggggacugguguucacaugaauaaaagccucuuaaacugauauuauaaaauauaacuugugaugaaauaccuuaaugguucagaaaagcugacuucagaccaggagaguaauagcgaauauuagugauguguuuucaugaagaguuucuuaccaguuuccuaucagaagccaggccuuuuggcuagaguaaaugaagacacguuuacagugauuuacuuacagaggguccugggggaccaguccguccagcagcaccagggaaaccagucauacccuaagagccaagcacauuagaauuccacagucaacaucaacuccaagaauuuggguaagaugggaauuucuuuguuuuggaaaaucaguacaugugaccaggaauagaccaaggaguaggagguaggcagcuucauauagggcauuauuuagccaggacccugaaggcccuccuucuccacacaucuuccuuaccagcauauuaccaguugcaaugcccauauuuugcguuaagguuuggaugguccuuucugaaaugcugacauauuaucuuaugguuguaaagguaugaagauaagacacuaugucauuauuacacauuaauguguauacauuaauaacuaucuuuaccaccuggcugagugguaaggaaauggacacuuaauagguaaugguguucauggacaaaagaauaacaaaugaccuagauaauucagcacuguccagugagagaagaagucaguaaaguucauuuuuggggagcucugggucucuagagaauuguugugauagcauugccugcaaaggagaaggacauggucaggcagaagaaggggcauauuaauaaacgccaaaaggaauauuuuuuccgacuuuacaauuaaacugccuagggcccaccuugguuauuaccucaagugagcugauagcaacauacacugaguuccagcugaguucaaguuaacaucaauaucggaauugcucugaauagaaugaacuugaaucucaaaaguuuccucaugguaguccaaauuuaccaaaaauuucaaaacuuucaaguguccuuaauagauucugaaaaaagaaaagcggcgagaguccauuguaaauacucacaggggggccuccaucaccacgacuuccagcaggaccggggggaccauuuggacccuaaaugcaaacaaaaagauggagucaaaucacaaacaaacccuuguaaaugcuacucuuuucuucaaguggaucauucccgcaucucuuagaagaaaauauagaaauaaaaaaugacuaucugugucagaauguucuucaauauuaccacccuuaugagguuaucagagaauuaaaauaaaacaauauucaugaaacuuuuauacuuuguaaagcagugugcaaauguuaauccuuccguuauuuuccaucuucuaucugguauauucccuguugcauagcaggcacuugacggauauauauuuaauuggaagaucuaauggguagcugcuguguggaccaccagugaauucaacuuacagcugggccagcagcuccaacggggccugugggaccaacaacaccguuuucacccuuaggcccuuuggcuccucuuucuccuuuagcaccagguugaccagcagcacccuguuggaaauaaacaguuacagcucugguauuccgacccacucuacuccccaacuuaggauguuuucagauuaaucuucauuaugugauacucacagcaggaccagcaaauccauuggggccagcaggaccgaccucaccacguucacccuaggugggagaagggauuuaaaaauguguuaucaauccuagguucaucaaugucuaaacauugugaggugugaguauacaaaaugacccagguucuuacuuacagggcuuccccgaggaccagcaggaccagcaggaccagcagccccagcuucgcccuauaaugggaccaaagaugaaucuguuaaugugccugacauagaugcucaaagaacugggagggagagagaacagugguggacagacagagucuguaguugccuuggaagagauaacugacgcacaucucacagaguaaaaugaaguggauuuuuacuuaaugcuauauucauuuuggggguuaaguaguauggguuauacacuugagaaaacacuauaaaucagugccuacaauaccaggaggaggacauuuuaauuuuuagauggacacggggcugaucuauuuguggcaaucuuugcaauacaauaaauaagaucuauuuuaaguggagaguucaaugugaaaugggcacacuauguauuuuauugauuuuuugguaauaauugaaggcuuugagaagccucagugcauuaggauauuguuaaugcgcaacauggagagacuuuaaaacaaaugcuagggauuagaguauagaucagauagcuggcaaaucuauaggaagggaaaaguaauuuuaaacacacagcauuuguuuccugcugcucuaucacaauagcuagguuuuuaaauaaguaggcuuuauaccaagccauaaaaaugaauugcuggggcucuuugggacuagggaaggcgggaaauuuuagauauugcuguuggcuuagugaaaaugcaugcuuacccggucaccuguggcuccagcaggaccaggggcaccuacagcaccaggagcacccuaguaccaaaaaggaaacaugucuuauuaauaacaccccguaucaucaaaagugaaccuugucauucuuuuuuucugugcuuauacagugacugaacacuuucacugcacucugguuggauaucuagaaggccucugauguauuuugguucuaauuaacaagacuauuagaagccacucucagaaggaggguacuccaguaauaaagguuauggaaauguguaagucaauagcaggucagaaauuugggagaucugaacuuuccgcuauuguaaaauucccuggagagcagcaaaugaguagccuuguuugaaacuguuagaacuacgugauucaaaagaaagacuauuacagaugugcuacagucaguuuucagcucugaaggagaggugaauaaaggaauccaggccgacuguggccuagaagacccaugaggcugacauacgagauaagguaauuagacugucaugggauuaucuuuggcaucuucauggcauuaacagcuaaucuuuggggcugcucuuugggugauaaauuucuagggaguagguuugaauaacuauagaaucuuguuagaggucccggcuuccuaaagcauaggagacuuauuuauuuauuuauuuuaaucucuguuaucacuugaagcaaucauuuaauauucuauuaaaccuaaagcuuuuggucuauaguuuguaguugguaucauugacacuagggaaguuagaaaauucaggauauuauuuucaaagagguuaaaucccauuuaauuuuuccuuuggaacauguaaaaugauauuauuagucauagacccaggagagaaaggaauauuauuuuauuaaacuugauaaauaaaguguguguaguucuaauuuggaaaacuucucaauucaaacauaaaaaaaaaauccaaguacgaagaaacauacaaacaaaauucuacucacacgagcaccaucucugccaggguuaccaauuucaccucugagaccagguucacccugaaaguauaaagcaagagcaacuuuuuguuuucugaccaaaauuuugaaucgaaauuaauaugaaguuuuuuucuuuuuuacagaagaugcuaugauaccuucagucauuuaagauuuuuagcaaugucucgauuccuuaccauucuguagaauguuaaucgagaaaaauaaugaggaaaaaauaauucaaggccauuuccagauuauuguuaaacaaucuuuucuaauuuccguacacucuccugaagcauaaucaagcaagguacagauucauguggacagaauuguaaggcaacaucacaaugggcugcagcgccugaucacucuuacggcauaacuaaugcagcagcaugguugacagcuguucaauguagcuucuucccauuaauuaggacaggaugaggcauuauuguuaguggcauuaaaaugagccucauguauuacucaacaccaucuguuugugugaaauuccaugguagcaaggaauuuugccagauuagugaguuuagaaauguguaggugcuagguggcagagggaaauguauauagauagauaugaaaaugcuaccagaccaccugccaagaauugugaaaacuugggcauccuugugcagccuucuuuacuagaguucaucaacaauauguaauaggggucaacacguaccuuuucucccuugccuccagguaugccagcagcaccccucucuccugggaguccacuaggaccagauggaccagcagugcccacagcaccaaccacaccagguucacccuugagucaaacacaugugaaaucaauuuuaguggagaaagaagaaaaugaagaaucaaacucuagaagaauuccaauuuaaacagcuagcuagacaggcuucuugccugcuuugaaacacaaagaaggcugggcuauugaaaggagggagaauauagcagagagagaugcuguuaaugacauggugacugaagagaugaggguagugggagugcacagcugcgauuccucuauaaccugcuucaguccucuuaaggauggcaggcauggagaagaggauaggacaaugggaagcagagaguaaaaaauguuuacccacaaacauuuuucaaggauaagucucuuagcccagauagaaagcauggaaagagaccuugucaauugaggagauguuuguguuuuaaucuccuuaagaguagagacuguaucuuccauuuuuauauaaaacccuaca

SEQ ID NO: 14533 - RNA, 13490 nt, Homo sapiens
cguacucccucuagcggcgggccacugcagcguggccaccgcccccacccccaucccccauccccgcaccccccuccacccccuagcccgcggagcacgcugggauuuggcgccccccuccucggugcaaccuauauaaggcucacagucugcgcuccugguacacgcgcuucaacuucgguuggugugugucgaagaaaccugacugcgcccugaggagaacagcggagaagguccaccgagccuggcgaaagguccgcugagcgggcugucguccggagccacuccgggcugcggagcacccaguggagaccgcgccuggcucaggugugggaccccauccuuccugucuucgcagaggaguccucgcguggugaguaugcggugaggacguuuuuuuuuuaaagaucacguucauuccccgugcuuaucgggagcugcgggagauggaguagcaccccagaaugucuccacgcaaaacuugucacgccuucacuggcuguaccccaaaacaaauggggaaaccaagccuuaaaggcuuggguuuccaggaccaaguccagauacgggcuguagacagagaugagcugcggacagugaugagcugcagacggucaggagcuauagaucgauuugcaauuugcucuucaaaugcgcuaccaagugccaugcuuuacaaacagauaagcgcuucaaaugcgcuacaaacuggcgcuucagaugcgcuacaagcacgcuucacgcgggcgacaaacugaugggagcuacaacuggcgcuucauugcgcuauaaacugaugggcgcuuuaugugccacaaacugacggaugggcgcuucaguggcgcuacaauccagaacgaggagcagcgauauaggagcugcagacagaaaacugaauugcgcuuuacaugcgcugcaaaaucugagcugcagaagaguagcacuacaaaaaacgcuacaaaaacgaugcgauuagccagcccgacaacagcgcuucauugcgcugcgaggcacaugaacugcagagguacaugagcugcggaacaauucacaccuaagaugcacuacaaagugguaagagcugcagagguacaggagcugcagaccguuugcgcuacaaauaaagcagccguagugggacaugagcugcggaguacaauuccucuguuuucuuggagcaggaccccacccuuucaccuuuuggaauggcucccacucuauuuuucugcaggacgguucucgcaugauggugcugguagacaaaauggagccccgggcaaaaauuaguguuuaacauucugcccacaccauucccgcuauagcaguggaguggaggggcacugauuggaguggaaaugggaaucuuuuggugauggcagagcaggcugccugccuacuugugcuugauugaaguggcgguguaguugugguggcgcgaaucagcguccagcaacaguuuguggaaacuguggguuugcugaguauggcgggggaauuggaucuguggauugcucuugcugcaugaaaugaaucuggcuuuggugacuggugggagggguuugggaggggggauucuggcggcggggggggggggugugcagauacucugcagcccuguagcagccagucucaggccugccccgcccauccuagugugccuucucugcggugcuuagcgccuccuccuacagcgccuccucagagcgcgccuccccugcagcgcgccuucccagagcgcgccuucuagaugcggccuccucaggccccuccucccagcuccuuagcgccugccugcccaggccccaccucucucuggccaccucauucugaggugagcugcucaggccccgccucuuccaggcccgccuuuucuguggugagcugcccaggcccugccucucccgggcccaccuacucugaggugaacuguccaggccccgccucucccggggccgcccccucugaggugaacugcccaggccccaccucuccugggcccgccuccucugaggugaacugcccaggccccgccucuccugggcccgccuccucugaggugaacugcccagaccccaccucuccugggcccgccuccucugaggugaacugcccaggccccgccucuccugggcccgccuccucugaggugaacugcccaggccccgccucuccugggcccgccuccucugaugugagcucacccagaucccaccuccccaggcccgccuccucuuagguagccugcucaggccccgccucuccaaggcuuggccccucccuaagccugccucugccgggcuggccuauagucccaccucccucagagccggcuagcacacaugcgcagugugaacccucagccccucccuucaggcgccgguccucugcaccugcgcaccuuccuugccugagcccuggcuguacagccccgccccccugcgguuucucugcuguguugguuuugcuuuuuggcuacuagagucuaauagaauaauaaauaaaacaauuaacaauaauaauuauaacuggaauuuaugagcacuuuuaauauguucuuugcauauauucaauaacauaaucccacaauuuaaacuccugauaguggcuuaugaagggaccuuguaaacugacauggcuggugccucuaaaggcaauuuagccaaauguuuuuacugcaaaugaaaaccaaaacuuaacaauuuauuuuuaaaaacuuuaaaaauauuuucacauuuaagguuuuuuuagaggcacuaguggaccuuugggaaucggauguuuugguggauacaaaauuggugcuguugguuuggccucugagugaggauaaggcuuuuauuugcgugccuaugaagcuggguguuuuccuugaaucucuaggugauuaacccuagccuauuugccuauguauaauaaauugugccugcacaugguaggcauucauuaaauauguguuaaaugaccagaguaaauugguuuauucagugucuugcuuggugucuguaggucucuucugauuugcuccuuuccuauggugcuuugcuguccuggguugccuuguuugcguuaucucucacauuuaacagaauaaaaaaaaaguguauguguuuuuaaacuccaaugauauaagcuguaauuauaauacaaagcaacuaaauuaauuuuaauuauuccaaauaauuagcuuuuuucauaaaaagcuaguuauuccaaauauuagcuuuuuucaugaaaagcuaguuauuccaaauaauuagcuuuuuucauaaaaagcuaguuauuccaaauaauuagcuuuuuucauaaaaagcuaguuauuccaaauaauuagcuuuuuucauaaaaagcuaguuauuccaaauaauuagcuuuuuucauaaaaagcuaguuauuccaaauaauuagcuuuuuucauaaaaagcuaguuauuccaaauaauuagcuuuuuucauaaaaagcuaauuuaaauuuggggcaaguguauuauuaaugguacauauuguauuaaaguuuguguaauguaauauaaaguggccacauuacaaaauauagguuguuucagcuugcaaaauuaaacaacuguauaaaacaaauuuauaacugauugcuaguaagagguaccauguaagaauuguguuuccagcugaaugaagaaauuuuaaaaccugguuccauauauuacaaaucaugagccaggacuuugguaggggaggaauugggggcuuuggcucccaaaaaucucugucacauacccccuccccaccacaaguacacaaucuauggaaaauuugugcuuaucauaauuacagcuuuaaguaauuuucccuucucuuuggauauuguauauuugcauauugaagagguucaaaacaacaguaauaacaugcauauuaagagaauuugcauuucauaaauaguacaagauaguacuaaaaaauuggacauuugaaaauaugaagcaacuaagaguugcuuaaugagaugucauuuccuaacaggauguucauuuaugguuuuuggcuacuauugcucuuugguguguuuguggaauagaaauuauuccaagcuauugugaagagucaauaauuaaccaaauguauuuauuuccuaaaaagacuaaaacugaaauuauuaucauguaaagauggcaucuguccuaggcaacuuggcuuuaugcaguuuguccuuucaguuuucaggaaugagaccucuugaccccuccccuccaaugcagccccuacuaagggggaguuuaaggagccauacauaguucuauaauucaaaucaaguaaacaugcuucuugucccagguuaacuugugcugccucagucgcuguuuaaacauuuuuauacgcacuguuaaccugccugcccauuacccuauuacuuuuaauggauaaacuacuguucccugggcaguugucucuuuuaacgucccacccuaaacuugccaacccucauaugaaggccucaggcuuguuauuggcaaaggucagaagucuuaagcuagugaccuugcaggcuaaaguaggccuugaauuuguuugaccaggaacuaaauuaaaaaauaaaaaagaaugaaaugucugguggcaggggggcagggguggggagggugguaagggggagggcaugcacccccaaguuccauuguugcagccccucccaucuuaacucuggucucuuuucacuuuucaacuaccuuccuuauauaccaaagguauuugaauuuuuaacucuuauugaucuuuuauuucccuaaaccauguaguaauuauuugcugauuuccuaauguauuguuauuucugucccaucacuguuuuuugcagauaauaaaaccaucagaccugggcuucaauaaagccccacuuaguggccgugauugacaaguggucaggcugcaccaggccaugcugugaaugcucuuuaggaagucuugucucaagguuuugaagauauuaaugucuagaugacaaaagugguaccuuagucaccuuacuuaugguuauuaguuguucauuaaugggacaugaaaacuccuaauuuaauaaggaaaaauugcauuauguugugauguuauauugucagggucagcaauacaauugucuuuaaggaguuggaaaugauacugaaugucacggguuaugauguguuuauuguguuuucuaauuuuuucuaaacuugaauauuuuaucuugaaugucaauuauuuguuguuuuuauagccuaaguuacuaaaguaauuaaguagugggguuaaaacuguuaaaaugucacacuacucccugucucuuaaagacccugcuugcuguauagccacuccuuggagaggcuacaccaacugcaaaggacacagggauaguaucuguggguggugacauuggggcaugggagguaccuaaagaguuuaggaguuggagaggaaggagcauuucuuuacagccaggggcugggcaucauguuuaauuaccacuuuuuuuuuuucuuguacucuauugguugaaaauaguaacuauuuuucaccuaacuucucuaauuaccaacuguguaucuuuuuggccuuauucuauguaauuuauuuggcguccauuuuugcagguaaaucacauagugaguauccagagaggaccaacuuauguauuuaaacuuuuguuuauuuaaaaguuuuauaaacuuucuuuaaaaguuuuaaacuuuuuaaaucaaaguuuuuuaaacuuuuuuaaacuuuuacauauuauguuuuaaacuuuuuauauauuuaaauuuuccaaauaugggacuugagauuauuaauaaaauuuaaaauaauuaaaucauucuaaaugcauuuaacuguauuuucaggaaguacacaggcagacacugugucaggauuuuuaugugugugauugucauuacacucauaauuagaaugcuuaaacacacacccuacccccaccuccccacacacauccacucacccccuaggagugcagcccugucccaccuuaacauuacaaaccuucauuuggggcuaugcugacaaaucuucauuaaaaacuauggauuacaaacugguaaacugcaagacaaauaaggccuugaauuuguuugaccaacacaguauuuuuaaaaaaguaaaugucuuuaggugggaaaugcaugcccauguugcuauaguugcagccccucccucuuuuaaucccacucuuuuuacacagauagucaccuuucuauuuucuaauuaauaacuuuguucauaucagcuaaccauuguugaauacucacuacauaauuuaccugcacuauuuaauuaaguccucauaauuaguuugagguauacuauuauugggcuucuuugaaugucccauuuuauagcuuuuccuaggaggcaucaauuauuauuucuugaaugacugcauaaugacaaaggaaacugacauacacauauugcugcuuagugccauuucugucccauagagaauuuucuuuggggauuuaaauuauggucagaaaaguaauuuaggcaguccugugguuuuugugguggugguuguuugauuugauaaccaguuaccuucucgguggcaguggaauaggguugugacaguuggccagaguacccuccugcccacagggcugaugaauacaugcauugugauuuuaauacucccuucuugcuuuaaugagauucuauuaguugcaguauuaacuauuuuuggccuggcuucuuuaauaacaaaaguuauuauuuuggcuuuaauuugcauaauugauuuuguauccauguuugccuugaaguuucuugcuguguuugaauacaaaacuacuuguuuagaggguuucaacauucuuuuauaguuuauaaagguaagcaugcuguugauaauguauuguugaaucauaaugaacagguggccuuugaggaagacaaggucauuugaacaucaaaaaguacuuugcuuuuuguuauauauggugcugauuacuaacuuucucuugagaguuuauuuucuuuguucacuaauuauuaauguaagcacguagagcaagggauaauuuaaauaccaaauccuuugugucugcuuuugcugcuuugaauguauaaguuggauuuauacauacauuuaucuuuauuuacagaaauaagcggguuuugaaaacaaaaaaaagaaggaguggaagagggggccaggauccaggccuccauccccacagaagugaagcuacagcugggaggucuccucccaccccaaccgucacccugggucccgacugcccaccuccuccuccucccccuccccccaacaacaacaacaacaacaacuccaagcacaccggccauaagagugcguguguccccaacaugaccgaacgaagaagggacgagcucucugaagagaucaacaacuuaagagagaaggucaugaagcagucggaggagaacaacaaccugcagagccaggugcagaagcucacagaggagaacaccacccuucgagagcaaguggaacccaccccugaggaugaggaugaugacaucgagcuccgcggugcugcagcagcugcugccccacccccuccaauagaggaagagugcccagaagaccucccagagaaguucgauggcaacccagacaugcuggcuccuuucauggcccagugccagaucuucauggaaaagagcaccagggauuucucaguugaucguguccgugucugcuucgugacaagcaugaugaccggccgugcugcccguugggccucagcaaagcuggagcgcucccacuaccugaugcacaacuacccagcuuucaugauggaaaugaagcaugucuuugaagacccucagaggcgagagguugccaaacgcaagaucagacgccugcgccaaggcauggggucugucaucgacuacuccaaugcuuuccagaugauugcccaggaccuggauuggaacgagccugcgcugauugaccaguaccacgagggccucagcgaccacauucaggaggagcucucccaccucgaggucgccaagucgcugucugcucugauugggcagugcauucacauugagagaaggcuggccagggcugcugcagcucgcaagccacgcucgccaccccgggcgcugguguugccucacauugcaagccaccaccagguagauccaaccgagccggugggaggugcccgcaugcgccugacgcaggaagaaaaagaaagacgcagaaagcugaaccugugccucuacuguggaacaggaggucacuacgcugacaauuguccugccaaggccucaaagucuucgccggcgggaaacuccccggccccgcuguagagggaccuucagcgaccgggccagaaauaauaagguccccacaagaugaugccucaucuccacacuugcaagugaugcuccagauucaucuuccgggcagacacacccuguucguccgagccaugaucgauucuggugcuucuggcaacuucauugaucacgaauauguugcucaaaauggaauuccucuaagaaucaaggacuggccaauacuuguggaagcaauugaugggcgccccauagcaucgggcccaguuguccacgaaacucacgaccugauaguugaccugggagaucaccgagaggugcugucauuugaugugacucagucuccauucuucccugucguccuagggguucgcuggcugagcacacaugaucccaauaucacauggagcacucgaucuaucgucuuugauucugaauacugccgcuaccacugccggauguauucuccaauaccaccaucgcucccaccaccagcaccacaaccgccacucuauuauccaguagauggauacagaguuuaccaaccagugagguauuacuauguccagaauguguacacuccaguagaugagcacgucuacccagaucaccgccugguugacccucacauagaaaugauaccuggagcacacaguauucccaguggacauguguauucacuguccgaaccugaaauggcagcucuucgagauuuuguggcaagaaauguaaaagaugggcuaauuacuccaacgauugcaccuaauggagcccaaguucuccaggugaagaggggguggaaacugcaaguuucuuaugauugccgagcuccaaacaauuuuacuauccagaaucaguauccucgccuaucuauuccaaauuuagaagaccaagcacaccuggcaacguacacugaauucguaccucaaauaccuggauaccaaacauaccccacauaugccgcguacccgaccuacccaguaggauucgccugguacccagugggacgagacggacaaggaagaucacuauauguaccugugaugaucacuuggaauccacacugguaccgccagccuccgguaccacaguacccgccgccacagccgccgccuccaccaccaccaccgccgccgccuccaucuuacaguacccuguaaauaccugucauguccuucaggaucucugcccucaaaauuuauuccuguucagcuucucaaucagugacugugugcuaaauuuuaggcuacuguaucuucaggccaccugaggcacauccucucugaaacggcuauggaagguuagggccacucuggacuggcacacauccuaaagcaccaaaagaccuucaacauuuucugagagcaacagaguauuugccaauaaaugaucucucauuuuuccaccuugacugccaaucuaacuaaaauaauuaauaaguuuacuuuccagccaguccuggaagucuggguuuuaccugccaaaaccuccaucaccaucuaaauuauaggcugccaaauuugcuguuuaacauuuacagagaagcugauacaaacgcaggaaaugcugauuucuuuauggagggggagacgaggaggaggaggacaugacuuuucuugcgguuucgguacccucuuuuuaaaucacuggaggacugaggccuuauuaaggaagccaaaauuaucggugcaguguggaaaggcuuccgugauccucucgcugcacccuuagaaacuucaccgucuucaaacuccauuuccaugguucuguuaauucucaaggagcagcaacucgacugguucucccaggagcaggaaaaacccuugugacaugaaacaucucaggccugaaaagaaagugcucucucagauggacucuugcauguuaagacuaugucuucacaucauggugcaaaucacauguacccaaugacuccggcuuugacacaacaccuuaccaucaucaugccaugauggcuuccacaaagcauuaaaccugguaaccagagauuacugguggcuccagcguuguuagauguucaugaaaugugaccaccucucaaucaccuuugagggcuaaagaguagcacaucaaaaggacuccaaaaucccauacccaacucuuaagagauuuguccugguacuucagaaagaauuuucaugaguguucuuaauuggcuggaaaagcaccagcugacguuuuggaagaaucuauccaugugucugccuccauaugcaucugggcauuucaucuucaguccccucauuagacuguagcauuaggauguguggagagaggagaaaugauuuagcacccagauucacacuccuaugccuggaagggggacaucuuugaagaagaggaauuagggcuguggacacugucuugaggauguggacuuccuuagugagcuccacauuacuugaugguaaccacuucaaaaggaucagaauccacguaaugaaaaaggucccucuagaggauggagcugaugugaagcugccaauggaugaaaagccucagaaagcaacucaaaggacucaaagcaacggacaacacaagaguugucuucagcccagugacaccucugauguccccuggaagcuuugugcuaaccugggacugccugacuuccuuuagccuggucccuugcuacuaccuugaacuguuuuaucuaaccucucuuuuucuguuuaauucuuugcuacugccauugacccugcugcaggauuugugucauuuuccugccugguugcugagacuccauuuugcugccacacacagagauguaagaggcaggcuuuaauugccaaagcacaguuugagcaguagaaaacaacaugguguauaucucaaauugccugacaugaagaggagucuaacggugaaguuucacuuuucaucagcaucaucuuucacauguucauuaucaucugcucuuauucuugcauguuuaaacacuuaaaauuuuuaguauaauuuuuaguguguuuugaaguggugacuaggcuuucaaaaacuuccauugaauuacaaagcacuauccaguucuuauuguuaaacuaaguaaaaaugauaaguaacauaguguaaaauauuccuuuacugugaacuucuuacaaugcugugaaugagaggcuccucagaacuggagcauuuguauaauaauucauccuguucaucuucaauuuuaacaucauauauaauuucaauucuaucaauugggccuuuaaaaaucauauaaaaggauauaaaauuugaaaagagaaaccuaauuggcuauuuaauccaaaacaacuuuuuuuuuccuucaauggaaucagaaagcuugucaaucacucauguguuuuagaguaauuacuuuuaaaauggugcauuugugcuucugaacuauuuugaagagucacuucuguuuaccucaaguaucaauucauccuccauacauuugaauucaaguuguuuuuuugucaaauuuacaguugucaauugaucuucaagcugcagggugccuagaaaugggccguugucuguagcccuggcaugugcacacggacauuugccaccacugcaagcaaaagucuggagaaguucaccaacgacaagaacgauuagggaaaauaugcugcuguggguuaacaacucagaaagucccugauccacauuuggcuguuuacuaaagcuugugauuaacuuuuuggcaguguguacuaugcucuauugcuauauaugcuaucuauaaauguagauguuaaggauaaguaauucuaaauuuauuauucuauaguuuugaaguuugguuaaguuuccuuucacucaauugauuuauuuuguuguuaaucaaauuuauguuaauuggauccuuuaaauuuuuuuuggcauuuuccaacaaaaauggcuuuauucauaagaaaggaaaaaaaucaauggaauuugauaucuaaagaaguuagaaagggagcaaaauaaaaaacauaaaggagauagaugaauuaguaagcaaaucaguagucgaguuuuucaaacuggcaaaauuaauuaauugacuuuuagcccaaauuuacauuguuaauuaaaucaagaaggaagaagaucuaagagcucccauugauaggcaagccuagagagaacuagcuaaauuuaucaugcuaggauauugaaacacagaaaguuuacauacauuuaugaagggucaauuuaguuuggacagugagguauuugucuuaguggaaaaaaggagaauuagucugaucaaaucgugaaguaauacagugaacuugcaggugcacaaaauaagagggccacaucuauauggugcagucuggaauucuguuuaaguuuguagguaccucuuggacuucugaauugauccaguugucauccaccacagacaucucacaucagauacagacaguuccaagauugacaacagagaacaaccugcuggaaagaccugggcagaaauggagagcccugcgggaaccaugcuacauuuucaucuaaagagagaaugcacaucugaugagacugaaaguucuuuguuguuuuagauuguagaaugguauugaauuggucuguggaaaauugcauugcuuuuauuucuuuguguaaucaaguuuaaguaauaggggauauauaaucauaagcauuuuagggugggagggacuauuaaguaauuuuaagugggugggguuauuuagaauguuagaauaauauuauguauuagauaucgcuauaaguggacaugcguacuuacuuguaacccuuuacccuauaauugcuauccuuaaagauuucaaauaaacucggagggaacugcagggagaccaacuuauuuagagcgaauuggacauggauaaaaaccccagugggagaaaguucaaaggugauuagauuaauaauuuaauagaggaugagugaccucugauaaauuacugcuagaaugaacuugucaaugauggaugguaaauuuucauggaaguuauaaaagugauaaauaaaaacccuugcuuuuaccccugucaguagcccuccuccuaccacugaaccccauugccccuaccccuccuucuaacuuuauugcuguauucucuucacucuauauuucucucuauuugcuaauauugcauugcuguuacaauaaaaauucaauaaagauuuagugguuaagugcaaacu

SEQ ID NO: 14534 - RNA, 15478 nt, Homo sapiens
ccucaggcacacaguaaguuuauuuccaagauaaauaaaaacaaucuggcaucuauacuggaaaaauggguauacuguagcuuucuucuuccuuaaugguagaguuguguguguguguguguguguguguguguguguguguguguguguguaggcaugcuccagugucugcuucuguuuugguuucauuacaccucuuuuuucucuuaaacugaguuuuauuacucauggaagcacaggccaguagugcugauuaaagccugggaggggcugccacacacacuuucuccgggcacauggcucuacacauucuucuagacuugcuuucuuucucugcuggaccuuucugagucuuaauccauuaguguuuaaugauuuguguugaugcucagugguuaucaaagaagccccacuggacucuuguugaaaaacaagauggauuucagguucauaacaguauuuggacccugccuucccauucuucaguuuuacuaagucuauaccauuuucaggugaaaauuuguuacauccaaucuuccauuugauuuccacacagagguuagcaugcuguguggcuccgggcuugauaauacacugccuggggcucuacauacaccagagacuugggaaagagcauugccuacaaucccacaaccagucagccuuccugauacuuagagaacugauugggauaacauuuagcuucagaucucugcuguacuuacuaugugcagauccacuaaggcugacucauuuggaaguuucaguagggacauggugugaaagacauagggacuuagcugacuguccaucagcacgggggaaagaggugauauaauugucaaaaaagcagauguaaucuuagcaugcauuaaaugcaggcauauuuuuuaucacaugagaagugauaauucaaugcuacccagguuucuauauucugcuggucagaauauagguagacaguucuguuuuauucucagaaccucacuggaagaggaaucagacaaaauacagcauuuucaaaagagauucaccaggauaggaaagguuuugaaaaccagguacccaaggaacagaugaaggaauuagugacagucuggguaagaaaagauuuggcagggagaggaguaacagggaacaacuaucuauaaauauucaaaaagcuguacuguuuugacuugauuaguuugguuuggucccacagggcacugcacuggaaguaucuccuugaacuuucuuuauccccauuaguggaagaaaaaacucccccaggauacuacgaaaacuggcugcccuuuaaggaagguguuuaagcagaguuuggaccaccucuugguugaggcagaugaguagcuacauuagaugauuauuaccacuccuucugaccagcaguuuauaugauaauaauaguuugggaaccauccuuuauacaauagcaacuuuccaauauuaaauauuguuucauuguaguuguggcuagguauuauggacaguaacucaccaaggguaagacugauacugucagcuauuugcacaaagaagcaccaaguaagugugguuuggccacugguggcugaacugccugaaaucuaacccaaauugcuguagguucugcucauaguaaccuuccauuuuguguuuaauacacagcugcaaaugauuuuagccuaccguuuagaauucugcagagugggauaacccacuagaguaugacagaggguuacaacaucuuguguaugguuccugggauguauaaaugaccuuucucaaugcccuggccaaaucuaagccucuauacuacugcaaacgguauuuugaaaaauaaauauauuauuauccuagauuuugcaguaacauagaagaaccuaauuuuaucucaccagguacauugugccaauaaucucaccacuaguaucucucccccagauuaaaaugguuaugaauauuaaccacuuuuuauaaagaauguuaacaaauguuuggcauugugacuauaaugcauuaaacuccagauuuaguaacauguauuccuuccaaaagucaguaguucuacccuuuugaagacugucuuuuuccaucacucuuguugagcuuagaagccaaacuaugcgguggagacuuauucaaguaguucaaauucaccucccugcauugccucugccccaucaaaccucauuuguucuagcguccuucuguuccacugcauugcauucugacugagcaaggugaagcuuuauaaguauuuccacuauuauguguugcugccagagcuuuuagaaagaaaucagguucaaaucaaaagcggcaaaugaccugacgcuuguauuauaguaggauuauguuacucuuuaauccuuguuuuagaguaauguguuugacacucaaauguaagcauuuccucuuggaucugucucugauccucuuuguuuauguuuuugcagcaucccguguacuguguaaauguuguugggacccagaaugcucauaaccucaucacugucuccacugauggcaaaauguguuccuggagccuggacaugcucucaacuccacagguggguuuguuuuucccuacacauaacaccauccugguuaaaagagauaccuacuuaauggaacauaguuccuaaaagccaaacccucacauccuagaggagcuaaaacaaauggaugcacuugaaagaguggggccugcuuucagcaaucuucucuugaagccaaaacccauuuccuuuaccacaaaucauguaauuauuguaauacauuaauccuuaggucaguuucaagugaaaaugaaauaauccauucuaaaucauaguaauuauggaaguugccuaugguaugaauugcacuuacccuacagcauuguugaacagaugcagacgagguuggagcucagcagagcaaucccuuauggguacuugcauuggagggaagguaacccagcaaaacagaaauccaagcccuugcuuguauccguagccuagacaacagccuguguguaugaagaaaccaucuguuuuccccucuggaauguuuuuuaguauggcuccugucauuccuugcucaguaaaugagaagucaaaaaugaaaaaguuccaaagucugcaaaccaauacugauugcaacaguggggaccaaacaaaggaauagaagugggagaggcugucaaagggagacaacuaaaugcaacuugcaagauaugcauauguagacaaacacacaagacaugcgcauacacacaugaacacauacacacacgcuuuuuccauauuucuuugugugaaaaaacaguauucacuauccuccaaccaaaaacaacagagaagucauuguuauagacuuugacaaaaauguaaggaaacauggagaaaacugcaaaacaauaucuaggagauaauucucaauguuaacauucccauauucuuucccaggauaaaaacccuagaaugucucucacacaauuuuagaagaaguuaaaguuucaaaauguacauaaggagacagggcacgguggcucacacuuguaaucccagcacuuugggaggccgaggugagagaaucauuuaagccuaggaguucaagaccagccuaggcaacagagcaagacccuuuuucuacuaaaacuuaaaaaguuagcugggugugcuagcacaugucuguaguccauguuccuugggaggcucaggcaggaggauugcuuaagcccaggaguucgagguugcagugaacuauuaucacaccacugcacuccagucugggugacggagugagacuuugucucuugaaaaaaauaauuauuauuauuauuauacacacacacaugcacacacacaaaaggaaauauggaaacugugaagaaccaaccuccuuuaagccuccacaaaauacggauguaaagaauacuacguuuuuuuaaaauaauuuuagggagaaaaaggagagagugcuaauaagcugcuuacaauugaaguuccacuauuuucgcugaucuuuaacauuauagagggcuggagggauugguauuuuauggcuuugucuuaaaauucucagcaauguuuuguuuucuuuuaaaagccugaagauuauaaacagacauaagagcaagcccacuauuuaggaauuuuuaauugcccauuuugcucauuacacauauuuauuuagguuaaaaccaguaauaugguggcucuaaguccguuuguauuaguuuuagcaugcucacagacuccugugucuauacaaagauggaggauuucgugacauggcuuccauggauggcagggaggaauaggggcauccaacaguuggccuggucuuucucucucccaaauggguaaagggacuuuuccuuccuugcugcuaauuuuagugaugaagcagaucauuggaugauccaguuaucuguaugacauagucacagcauccucuccuuuaucccaguugcugaugugcacccuauguguggauaucacaaacuuugaacacaucacaggaucagaaucagucuguguugcuuagacuguuagcuugcacuuucaauuuaauggacuccuuggcugaaauaguuuauuugcacaagaaagacuaaacucucaagcaacuauaaugauaugauaccucagaaugauuuuuuaaaaauuauuucagaugcacaaaauaggcuauuugauguaaauagccagaaauacucagggauauuaguuauaauugauuauucuuuucugucauuaaacuuaacucagcaguauaucuuuuaagauuaggaaucuuuaauucucaauuuuaaaaaaucauauuauaaaauaaagacucccauuugcuauuuuaaagacguauuuaaauauuguucuuuucaggcuuauagccuauucacccaauggcugcccugcaugaaaucuagucccuguugaaaucugguuuuuaugaccugagugacaacuuucugguuuuaguccauggaggacacauacuccugcuuugacaaauuugcuuaguacaucugauauuaauacauguguauucucacaaacaauugauuuugaaaauguuuguaaauacaaggguauuguguguuuuauuaaagcuuggagcugacaaguguaaccauuauuaucuuuaguuucugcaccauuaguuucaaaauucucaccugucaucuuugccugacuuaagaagcagcagcacaugcugaugaaauccagccggcuugaaaccagagauccacagaagcaugaaugucaggggcaguaaagcaugguuucuggcacagccggggucuuuuguaacgcugugugaaaagcaaacacaugauuuagccaaaugauuuuuccgugcuaucuuuggcauggcaaggaguugacagauggaaauguaaccacaccguguuuugguaggagagcauggagcugguguacaauaaguccaagccugucgcuguuaccggaauggcuuucccaacgggagacgucaauaacuucgugguuggcagugaggaagguacagucuacacggcuugucgucauggaaggugauuuuucuguuucuuuacugaugacauguucuucauuuccgaaagucuguuaucacauucuggauuuuaaccaccuugcauuaugagaaagcaucucuggaaaaauggaaagcacgacuucaacucuucauuaucuuaaagagcugcaucugcucuggucauuagcuguucauaagacuguggugguucacacugccuugagggaaaaaagcucgagcuucugagccuaucauaacagaccacuugcaccuucccagcaucuccgcauaccuucagggucuagccaugugcccaucagagauaacaauccccaaauauuucuuaucccuccaugccucaaugaguuugcauacucaacuucuuuuaccaguucuagcauuucucccuuuuuggccugguuaauuccuccucaucauucaagagccagcacagagaucauuccaugugaaacauuuucugacucuugggcaaagaaaaccacucccaccuuuaagucccauagaauuuucaauucucuuauucauucacucuuccaaggaauauuuacuaagaaccuaccaugugccaggcaucaucaaaaggauacauuaaagaacaagacagaccuagaguucauauucuaguugaggguaaaauacuaauaagcaaauaaauauauaguuuaggaugguaagugcaauggagaaaauuaaaguagaauaagugggauaggacuauaggcugucaaguugacaauuucauauauuuuccuuaugcuucuauaauagcauuaaucguauuuuaguuuauucauucaucugccauuuuucucuuacuacauuauuuccauuucaucuuugauuuccugcacaguaccuaggacauaguaagugaggagcuaaaaauauauauuggggauaaagaaaugauauauaauguaauccauccaaucuaaagaagugccuuaaaagcuuuccucccagucagaugggucagaacagagugagucacacaaaccaccaugcaguucccaggugauaagaacucuaccuuaacugagagauucacaaugccccuggaaaagaguugucaguauaaaguggaauccaauaguuuggacuagauuguaaaauugcaugcaaaacuuaacagguggccucaugucuuuugaaagggucacuauguucacacuggugcuuaauuugucuuuuacuuuaguaguucuuauuccauugauuuuuuuucaucucuugcacucauccgaggcuauuaagauuuaaugaagaaccacaaauuguuccaaguucauaucccuguguuuuugugauuuguagaaaugacaagcauccauggcucagcuaugugacuuuuuccauucaaacuauacaagcuguuauguuccugcuguucugcacguagaaacaagcaguauuuguccccucacaugauucaaagaugacuuaggaagauaugccucacaguccauucccaaugauccuccuucauaaacccuggcuaaaaccacacauuaaagcuuuaucaaagcauaaaaauauuugauaaaguuauucauucauaaauauauuuguuguaugccuacuuugagcaaagugcauuguuagguucugcaaggccugcagacgucauguaaaccugguuucucucuucaaaauaacugaugacggugagaaagauaaauacacaaauaucuggaacaugaguagaaugucuuaaguggcaugagaggcauagagaguauaguaggccagaccuggagucacagcuuuaucuauaugcguauuagaaucaacauggcauagguucaguuaacuuaacccaugguuuuaccuagguccuugauuaucuacgaaggcuauagaauacauucauugauaauuuccagauuuuuuucauugcuauaaagugaauaacauuuuacaugaugaacauucuuguucuguggcuacuguacuuucuaagcacuaucagaauaugcacuuugguucaaaagaagggucccuauggcacacaccacaaaucuuuuuacaacaagcugaauuuugcuuuacauugguccauccaucugaaauauaaaauacagaccuuaguaacauuguaacguagcaggcauuggcuuuguagucauucuaaaugggucauauaggucuaugggggagaagcaggggauugcuauuuuucaccuaacauagagaaggugcaaauccacuuccauaaauuaaacaagguccucauuuugcacccuauaaauccuuucaggaugcuguuaagagcaaguggagucucaccaggggccacuucaaagaucaguuccucggguucauuagaacaaauuuaaaugaucauguguggaacugcucuuagcaguuucacugggcauaauuuuugagugccuguuacauggaacacgcacugccacacuuugcucaugauuccaaauuuugcuaagcacauugacauuuauuggugcuccagaggcccaaauguuuuaauaacugagcucguuuuuauucuuagugacauaauauuaggauucuacaauuccuacauauuugucauauuuauaaccucaugcacaugaauauuuuaaauauagcauuuuugguauguuuucucacaucuuccuaauuguauaugauugcaugcagaauacuaugugauaauagagggcugcaaauaauaacagcuuaguuaaauaagcaagauaugucuguguguaauuuuuuaaaugucuaucauuauuucucaaaugugcuucuguuuuaaaaaaggacugagacauaaguuugucucuuuuucuuagcuaguuuauucaacaaauauuuauugagcacuuacuauaugccagacacuuggcaacaagaaagacaagauacuugcccguaugggauuuacaguggauauguaaaucugucuucuguuuucaguaaagagaaaacauuauuuucuccauauuauauuuaaauuaugugcauuauuuuguggugacaaggguuuccacaaaguguuacauuuucagcuauguuaaaguaauuuaagaaauuuacuugaaaaaaauaaaugauuguuccuucaaggauggauggaguuuuauagucaauagguuccccaaaaggagauaaagcagaccaugugcaaaaugcuaucucaagaauaaaauagucuuauaaauauaaaagcuucagagaccuaaguguauuuguuuccauuaaaauagcugcaucagcaaugauaggcuuugaggaauucugcaaaaagaauuaaauaauaaauauugauauuaaauucuguauuuuaaaaagauuucauugcccuacauuguuuuuaaauaaugaaaaauaggguaacauauuugcaaacaauuucuuucaggauaacuguaaaaaugauuucauuuugguggugugugguuguucuaaauuauggagaugcagaguugaggguuuuuuguuuuguuuuguuuuuaagcaaucauugcuuuucagaggucacuggaauucugcucaugugugcucuuccuacagcaaagcagguauuggugaggucuuugaaggucaccaagggccagugacaggaauuaacugccacauggcagugggcccaaucgacuuuucucaccuguuugucacaucaucauuugacuggacugucaaacuguggaccaccaagguaagaauaucuugacugaaauucucagauaauacauaagggcagaggaugguuuuucauucccuggaaacaguugucccuaaagccucuuccaggcaaccuggcauugggaauucauauaccuucuggugagcucagucuaccucagagcuaguuaaguccauuuuauuuacuuuuacacauauagguaauacuugaaaauauucuaacuauaaaaaauucaaacaauucaaauaaugauaaagcugcaguccuccucuaccuaccccaaccccaaccccauccacaacacccccuucacugccugcaccucaguccccuccccagggguaaacuuuuaucaguuucaugucuauguucuggagcuuggugguaucuacuuacuuacauauguaccuauggaaauauaugauuugggacuuggguuuuuuuuuguuugguucguugauugguuguuuauuuuuauuuugagcuauuggaaguuuuuaagcugguaaauggcccuauguuauguuuuuaaagguaauucuggcugggagcuguggcucacaucuguaaucccagcacuuugggaggccgagguggguggaucgcuugaggucaggaguuugagaccagccuggccaacauggugaagccccauuucuacuaaaaauagaaaaauuagcuacauauggugguacaugccuguagucccagcuacucucgaggcugaggcaggagaaucacuugaaccugucaggcagagguugcagugagccgagauugggccacugcauuccagccugggugacagagccagacuccaucucaaaauuaaaauaaaauaaaauaaaauaaaauaguaaaauaaaauauaauucucuccaugcuugagagcaagaagaaaagcugagaccacuuggaaggaaggcacaauaaucuaggaaagaaaugacagugacuuaaaccaguagucugagauggagagaaauaaaugcauuugagaaccauuuaagagauaaaagccacagaaacuggugauugauuugauagaaggaagguaggagagggagucaucagcagauaacccagguuuaagaccugggcagcuggugaguguagcacucacugcacuggagaacagcaggggaaggacaugcuggggcagagcuuugcauauguugagcuaaaggugcccgggagaggcauuucaagaucuccauuaagcaguuugauaugugagucagaagaagagagagcccuccaaacagaacguaugcacuagaauagcagugaucuucacaaaugaguaguuuuuuuuuuuuuucuuuuuuuugaaacauagucucgcucugucacccaggcuggagugcaauggcacuaucuuggcucacggcagccucugccucccaggugcaagugauucuccugccucaaccucccuagcagcugggauuccacagcacacaccaccaugcccaccuaauuuuuguauuuuuaguagagaugggguuucgcauguuggccaggcuggucuugaacucccaaccucaaaugaucugcccgccuuguccugccaaagugcugggauuacaggcaugagccaccacaccuggcccagcaguggauuuuaaaagaaacacuaacaugcaaucuggagggagagcaauacuuaggaaauaaauagaaauugaacuagaaaagggagaugaaaaaguaacccaggaaauagaagacaaauuagaauuuucuuugcagcuucauggguauuaauggaaaaaaccauguuaagaggacagaauuugcuuuuaacuauaugaaaagauaacaaccucauuuauaagagaaauuaaaauuaaaaccaaguugagaaacauauuuccaacuaucagauugacaaaaaucuaaguuuugcaacauacucugugaugaggccgaaagaaaccagcuguucucauacauuuccauuggaaaugcaaaauggcucaacacuguggaagaggauuuagcaauaucuaaaaauaauacauguuuuaacagaacaauuuccacuucuaggaaucuaugccaaagauauaccagcaaaaauaagacagaagacauauggagaaggacauucacugaaagauuauuugaauagcaaaagaaugaauacaacucaaaaaucucuaucaguacagugcugugugaaucaaaaguaugguaccuccacccaagagaguaacauuauucagguauaagaaaaaaugaagaagacuucuauguucuauuauggagugaucccuaagauacauuuuuaaaugaguaaagcaaaguggagagaagugcaaauaguauauuaucauuguuuauaauuauauaauuagaaguugaaaggauaaacaaaaaaguuacuuauagcaagacaggaagcuaaaagaaaaaaauaauagcuagacuucuuugaauauaccuuauuuuuacauuugauuuuggaaccauguaaauauuuuacauaguuauaaaagaaaaugaaauaaauuuaaaaauugauuccuaaaaaauuuaaaguaacaugaaucaacuuuaaugugguucaaauugguagcaaaaucuuacaugaaagaaugauuugaagugacuuuaaaacucuguauguuugguauacauuccuaaagggauauauuuuaaggauuuuuuuaaacuaccaaaaaaaaucuaaaaucuaaacuacuucuaguacucauauugcugguugucauauugcuacugcuauccugaggccauuguauuuauaucauaacauaaguuaaauuacuauguuggugucauugagaacugagauuaucagcuugguugaaaggagauacagaugcaugcaguuaaguaacaauucuguaguaauccugaaucugagugggaaguauacuaagaacucaugguguguauuaucuuucaauacaaaagaauacauauucacugcucuguucaccaaaaagaccugggaacggugaccaauucaauagcaaugacauuccugaugcccagaaugugcuccccaaauacagcuuccacucaaggaaaccagggaucccagaagaaauuacugauucuaagcgcggagcaggaaauuuauaaaauaaacugagauuauuuuauuauaacaagcaaagaugcuaccaaacacuacaaaguuuuugucaaaggacuuggaaaccaaguugaguaagcuucuguuggcccagacaacaucaauaagaguaauagauucaugaguuccuaacaauacugaagaaaacaaacaaauaaaaaaccucuuuggccaccuauggagaauacuagguaaacaaacucauuauuuugaaaaccagugaguaaaugaaagaauaaaacauguagucugucuuuucuauaugaauuguauuucaggguuacuaaaucauugaugaggggacuuuuucuuuacagaauuccagcuaauauaggaauaaaaaaugggccggggacuguggcucacaccugugaucccagcacuuugggaggcugaggcggguggaucacgaggucagaagaucgagaccauccugcccaacauagugaaugcuuaucuuuacuaaaaauacaaaaauuagcugggcgugguggggucugccuauaaucucagcugcuagggaggcucgggaggcugagucaggagaaucacuugaaccagggauucagagguuguagugaaccgagaucgugccacugcacuccaaccuggugacagagugagacuccaucucaaaaaaaaaaaaaaaagaaagaaagaaagaaagaaaugacagaauuugaaaaucaccauuuugcaaacaccauaaucuaggcaaugauuauugcugauaauauuguaaaaauagaaacaaccuuuuucauaauuacagaauacacaauaccaccuuugaaguaggcuuacacucaaaauugaaucugaaucuuaucaauccuccagaucucugaauuuagaagauacagaugcaaaacauuaaauaacaccacagggaugcaaucaaccaaacccagaccgcuggcauaucuacgggacaccugauuuaguuucugcaacaaaaccaaaaauuuuuccucaagggcaaauuggaaguggaaacaauguauuaaaaaaaaaaaaacagaacaaaacaaaacuugggacauuucaguggaucuuaaaauauggaucuuacauagaucuugauucaaacaagcaaccaggugaaaaacuuuacaaggcuaccagggaaaugcaaauacuaacuguauauuugaugauauucaugcaguacuauuuuuaguaauuuuuuuuuuuugaaauguagucucucucuguugaccacacuagagugcaguggcaccaucucggcucacugcaaccuccaccuuccaguucaagcaauucuccugccuuagccuuccgagcagcugggauuacaggugcccgccacuacaacuggcuaauuuuuguauuuuuaguagagaugggguuucaccauguuggccaggcuggucucgaacuccugaccucgugauccacccgccucagccucccaaagugcugggauuacaggugugaggcacugugucuggccaauaauuguuaugaucacuuuaaaugguguuaccuuuuagggaugcauauugaaauacagaacaaauuauaugauauuagggauuugcuucaaaauaagcaguugggaaugggagagcuugugaauguaggugacuaacauuggucaugauugcuaauuauugaagcuggaugauugauauuagucucucuaucucugaauauguuuaaaauuuucuauaauaaagaaccuuuaaaaggcagaaaaagcaauuaguaauaauggcuaauacuucagagaagaaacaucaggacgggaauauguccauuguauuuagcaacucagaagccacuaguguccauggcaaaagcagugucuuuggaguuuguugagggugggacaaaaaauuacaauacguuaaagaaugaguggaaagcaagaaagcauuaaaaucaagauguuuucuuuccuuuuuuuuuuucuucuugagauuagagagagcucaaggauguugcugcuguggaagagccugugaaggagaguagaaaaucuguaaguguaagguagagaaagggccgugaaaauguugccacaaaugaauucauagcauggacagggaagugaauuuuaaaucugagcagcaacaucucuucuguuguaacagaagagcagguaaggaugggaucauguguguguccguguguagaguuagugaaggaaagcagagcaaacucuccugugauggcuauuuucuuaaugcuguaggggguuaaauacucugcugagugggaaguggagcuacugaagggagcagauuucagcugaucacagaggagaauaggaagagcugauuagggaaugaaagauggacuguggucagugugguggguccaguugcggucagaaaccagaauguuuuagcagcuucaaucuucaggacugauuuccuccaagaaagggcagcaguggaaauaugggaaugaaugaagggcaaaguuagauggaugugggcaggagccuuaccagagugugauggaggggcaauagagcaaggaauugggagauauggacaagaaagcuucugauguuauaggcuaaggaugcuaagcuggagcagaaaggaaauaaaaacagacaggagaaaguaaagagagcaaaggauuggaugccccuauaagaucaaagaacaaggaugaaggaaguaauugaauaagagaauuaguaacauaagauauuacuguuagaaagugagauguuuggauuuaguauuucacaacugaaaucauuccaagugauuuuuuuaaaaagucaaggauguggucauguguauagcugaagucuagugaggguggaauucacugcaaaugaggacgucacaaaaggucaaggugcugguguguugugggcuuuggagugggccagaaaauagcuagacugggauggaaaaggaaacagcgaucacaguaccaaaguccucagugaauuaggaggagacaucaaaagagguagagaaugauacagccagauggccugagcuuaaaagaaauaggacuuuuuacuggaggccuaagaagcgguaaaauagcccugaagagcaagugagaagcugacccucucacuaucuugaaauagaauacaugauaaugaacagcuucuacaugaggaaauggcagaagagguggugagguuagggcagagcuaggauuccacugaggca

SEQ ID NO: 14535 - RNA, 1507 nt, Homo sapiens
uacacaauaauuuauugagagccuccucucccugcccuugcagucucuaguuuacuuuuucugcuuauagauuuugcgcaccagccccagaaagauggcuggggucaggggugcugcguacuguucaaugagacccauaauguggcuguaacugucuuccucauauugcaagaacacggccagcagauucagcuccucagauagugccuuaaccugggccaccuucuuggccuucuucugccgguaguucuccuucaggaucugguacuauucuggaguggccuguugcagacacugaaccaccagccaaccgcauuuguuguccuggaugucagugccaacuuugcuggucacacugggguccccaaagaggucaagguaaucauccugaaucugaaagaacucucccaucuccagcaggaucuucuugccauuagcaugcuccuugucgccaucaauuccugcuguacauggcugcagcuacaggaagguaggaguagaaagcugccuuguacuugacgauagauuuguaccucuuuucagugaaucugccaagauccacauugcccuggggggcugugaugagguccagggucuacccaaucucagucugauaggaacucugcaggaagagcucgauuagguccagguaauagggcugcuccaggcugggugcgguggcucacaccuguaauccuagcacuuuggaaggcugagguggguggaucaccugagguugggaguucaagaccagccugaccaacauggagaaaccccgccucuacuaaaaauacaaaauuagccgagugugguggcauaugccuguaaucccagcuacucgggaggcugaggcaggagaaucacuugaaccugggaggcagagguuguggugagccaagauuccaccauugcacuacagccugggcaacaagagugaaacucugucucaaaaaaaaaaaaaaaaaaaagaaagaaagaaaaaaaagaaaaaauagggcugcucugggcaauagagcuucagcaggugguagauacauacuuccagaagcauagcaucauugauggcauccaaacccaugcccggcuucugauaccaccagaucuguccccggcgggagacggaugaauccaugaugucaucugccaccaggaagaaagcuugcagcaguuccacacaccagcccacggucagggccugcuggagacuaucagcauccuguuuccucggcuccaccagcucccagaaugcuacuagcaccaucaaauccuggugauacuugccuccaauggcauuguacuccaggaccuccuugagccggucaacagcaucuccugucucugagugccccaucucauccucacucagcacccuaaugaucugggggaagugcugaacgaaauccugcuuuucuugggcauaaacaucugauuucuggucuccauucauucugagggaggagcaaagggcucuguuccuggauguggguuccugcucggucaggauuuc

SEQ ID NO: 14536 - RNA, 1507 nt, Homo sapiens
gaaauccugaccgagcaggaacccacauccaggaacagagcccuuugcuccucccucagaaugaauggagaccagaaaucagauguuuaugcccaagaaaagcaggauuucguucagcacuucccccagaucauuagggugcugagugaggaugagauggggcacucagagacaggagaugcuguugaccggcucaaggagguccuggaguacaaugccauuggaggcaaguaucaccaggauuugauggugcuaguagcauucugggagcugguggagccgaggaaacaggaugcugauagucuccagcaggcccugaccgugggcugguguguggaacugcugcaagcuuucuuccugguggcagaugacaucauggauucauccgucucccgccggggacagaucuggugguaucagaagccgggcauggguuuggaugccaucaaugaugcuaugcuucuggaaguauguaucuaccaccugcugaagcucuauugcccagagcagcccuauuuuuucuuuuuuuucuuucuuucuuuuuuuuuuuuuuuuuuuugagacagaguuucacucuuguugcccaggcuguagugcaaugguggaaucuuggcucaccacaaccucugccucccagguucaagugauucuccugccucagccucccgaguagcugggauuacaggcauaugccaccacacucggcuaauuuuguauuuuuaguagaggcgggguuucuccauguuggucaggcuggucuugaacucccaaccucaggugauccacccaccucagccuuccaaagugcuaggauuacaggugugagccaccgcacccagccuggagcagcccuauuaccuggaccuaaucgagcucuuccugcagaguuccuaucagacugagauuggguagacccuggaccucaucacagccccccagggcaauguggaucuuggcagauucacugaaaagagguacaaaucuaucgucaaguacaaggcagcuuucuacuccuaccuuccuguagcugcagccauguacagcaggaauugauggcgacaaggagcaugcuaauggcaagaagauccugcuggagaugggagaguucuuucagauucaggaugauuaccuugaccucuuuggggaccccagugugaccagcaaaguuggcacugacauccaggacaacaaaugcgguuggcuggugguucagugucugcaacaggccacuccagaauaguaccagauccugaaggagaacuaccggcagaagaaggccaagaagguggcccagguuaaggcacuaucugaggagcugaaucugcuggccguguucuugcaauaugaggaagacaguuacagccacauuaugggucucauugaacaguacgcagcaccccugaccccagccaucuuucuggggcuggugcgcaaaaucuauaagcagaaaaaguaaacuagagacugcaagggcagggagaggaggcucucaauaaauuauugugua

SEQ ID NO: 14537 - RNA, 5012 nt, Homo sapiens
aaaaugcuucucuuucaccauguaaugucuuaaacucauuaaacaaguaaaaacgcugccaaguuugugcagauucuucugguugggggaaaaucuguuuuuaaaaaaagucauuuugauggauacucccaaagagaagagacucagagccuggaucccaagggguaagagaaaauauccuuacaguaagggguuucaggagugcuggcauagaaaccaguuucucucucacacaugcucuuucucucucucugagaugcaagaucaauuacugacguugcucaagagagaagguaaaugagaaaaaaggugaaaggcaaaaagaaaagaaagguagaaaggaaaaggaaagaaagaaggaauggaggaaaggaagaaguaaaaagaaaggagagggagagagagagagagggagagagaaugagccuagucggcuucuugccacacuuaugagcucuccuaagccugcuccuuuggcuccuuuucgcagauacaagcaggucccggauccucuuuuccuuguucagacguuucccuaggguguucccuugggcaacucacaucaucuguggucucugcaucguguccugguguggagaggaguaccagugagaauagccaggcauguagcuguuggggggcauacugacacccuuggccgaggcagaaacgucccagacuggaggcagcgcuggcgagcguggcgacagggccgccgagcccuggagggggucgcucucaugaggauuacugcccugcuucagcaguuucuuaaacuuagagcguuuguucugaaaccauaucuucaccugcaagaaaugcagcaaucauuaggcccauaaacaucaaaccagugccucuaacgucacucagggauuuagaagcaauauuaaaaaagcaaaaaaacaaaaaacaaaaaacaaccaccgccaacgccuacaagccaaguccccgccuccuuccaccucuuucuagccucuuacagucccacuuccuacaacauacuagguaucuugccuggauaccuaaaguuauuguaauucuagaauugcgugcuagcguagguuuaaaacaacaguauaaauaagaaaaagcugaaugagaugaccagguccaaagccuaaaggauuuuuaaaagcagcccuuucaaaucaaagccauucaauugaaugcaccuccucugaaagucuugucauuuuacauaaaauuuaguaauguaaauuuagucuauguaaaauaacuauuuuacacagucauuuucuccguguacaugcauagagauacccaaaagcuguuaucucuauaaagguacaaggagcaaaugacugaaggaauuaaagccuguacauuuauaacuaaaugccuugaauauaucuaugcauauauugcauaugccauagauuauacaugaagcaucuuucuccagacauaaauauauccccauaaccuugcagggauuaaggacugcagcuccuucauucccuauuuuguauguugccuagucaaacuguggucaaggaucaucacaugauuguuaguauaguaauuaaaagucaaagggcuucugaaaauuaaacgugaaucgggaaucugggaugggagcauaucuaggccaacauuucagaucuacuuuauuugaagaaggaaauuuuauggugcagcuuccuuuaccuuuaaaauucccuagccauaagaaucuacuuuuucaagacgcauacaagucacugaauagccggaaucccuucauaucaaaccccaaauauuaugaauagcaauauggaaagagaaaacaggcuaaauugaaaaagagcuuaaggaacaacugucuuaagucaacacacaaucagucugcagcaacagucucauaaaaccugagguccccuugcugaagauuaccuacaucagaugaggccuacuuacuccauguagguaaauuaaucaacaaaaacugcaggugauugcagccuggcuuuuugaccaggguccuaauauacucaccuaagcuccuucuugugaaaucugaaaugccuucuauggcuuucaaauuaguaggaugggagaacuucaguaacuguacuuaacuguggcuucaccuguuacaauuuugguaacauuucucuuugaucuccaacucugccacugcacccaaguccugugcuccagggaggcagcucagaccacaucagucugucacccagaugacuuaaccaccgugcuuagggaaaucuucagaaaaacccaccuugacacuccuaggauaaauagauugcacuuuggagccuuuacuaaaccucauuggaaccuaugccuacuuuguuuuuucuuaguucauuucacaaguuuucuuucugugucaauggguugaaaaccuuauuaguucccagggccuacaaaaggauccuuaaaaaaguugaaccuuauucugccuccuggcuuguacaccuuuuucuccuaaauguuuguucucuuucauguuguucugcucuggaauaacacucaauugaauuaugaguuuggucacaaaaggauucuaggcugggguggggucgccgaggguugggaggaugugcaaauccaauccaguauucaauaccaggucauucauuccaaacuguguugucccaggaaagugcauaacuggagcaaaaggcauuugucauuaagcuccuuccauccuugguugacuaggccaacaauuccuccugaugugcucccugcccgaucugcaagcgguaccagcauuucagggauacuugggcuucucgggaauuaccuguguuugugucaguccuaaggaagcugccaguucggcucucucuggaagggccagauacugugucugcugaaagcgaugguuuaaagccuggagcugcaggcuggaauaaaugguccgaggcuuccgaaucuuuuucccuuuuccauugaaccugauuuccccguuuucaaucacuguaguuuuuuguugaucuguaagcaaauaauacagaggagcggucacccgggaggcuacugcugccaucucccugcuccuggcguggcaugcaacgagucuccccaaagcccaauaaggguuaccucgaaaaaucccuaugaugccccgaccucucuugguccacucugcccgugugcucccagcgucugcguaaucuccuugacccagucccuggcccgaacaaugugcagcgucugggccaagggagcgccagaggcccucagacaaacagcccgcuuugccgcagcggaggcggugccggaggcucucuggggugcgcagcgcagcaaggcggcagcuguccgggcggagcggggccccugugcccggcuuaacaguaccugaagcugugcuugagccacccagguguuuacgcggccaguugacuugaugucaccagcuccaagcucagugcaucaagcauccucggcauguuuugaaaugacucuccugaggaggaccaaauccucaaacaaaacacaaccaacagcucagaccagcccacgagcaggcugcgccucucacggcaacuuugucccccucgggugcugagaaccaucagcccgagguucuuugcuuccccuccacgaacaaaggagcagccaacacuguagcgaaaagcuagauagggggcccggucagggaugaaggugagggacacuuuaaagcccacuggaaagagccugacuguuacuaguuuaaccagagcgaaagccaggccagcuucccuccgagucacugaggagcacggggcgccccacgcaaaguaggccacugccugcccagcgugggcugggaagcaaaacacgcuccccaguuccggcccagaaauguccccagccgggucaaacguggguuacagccuggagggaaggagcaaggaaaagggcgcacagacccaggaggcuggagagcgcaguguggacuaacucgucgaacgaagccugcgccgggcccgggacucagcccgaacugcgcgucggaagcugaggguccgcggcggcgggaaggggcccggcugggagaggccggcaggcaggcgccaggcgagcgggcgcgcacggggcccggccaagggcgcgcggggccgccugggggagggggccggcggaggcccgggcgucgaggaagugagcgggcgggcgggguagggggcagucgggaggcgggagaagcgagcugccccagcggccucucaccugugucguccccucgcgucugggcggcugcgcugcuguugugguaggacuggagguaagggcugugcugcgaguggcucauguagggguaggcggcgagcgagcggugguuguaggaguucccuccgcccgacgcguagggcgagccguggugguggugcugguggugguggugguggugcgagccggccgcugccgccgccgccgccgagugcaggcagugcagaggguagugcgcgccugccauggccggggagcucugcugcgagugcggcugcggcggcggcggcggcggcggcggcggcuguugcuguugcugcugcugcugcugcugcuguugcugcugcugcugcugcugcugcccgaacuccaugaaggcggauuuggacgaguccuggccuuccaagccgucagccaucguagucauggucaucaucaaaaacuuugggggcuggagaaagccuucucccggguuuccuccacccucccccacuuggcucgcgccgcucuccccucugcagccaccuuagcucuuuggauccuugcaaaaaaaaaaaaaaaaaaaaaaaagaauuuaaagagggggguggaggugguucucccucucccucgcucuucucuaauauauauauauauuuaauauaaagagauauagugagcggggccuuguuaacucaaagggaggaggaaggaggagggaugggagaggagagggggaggggggaaucugcucuccccccgccugcuuuccccccuuggauuuuuugggggcuggugcaguuuaaggcagagauuuuaagguggauucugcgaaaguugcg

SEQ ID NO: 14538 - RNA, 4456 nt, Homo sapiens
uuuuucagaaacauuccgcuuuucauggucgaaauaauuuuauuuauccagaauauacaguuuaauuccucuaucuacacuuauuuacauggcuaaaauaacauugaaaaaagucuuuugaaaaguugaggucauagauuucaaggcaccauugaaaguguccacaguugcgcaaaaaaaguccucuguaaaaaaagggggggucuuuugaaaugcaauaacuuacaugcaaaaaaaagcuuuacacaugaaucuuuuucaguuuuccgaacuuccccauaugaauuccuuucuuuaugauuuucuagaacagcaaaacacaguagucccaaaaaagagaguaagagagagcagcccaucuaauagagugucccggaggccagcgccagcgggugcuguaaggagcccggcggcggcaggugggaauugauugagcuggcugcacuuguguaccaggaugcagaguucuccagguagcuggacgcuggggacugguuggaggucggagggugggcaugagggugguggcugagcgagcgggacgagcccuggggcucccacaccgcuggagacugcggcgaguuacacgccauugggucgcuggagcugggacugugcuccgggggcaucuccccguuuuucaugaucuucuugaucuuggaucuuuuguucugaaaccagauuuucaccugaguuggggaacaaaggcacacguuaccgggacacucagaggucgcccgcgccuuccccggggcggcgacuggaggcaucuucggaccucugggcggcccagcccugccuggcgucuccccgccgcuugcggccuaccgccaagaagcuaugccuuaggcaaaccauggagcucuggccccagagggcgcccuggccggcucggggcgccccggcccagcgaggccacgaccccaaggcuugucuuuuguuugggcugggggugggggacgccagcgcggcgggugugcgcccgaguguccucggcggcggcgcgccucguguaagccugcgcaggacgcgcggaacgcggcgaaggucuccaaaacaaucgcgcgagcccggcggggaaggggcguggggcgggcuacgcgcgccuguggucagaaaaaggagcgagcucccaaccucccguccuacucccuucacucccucugcagcucagagaggccagaaucugacugcagcucuuggcggcgacucgaacauucuuuaugcuuccguaggccccagcuggguuggaggaguaaaaggaaugggacaauccaggaagacuucucacguacaauagcgccccccaccucgcgacccuucgguggccguggccugaagcucccguaggcucagggcacgacccuucaguuucuccgcuccaggcgacguucucagccuuuucuuagccugagaccaccgcgagaacaccaggccuugcucacccccgaggaggcucuacauuguuaagaaaaccagauagcugcucugggcugccuaggccgcccuagaaauaacccuccgcuugcuuucaacccgcgaaauuggccccacagcuccggaggcccgcuacggggugggggcggggggcgcgguuagugggagguaucuccagaccgcugaugaauaccauccccaccgucucaaggccugacucaccgaguuaaagcauaggggcugaugucuuugggucuguuaguuucucacggguacugucaaaacagcuccagucccaucgagacugaaccgcgcgacccaaccagacgugcagcucaggcaggucuagugcauggcagcgccguauuuaccuguguuugugucaaucccagcgaggcggccagcucggcgcguuccggcaaggcgagguacugagucuucugaaaccuucucuguaaugcggccagcugaaagcuggaauaaauaguccuggguuuacgaacuuucuuugguuugccauucaccauucucaccucgggcucggucacuucuuucucuaaauaaucaaaacagacucaguuaaagcuugucaccagacaaugccccuuuugcggaagggccucaaauagaguccuagaguuucuuaccacucagucuucauucuuugcccauaucaccaccaccuuugcuuuucaggaccgcgauaaauaugcaccuaccccaaauauggaaaagcgggauagccucugauuaauuccuacucuguucauucagauaguuugugcaaagcgcuuccuacaacacugcuuucuccuuggcaucugggauucagcucuugcggucguugcuucuucucccggacuuguuuuuacgcccacccugugcuccuccgcguuuccgccccuccccaggcuucaagaacaccagccccuccccaggcuucaaggagguggcccugggccgugacccuacuucugucggcgucuguucgggcgcccgcagaagccagacucuugggcagggaagacgcuaaccgaggucuccaaaguucaaagacccacaagcaaacugcuccuucacuucagcagcaagcggucggggccgccgcagacagagggucgauuaugcaacccccauaaucucgcugcagaucugcgagggcacagaugugucugguuucuuuuacaaauagacuuaauauguucuuggcaaaaaaaaaaaaaaaaaaaagaaaucuuccacuuaugcacggaauacagagagagugaaagaaacguagacaccucaacccggggcucucuuuuaaaguucagcaagagucacacacugagaaggaaccgguggugggguguuuucguaggaaaggggcggcaggucaggaugagauucucacugucaugaguauggguuugggcgggagggggagggauugccaaacgcguguuguacaaaccugcccuggggcuacaacuccccuuccucaaaacuaccaccccucuggaacugacggagaaccucuccagggugugugugugugugugugugugugugugugugugugucaaguuccagggagaaguguggaggaugagggcuguggucucaauucugccagaguaggggaugcuaauauuagcaggauuauuaaugugcuggugggaagagaucaaaccuuaccaauaaaaccucuccgccgagccucaugccuuucucuuaccgcccaagcucacuaacccucuuaaacucucuaaguaaguuucaaagcggacgaaaaaggaggacggaaagacaaauugugggcgccuauggagacagaaaaaaaaaucuauccuacaacgugaccccucagcaacccuccuccaccuuuaaauggcuuuuuguuuuuggaaaugccuggauaaaccgcaaaacucucggcgcgcucuucucuggcuggcuacaacuccuuaacccccccacccccacccagcgugcucagggcacccgcaccgugcuagcuuguggcggcucucaaacuaauccugacugaguuuuugaggcagccuucuauucccacucgcaccaacccagcacgcuuaccaaaauucccaaguaaccuucucuuuguuacgcaaacgccaggagcugcuugauucuuucuucucuccaccccuauccccuuuccagccuagccggcuuccuggccgggcaagcugggaauucagcgacugaagggccuuggaaggugccggaggggagagacgcuaguucgaaccuccacagggcucuccuacuaaaaaucccuaaaaugcuggcccgagaaacucucuuuguuggagggucugaguccuacucccuucugccgcgugcgcccccacugccgugaaccgcugugacccccaaucuaccaccccaucucgcgcccccagcguccuagucgcccuguaucugcccagccuucccccuguccauguaccuggcugguugguggcgcuugggacgcgguuguaggcgccgccguacuggugguaggagcuagcguagcuauagucggcauaagcuuuggcuggguagcucccggcggagccguucacgccgugauacugauacugguagggguugagagcuuugccauaggaagccgagguaggagagcaguagccgugcggggcuccccccguagggcuguaguagucagaaucgguagcugaagacucgggcaaaguuggcgauuccugagacggauggugcauagcugcggacgucuggaacggagcuuggaagucgccggaucggaugcuggggacccuucugucaaacacuccugucaucgcucacgggcggcggcagcggcuguccuugcuguuguggcggcggcagcugcccuaguuggcuguggggcugcucuggucuaagcagacauggcugugggagcgagggaggaggaggaagaggaggaggagagaaggaggaggcggcggccgcggcgaggaggagacugggagucgugaagucucugucuccggccggcugacugcug

SEQ ID NO: 14539 - RNA, 20404 nt, Homo sapiens
caaugguuuagauuuaggacuuuuauuuuuuucacacccaaguuagccugaguugacucucauuguuccccuaucuacccacaguccccauccaacacgaagaaauauuugcuuucacauuacagcauaaagaccaccuaagcuuugacagcugacuuguagugggucagcgugcgggcagaagggucaguggcauugauccacuugggcauccaguaauggcucagccagucagcccggccuggguaauggcguucaaagacuugacgguaguaauauccuucuuugguuuuaggaguauugaagggaaauuucugggcugcauuugccaucauugcaucaucaaccuguaagaauaagcauauaagagcaaaauggcuuaaaauggcaggaaauacuuguguuuagucucauuucacgaaacagaaaauguuaagacgugacuguaacuuguaugagacccuuugaaucacccaucacuuagaaaaugcuaaaguauucauaauauggauagcugcagugccuuuuaaagaacacucauaugcauauuuuuaauacuugguggcucuguuuuagucauuugugccuaacaagaucuggcacccagcaggugcccaaaaaucugauaaaugaaaaucagugaugauuaguaguaagucuccucucucucucgauucuagaugcuacuuuauaauccuucaugcuacuuaauucuuacguaauucuuacaaaagagauaauuguuuacagagacucugaaucucucugauagggacauccuaucagagagauaucugauguauguaucauucaaacuaaauacauguaucauucaaacuaaauacauguaucauucaaacuaaauacaaaaugaacagcaaugacagcucugcauccaaacugucuuauuccugaaaauguuuuuaaagacauuauaccugauguucaacguauuccuguaaaaucuuaaaccaggaauucuuaacugaaguuauuccaucacugaaggcuucuuuuggucgccagagaaucucuuuggguaucagauuggaauccucaaacgucucucucaggagauguuuuucuaucccauucugacgugacaaaaaaaggagcaucagguaaaaauuacaaauauaaucugauggcaauggacaguuuuaccuugaguugauuuaccuaccuuuggaauucucauuucugguggcagagacaaguaauaggaagaaaaucgaugaucuagaaaugggacucucaguucaagacuuaaaggagaaaagaagaaaaucuaaauuaaaauggguauuuagugccugccagguuagguucugauucaguuucccaucaauucaaccagaucuuaagaaauguuaaggucauacagucacauacaagccuccuaaugacugcccuacacuaaugaauagauacaaaaaauaaaucuucauuuaaaauaauacauauaucaugucaucuagggaguaaaacuaacugagacuauuacuuuuacuuucccuucuaggaauaguuaaaugcauauuucaaaaagcagaaaaaguuacaaaacaugagugacccaaucauuaagaaaauaccuugccuagaccuaacucaguguuuacuaggugagaccaucucuucuaacaauugugaugacgauacaguauuuuuuugccacugauuaaaaauucacauacaauaugcgauauaaaccagugucccacuauauuucaucaaauuccaaaucaccgguuuccugaagccuagugacucuaguuaggacaagcagagaggauaaugaccagauucaguucauuccucaaacccauauuuaauuauauccuuaucuaggugugauucagcagaggcaacuaagacauuuaaugucaguuguuuauccuguacaguaaaagucuucaguucuucaacauaacuuuagacaacuagaaaugauaaccaaagaaaccugguucuuuauaauguaaucaaaccccuuguaucuucacuacucuauucccucagggucacuacagcaccacaugggcauggugggcacucacuacuugucacaugauguuuacgaucuuuacuucucuuuaaaacacuuaacgguagcugcuguagcagccuugccucuuccaucuugguuguucagaugugagcagaauguuguuacccuuuaaaggugaaaacuccaccucaaacaaccuauggaagaagacuucucuccauauaccacaacaccacuuugaaauguggccuaauccuuuugggacaaaguuaagaaacagcuucauuuucucuauaaaagucacacuuuguaacauauagccaacuauauguaacauauagccaaucagcuauugauuuuuauuuucucaggguauugagcuuuuuguuuuguuuuguuuuugguguuuuuuuguuuuuguuuuacaauagccucuaaaaauauuacccaugggcagcaguaguucgaucugcgcggagaacaucaaacaaauagaguucccucagaagccucucacucuccuccucggcuuuuucaggagaaggagccuauuucacaaacaaaaacaccaagaguuuugcuuuuggcacacaaagcaguuuuucuuucucccucuccaauccuaaagguggauaagacaaaaaguuaaacaaauuuagggaagggaguaaauaacugaacagagguaagcaaugcuucacaaaacaugccuuccuuccuaccaaacugcuaauauuagaauaaaaugaacacaaugggcaacagucauaauuccacaggaugcuaagaaauggcagaaaggggauucucaagcuuaaguaguuuuauuuauuuauuuuuaacuuuuuuuuuuuuuuuuuuaagagacggggucuuacucugucaaccaggcaggagugcaguggugcaaucacagcucacugcagccucaaucuccuggguucaggugauccucccaccucagccuccucagcagcuggggguaugagcaugagcccucauacccagcuguaacuaguuuuaaagaauaaaaauuaucugacacauuaaaauuucuuucuuccccaagagauagaaagcaaacacuaucagauucccuuuuguaaccucacaagauacucaaaaauaucacugucauacugaaagaugauagaaaauagucaaacaauucauacuuuucuuaauauagcaugaauaucccuccacuucagagugguuaccuugugaaaauauauguaacccugcguaaguucaucugauccuucuccagagaagaucaccacgcuaucuguguucuuccgaauauacuuggaaauuaaauacauaccuuaaaugagagagagaaauuaacuuuaaugucaacauaaccuuccaccaaaaaugccuuugauuugauuuuuggaaauaauugaaagcuuuacuacuauacuggacuucauauuaauauaaaguaguuuccacaauaaugaccuuguauuuauaagccauuuauauguacuuaauccaaaaguacuacuguaaaauaaaauaacccggaaccauuuugucauuuucuaaacagguuuuaaaauucuaauguuuuuagaccaagaauguccaccucaaaacuuugcuaagcugaacaaugacucaaauaccuaaaaaucaugccuuucauagugguauuaugacacaaaaauaagaauaaccguuuuggugguuuaguguuaauuuugauggguauuuucccccugccacuccccauuuaccagauuucacauaaagcuggggagacuauauaaguuauuaaacuugccuccuugguccugcaccacaucucucuaaaccaguguuucuucucaaccuuguuuuuauuaucaccucagcuagagagccuuuuuagacacuuauuuuccuaaccucaccccagccccaugaaauuccaauaccagagcuauccugucuaucugcuuauuuacugugauguuuuggagggccauaaaccauuguaauaccuaagauauuuuugccuuccaaggcaagucucucaagggaggcaguagcauauaaaggcucaauaacacuggaucagucugauuugggguauacuuccaaucucaguagauacauuaucuacaagauaaaauuaguauuguuugcagagcaaugauagcuagugacugguaaguugugugauggaauauaucuaaaaugacuauuucuuaucaaaaaugcauuaccaaaaagaccuauuuccucacuguauauagacuguagcccaagaaacuauaagagaaaugggagguagagggcagaaaauauguaucugcucccuggggaaacaccaacagugacaccaacaauguggagguugaacuacguauuuacuauucccuucacuccaaaagagauucagagaauucuuaaguggucuuaaauaaucaguaacauagggauuuaauuugcauucauccuuaaauaacauuuuaaaacuauggcuugaaauaauuuuuuuaaaccuuacauuuuuuucaguauuaaaaaaagcuuuuuauuuaagaauaucauaauaccuuaccuacugaagcacgaacuguuguaaugucauaaguuuccaaggaaaauaugacuucauccagagccugaaugccuuccucagaguuaaaaaggacuucauaauguucacuuccaauaugaucugccaccuuauuauauaaagaaauacccauuuacuuguuaaagaaaauaacuucccuugaaaaucaaacaugaugggaguucacaaagcuuuaugaauuaacaauggugaaaacuaaacaagggaaaaaaagaaaaaugacuuuacagcccaccacauacaagccccauccagcacuguucccucgccugcuucaacuccaccaccaggaaguaagucuccccucagcuccucuggugccaaggcuucaaccauucucccaguuggcaccucccucucuaccuauuuuaccuaacccaccucaucucucucuaguccaacauggucccacgcuaagcuuggucuuuuuugguccuucuuaaaugccuaauuuuauauccaggauguuauucuuauauagaauggcccuuccccucauucugcuuuccuuggcuauuuuggauucucucggcauugauuaccuugcacugagacugcucucuagcuuuuucucauccaugcuacgaaaguccuccauagugggaacuaggucucccgcucacugaauacagacaagcugcccucugcccacaguauucuaaauacaguacuuucaaaaauaauaauaacagcuaacacucauuaaguacuuacuacaugcuaaguucuacccuacuuacuuuacaugaauuauaucauuucaccuuaaaauuuccccauagcagacacuauuauuuugguuacauaaaugaguagagccaggauuucaaaccacaagucagguuccaaagucugcagucuuagccaugauacuaugccuuuacguuuaaaaaaaaaaaaaaaaaaaaacgaacaaaaaacccguuuuuuuaauuuuucaagauggggucuugcuacguugcccagccuggacuugaacuccugagcucagaccuccccccacagccucccaaguaucugggacuauaggugugugccacugcaccugacuuaugccuuuacuuucuuuuuuuuuugagacaaggucucacucugucacccaggcucccauaaggcuaagacuacaggcaugcgucaccaagccuggcuaguuuuuguauuuuuuuguagagauggaguuucauuauguugcucaggcugguuucaaacuccugaccucagguaaucuaccucccucagccucguaaagugcugggauuacagguguaggccaccaugcccagacaccuuuacuuucaaaagagcauacuuaucaucauagggucuuugugagaauugcaugggucauaacagauaaaaguacacagaggacaguguacaacacagugcauauccaacagccauuucauucuauuuuaauacaaucaauuuaaaacaauugacccagucaauacagcagcaguagaaucacccauuauugacuccauuuucauucuaauaacaagucuacucuaacuacacuacacaagggacagagacagcaccuuaccuuucuagcagccaguaaaucggggcugucuuccaugccaauugcaaaugucuggagaggauacuguacuugggcuucuuucagcugcuucaacagaguggcagcaaccaagcuggaguccaagcccccuacaugcaaaagaggaaguggaaguguccuaguuaugugccuugcauaagacagggacagaagauguauauuccugauaaacaccaagaucauaguuuuacuauuuaaaauccgccaaguuuuauaaacugaaaucaacuucaacaagagaaaaauauauaaacugugauaauaguaguauuugaauugguuaaaaaucacuacacagaauucuaaagaacauucacugacucacucuuaacaccaauaacauagcuauaguguaacucaaguuggaguaugacuaugacuauuaaauacagcuuauaaaaaaucauuuccauccuauaaugaaggaaagaguaaaucauacaguaaauauuuuauaguaaaaaccaaagggauggcuacaaaucauuucaauuaaacacacaugaaauauaauuagguuuuuuuaauugacuucaccugauaaaaggcagccaauccuucugucugucaucaaacguuucuuuacagcauuauuaaaaaggauccugagguuguucuucacaguuucuaucucaaaaccuauaaacacagcaguaaaucaaacagcuccagaaaaucuugggcuggauuaguuauugaaaugaaauacacaaucaucaacaucuaucaugaugguauuuacucaaugguggagugugccaaaucuuaauguguucccuccaaacaaaauaggaaguaggucuugaaacuaaaaucauucaaaugaugggagaauacaacuuaaaauuuuuuucccuuggagaaggauggggaauaggugggugggugucugcuaccuggaaagaguuucuccacauugucauagagggcgugcagggguacaucccgacagugaugauauuuaaccauuuccacggaugcaacuuugccauuuggcuuuaaauccaaaacuucauaguguccaggaagaaaaggcuccacuuuuaaaaagggagucgcggagugcuucaauguaacaagaccuagaaauucacaaugauaccuuuauucaaauuagguaacccuucccaauaacuuucacgauuaguuaacaucaucuacauuccuauuuucccuuuuuaauacaaacacauacccauuaaauaagcaaaauaggaaaaaaaauuuucuauuuuccuaagcccuaccaucuacuuaccugagagacaauaauggcacagggauauacugccaaauuacacuaacuuuucguaauucaaagaaauagaaaaaucuccaguguucaauuucuucuucuuagauuucuaaucaagaaaaccuauuuucuauacuaaagcaaauacacaaaaggaaaagacacacuuaugaagcaaagggaugaacuggaguccuaauguuaugauaggcugggagucauuuauuugucaucacugagguauuuucagaacacagccaugguucccagaccuuuaacaaguacaaugauccacuuuuaccuacuuuaaagucagauaagaagacaucuaucccuuaacuaguuguuauacacuauaugugaauaaaaccauauaacuuaaauuuccucaauaaauucucacagacaguacaguacccaaccucucaucaccaugaucuuugauacaaacaucaauguuuuauuguagaucguaauggacuaucuacauggaauacucgugauuuacaauuugagauugucuacccagccaguaaccuguguagcacugaauucaaauaccagaaaaaggacccagauucccucaccagccagcagagcucaagugagcuacacaacccggauagggaauggggaguaauuaaaagguuuuaagcaggcaauacuauaaucagaugagauuuugacagguuauucuaaaagcacugagaaaagaaaauuguugcaguauuccagaugagauaauuuggucuggaaaaggacagugucaaggauauagaaaagaacaauuaaggaauuucagaggguaaguuccauaucaagugaucaucaggcucaaagaaggcccaggggagcaggaggcugcuuuuccccaguguucucuuuaccaggcuuucccagcaguccuggcaacugacauauauauaugcuuguucuuugccaucugaucacacuagaaaugccugaaaauaagccaguuccaguauuaguacaaacacugugacuaguguccuaaggaccccuuugauugaucucauuaucccugcuucagccaauauuaaaucugaaaauuaagugagaaagaauuuaaagaauggcaaaaagaggcagggagagagauauuaggauguuacugcugcacagguaagggauaaaagauaaaugucuuccucaaguuuaccaucaaaaagugcuaugcaugauuugcaaguauuuucuuccaacuugugggccgucuuuucacuuucuugaugguguccuuugaugugcaaaaauguuuaauuuugaugaaguccaauucauugauuuuuauuauuguugcuggucucauauuuaagaaagcuuugccaaauccagggucaugacaauuuacuucuauguuugcuucucgggauuuuauaguuuuagcccuuacauuuaaguggauuaguucaaaacugauucauuugauccuuuuuuuuuuuuuuuuugagaugagucucgcucugucacucaggcuggagugcaguugcgcgaucucggcuuaccgcaagcuccgucucccggguucacgccauucuccugccucagccuccugaguagcugggacuacaggcgcccgccaccacgcccggcuaauuuuuaguagagacgggguuucacuguguuagccaggauggucucgaucuccugaccucgugauccacccgccucggccucccaaagugcugggauuacaggcauaagccaucgcgccuggccugauccauuuuucuguauccauaauuuuuguauacgauguuggguaaagauucaacuccaaguuuugcauaugguuacauaucugguugccccugugccaguuuucaaacuucuuucuccacugaauaaucuuggcacccuugucaaaaauaaguugaucauauauguauggguucauuucugacucucaauucuaucccacuagucuauacaucuauccuucugucaguauuauauuguccuuauuaccauugucuuguaguaaguuuuaaaaucaguuaauaugaggucuccuacuuuguucuucauuuucaaaagauuguuuuggcuauucuuagucucuugcaauuccauaugaauuugagagucagcuuguagauuucacaaagaacucaucugggauucugauagggaucaaguuaaaucuguaaaucaguuuagggaggacugccaucuuaacaauguuaagccuucaaaucaugaucaugggauacuuuuccauuuauuuagaucuccucucauuucuuucaacaacauuuuauaguuuucagaguacaaguuuuacacuucuuaaauuuauuucuaaguauuuuauucuuuuugaugcuauuauaaaugaaguugcuuucuuaauuucauuuugauugcucauuuuaaguauguaguauucaguuaaagugugucaaauaccauugauuuuuguauauucaucuuguauccugcaacccugaugaacagaagggauuuguaucuagaauacauaaggaacuauuacaauucaguaauaaaaagacaaaauaacucaauuagaaauggguaauucaagaauggauaaacaaauugcauugcaugcaaacaaauggaauauuauucagcaagcacaccaacauggcacauguauacauauguaacaaaccugcacguuaugcacauguacccuagaacuuaaaguauaauaauaauaauaauaaaugagcuaucaagccaugaaaaaacacagaagaacuauaaauguauacugcuaggugaaagaagccagucugaaaaagcuacauacuauaugauuacaacuauuauacgacauucugggaaaggcaaagugagagagaaagcaaaaagaucaguaaugacugggggguuaggaggaagaggacgggaggaaagaauaaguggagcacaggagauuuuuagggcaaugaaacuguucuacauaauacuguaaugguggguacauggcauuaaacauuugucaaauccaaaaaucuauaaaacacaaagagugaacccuuauguaaacuaugaacuucaguuaauauauaaguaucaguucaucaaaucuaauaaauguagcacaguaaugcaagauguuaagaguggggaaaacugggcaggggcacuguagggggagcauaugugaacucucugcacuuuccucucaauuuuuucuaaaacugcucaaaaaaaaaaauaaagucuauuauguuuuuaaaauaaaaugaucccuaacaggaaaaaaaaauggcaaaggaucugaacaaauauuucuccaaagaagauauacaaauggccaauaagcauaagauaagaugcuggacaucacugucaacaggaaaauacaaaucaaaaucacaaugagauaccacuucacauacacuagaauggcuagaauuaaagucacacacuguuugugaagauguggagaaacagaaauuuuaauacacugcuggagugaauaaaaaaugaugcagccauuucaaaaauuagucuggcaguucuucaacugaacauaguuaucaugugucccagcaauucuacuccuagauauacacccaagggaaauguccacacaaaaacuuguacaccaauguuuauagcagcauuauucauaauagccaaaagggguaaauaauguccuaaauguccaucaacugacaagcgaauaaacaaaaugcaguguauccauguaauggaauaucauuuggccauaagaaguaaguacugauacaugcuacggcauagacaaaucuugaaagcacuauaccaagugaaagaauccagucacaaaagccgguaugauauauaaucccguucauaugaaacauacagaauagggaauccagaggcagaaagacuggugauugccggggcuacaacugcaggggugcagcugauggauauggagagauggaauucaaagcuaaagggcacaggaggcaggguguuguggugcaugccuauacuccuagcuacuagggaggcugaggugggagaaucgcuugagcccacgaguucaaggcugcacugagcuaucaaaccaccgcacuccagccugggcugggcgacugagcaagaccccaucucuucaaacaaacaaacaaacaaaaaccuaguugauccugccagcaaaaacuaagguaaagggcauaggauuugauuugguuuuuuuugagguggaaaaacaauccuaaaacugauuggaguguuguuuaccaacaucugugaauauacuaaaaaccacugaacuguauacuucaagugggugaauuacaugguaugugaauuaucaauaaagcuguuuuagaaauccuaacacuugcugugcuauaacugcgcaaaguaccacaaugcaauaauugcagagucaacccuacgauuauaguaugacacaggaaaacuuaaaacugcacuuaagaucaagcuagauguagagcauauuagcacagcaaaaaauaaacgacugcacuaaagaaucauccuucaaggauuacagaauuuaagugcugaaaaggagaguacaacuccucuguuuuuuuaaaaaaagguaaagacucauaacuuagucacuuguaaaauucuggauugcucucuaagagauuuucaaauauaauuuaaaagaaaacguacaaccaagacaauaaugaaaaucuauagaaaaauuuauuauuaccuuuagcuucugaacauacagccaaaaauccaucuucugucauugcuuuaaacaaaggucugacuccauauguaucucuacccaggaacacuuucuuauuggcaguauccaguaaaacaaaugcaaacacaccauccaacauacaaauuguuugcucaauuccuccuuugucauaaagaugaaggauuaucucaccauccacuuuggucugguauucaaauucaaaaugcuguugcaucuuaggaagcgaaagcaaaaccaaaauguuagacuccuuguacauucacuaauaauuuuuuauugcaaagaugcuucaguauuucugagcucuauaauccuuucaugcacuuuggugauuuaggagaaucacagcauuauuaaacuaugguucgcuucaacucauauucugcaaauucuguucaacauaaagccgaacccaugaaaauuuuaguugcagucugauaaacagaacauaaugggaaugugccagaacaguaaccuguggagggauggaaauguauauuauauacauaccauauauguaauacauacauauauuuauauauauacagauugaguaucccuuaucugaaauguuuggaaccagaaguguuuuguguuuuggacuuuggaauauuugcauauaugugagauaucuugggcaugagacccaagucuaaacaugaacuucauuuauguuucauauaucuuauacacaaaaccuaaagguaauuuuauauaauauuucaaauaauuuugugcaugaaacaaaguuugcauacauggaaccaucagaaagcaaaggggucacuaucucagcuaccauguggaaaaucuguggcuguuugacaucauugaccaucauuccugacucugaauuuauuaugcugcugaugagcaaucauuuucauaugcuuauaaaauaugacauaccauuaauacaguaagaaaguaauaaguagcauaguagaaucaccagaauaccugcaucagcuguuaaacagcuguacaaacaauggcaggcuuucagacuccaccuacaaugcugcguuuugauuaaaagguuacuauacacuguauuuuuuuuuccuuuuucaggugagaagaaacaucagaagcagcugagcaacuaggaagcggguccucugagauugaagaggcauucggccagaugacuuuuaaauguuucuccagagucaucugcuucauuaacaauggcuuuugucuuggaaggcucucuuugauuuuauaaacugacaugaccucuuguucuguuaugaaugcagguagcucuaguccuucaauaucucuaucacacauuuucaccaugucaucuauaccuuuauacuacaguccaguuucuccuacagcuugacuuucuguguuauaaguguuucuacuuuuccuuaucacugcugcucauagaaauaucuacaggucuuuuugacauuuucaguaucuuaacaccacagagcagaaaauaagcaaaaauacacaauggauaaugcacauaagucccaucuguggggauccugccaauggcguauccagcuugaacaugugccauucuauuacccuuugugggcgugcuugcauggggaaauccgggcauguguagaaaaguuauacugcagcugaagcgggcugagagggucuuuuuucccuagggaacgccaaauaaacugcguguuuuacaccugcauuuugacugugacaucaaaaugcacauguaaugucaugucagugcucaaaaaguuucagauuuuggagcauuucaaauuucagauuuucagauuagggaugcucaaccucuaaauuuaaguuaagauaauagguugccugguugccaugacacuaaaaaacgugucuuuugcaacuauaaacuuuugauuugagaagauaguauuggcuaagaaguuccuccaguucagcuucaaaguccuagcuauaaaaauguaaagcaaagggacaaacaucauuuggcaucauucccugaaaaauaaauggcuccaucacaauaacagauacaugauccaaaacaaagcugcugguccccagggguggaugacaaugcccagugcuuccaccacugcagcagcauuaaagcuacuccuuacugauagauaaaaugacgguggcgcuuuauuagucugcauuccccaaaagaacagcaaagggacugucugccacugcaugcagaguaagaagguuugauuaggcuacuccccaauucugacacucuccaccaucaacggcaaacuaugagccauuaauggcaaacuaugaggaugaaaaguccuugauguauuccucuuucuucuuuguacucggguuuuuggcugacauuagagaaagaagagguuuaaaucagguggaaauccuagauaagcuuaaaacaugcuuucaaauuucaaaaaguaaaccuauuauguaugugcaugacccauaaauaugcuucacacuccauccaacucacuccauaauuugugaaucuuuugucuauaaguccucacugaacuguccaaaaaugggcuuugccuccagugacuacaaagucacuaccuggucaccccucucugcucuaucagggaugaucuguaacuagcaggugggggccuguaaacagucuucugcugacucuucugggcugaacugccugaaggguuagugaccauaaagcauucggugauauuaguaagcaacagcuucccaaaucuaccuuacccaccucuuuggccuaaacuuugcagguaacuuauuuaaaaaggagaaggguccuuuggguaacggauguauuacuuccuacucuccuaaaaccaaacuccaaugcugcaccuuaaauaaaagcccucaaaucuugccuccugacgucaugcugucauuugacuuggcugcaggcccugauacuccccugcagggagagggccugcucuuugccccagccuuuaccccauuccuccuuucuuucauucagucuccuucuacucccaguacaccucuggcuguauuuuauuguagugguaaacuuuauuuuuaccaaaaaggaggugugggggggauuucugaauacuuuauauaagccuaaaguauacauucugcucauuagacagacugcuagcugccccaacuacauaaacuuagaugcuugguagaagcaauggaacaaacuucucuacuuuuacaaauauaacauuuggcuaauuuagaauagaaauuaauuauuuucaaaauauuuaacuucuuguaacuuuuuaauaaaagaaauaacacuguucaagugaaacagggcacuuccuauuucauuuaaggggaaagccaagcugauaaugccauaauaccaccuagcguucucauguauaugacauuauuugacuuagaaaaaauuuuuaauacucucuucuucuaccucccacuagcaggaaauuccauucuugccuuuccuuuucaccauuucaucuccaaucaccuagaaaaaugaugucuggugcauaguagacccuuaauaaaggaauaaagaaauguguaaaaggaauuuccugaauaacuauuuuaaaacuuuuuaaaugagaagacuauuauuaagagucuuccuaugagcaggcaacaaacaaugacaaaagcuauuguucacagauaaaaauguccaaaaugugauuaggauguaaaucucuaucaaugccugacagguaucuaucaagaagucucaaaaaauaccaagaaacauaccaaccaaaugcaugaaccuugaaugaaaucuggcucaaaacaaacaagaaccagcuauaaagauauucuugguagcacuuugagaggucaaggugggcagauuaccugagcucaggaguuccagaccacccugggcaacauggugaaacccugucuuuacuaaaauacaaaaaauuagcugggcaugguggcaggugccuguagucccagcuacuugggaggcugaggcaggagaauugcuugaaccugggaggcagagguugcaguaagccgagaucgcaccacugcacuccagccugggugacagaaugagacucugucucaaaauaaauaaauaaauaaaaauauucuugggacacuuagggaaauuucauuuaaguauuaacuggauauuaggugguauuauggacucuuagguuuaauaauggcauugauguuauguagaagaauguccuuauucuuaggagauaaaugcuuauauauuuaggagugucauaauaucugcacuguacucucaaaugauucagcaaaaacauguguguguguguguguguguguguagaaagaaaaaucaagcaacuauggcaaaacauuaaugacuauuuaaucuaggugcuuguuguucuguucuuuacuguauguuaggaauuuuuucaaaaugaaaagcuggggagaaggagaaaaaauucuaagagucaaugaaacugaacuguaauccccauuuuuaucacuuuuuuugugaccaagucauuucacucaccuuuuuauucaucaguucccuauuuacauacuuagagcaaaugagauaacgaacauagagugcuuugcaaaggaaaaagcaugauacagaauauguaacaucaucguaaccaacaaacucugaaguuuaaucgcauccagacaucugguuucuuucuccucaccuucuuaugguuguagauuucaccauuguaacagagccacaaauacggauauuucuucacucgaauuggcugcauuccaaacagcgggucaacuaccgccaaccggugaaauccaaagcagcaguugguguauccauugacauucucaaaacggaaugcaucuggaccucugugugcaaucuucauagcacucagacacugaacagaaaggcaaucaucacugccaaacagcgcccaaaugccacacauggugcaaugaagcuauaagcuuucuauggagagaaaagcagacaaaucaaaaauauucaauauccaauccaacucugcauuaaaucuugauuccggaaacgugcauaaaccacuucaaagacuaaaauuuaaaccaucuuuucuauagcgauuucccauuagguuggcaggcacaugggaguagagaaugauuuaauuuacuuacagguauucggaaaagauagugaccucuacauucaaccggcuacagcagcuuagcaccuagccaaagccugcaucucucccaccuuaggauuuagugguuggcuagagcugacagcguccaugccacaucugucucugcauucuaaguuugcuuccaagauacagauacaaaugcaggcuggcuccaaccuagccagagauccuagccccacucucaccaucccaaaaucccucaaagauccaacagacuuuccagauuacuagagucuccucucagguucccuugacaguuaaaugcccucuuuaucugaacuagcugcagguaccauauaauggguacaacagaaaaucauacugcuguaaguguaaaagauacgcagcucuuucaagcauuucacuauauuacaucuagguuaccuucaagugauuuauucagaugugauugaagaaaaucuaaagggaaaaaaaaaacaauuuaauuugauaucagauauccuggcuuuauaacaaauaaaacauuucaaguuaauagaagauacaaaauauucacuaucaaaauguccucacugacaaaaauguucucaaauauuucugucucaaaguugcauuguucaguaaggaagcaaaguaggugagacauauacaccaacaacaucccuaauaaaaaacuuagcucaucccuauaagcccggaagcaaauaaaucacccuuacauacguuaauuacuuuccaauuucaaauucucaacugugaaauaaagggcuguuuuauuuggcugcugccagcucaaaaugacacauugcaccauguguggcauuugggcccuguuuggcagugaugacugccuuucuguucagugucugagugcuacgaagauuguacacagagguccagauacauuccguuuugagaaugucaauggauacaccaaaaacaagauguuuuaauuaaaacaucucuaacuugaaaaauaacuauuuugguguuuuuuuuaaaaaaacugcgaauugcagcaaaugcccaaauaguuugggauaaacacccuaaggaaaaaauauacauucaaguugcauaagucacuuugagcuauucuuugaugauauuucauuuauaucuaaaagaaccaaagguuuagcuggcuuuuccggaaaaccagaaccaaauaauauaugguuagaaugaaaaucaucucaagcaauuuggaaaugaaguaccacauguccuaugcugucucuuccaugcacuugaccaaauagcccaaauagccuauaacaaauuauuugagauuuacuggaaaaauuccauaagauuuaaaugagaugacuacuaauaagccaucugccuuugacucuauaucaauuuaaaacggguuaggaaagugcuuugaaaaucaaguauggucaucagggaaucaguuaccuaagucuucuuaacgcugcuuagugaaucccuguauuaauccugcuauaauaaauacauucuaaccacuaaacuggaggggaaaaagggagaacaaagaggcauguaaaguacacuuauuuuuucuaguaggaaaaagccaauuaaaacuauaaccuauuauuuuuauuggaaucagucuuauaggagggcaaaguuccuacugccgcuaccuguucucaauauuuuucuuauuucuuccuaaacuucuagaacagugcuguccaauaaauauauauguaagccacauauguaauuuuaaauauacuaguagccccauuaaaagaaaaaggugaaauuaauuuuaaauaaacuuaacucaguaugucccaaauaguaacauuuuaacauauauguaaucaauauaaaauauuaucgagcagauauuuuacacuguucuuccuacuccaacgacaaaauccaguguauuuaacacaauacaucucaguuaggacuagccagcacuucaagugcucaacaguuacagguggcuagcgccuaccgaacuggacauggcaguuucagugcauuuaauuucuauuccacuuagugcuacuuacaacuucacccucucccuuuacuuuuauauuaagaucucaguaaguaaccaacuacagacagguucaagcccuacuuuaccucuaauuacucuuacagcaaugcuaugaaucaugauuuaaaauuuaaaaaaaaaaacugcuguuaaauuauuagucaagcgcccagggcaauggacaguaaagaaauaauguaggccacgggccgagaugaaaacuguccuuuuuauuuaaagcuauaacaaucaucugaagccagcccugcaaaaugacagccauugaaaaaggcaugcuaguucuuuugccuuuuucuguacuuggucgccugugucccuaaacagaccucuucucggcaggguuugcucagcaagucacuugaugagucuugcagucuacagagacagguggggacugguggggauggcggggugagaggggaggaggagggugagcgguccaggugaggaggggggcaguugaaggugaaagcagacaccgagacggugauaaggccgcagucucuuccuagaucaggaccacgcgacaccugacugcgcccuggccacgagcacgauccgacccguccgccgcagggacccggaccgcgaaaauguccacaggcuucgacgccacauaguaaaaaaaaguacacauauaacauuuacaggggcucaaacugccgcugccuccucuccggagcgguccggccugccggccgcgguucccucucgaugcuucagggaaccaggacagaaagguccuuccgcuagcugucaggugcguaacaaucgcuaggcguccgccccgcccucccuaccgcaggagccgcagcaucagcaggcgcccgcgaaccgcgucugccgggugccaggcugaagaccgcauccuccaccccuuccuuccggagcagccccagggcacgcgaggaggaugcuggcgcggggcgcagggcacggggcgcaggacccggcucaccugggcguaagcaggucagggugauguggcgggcugaggccagggauguggacagcuugacgggcggcgaggccgcuggcgcuuauaccgaccuggcuccuguaacgcgugcgggaaguuucaucaugccugcgaggaccaaccagcgcgcacaggggcggggccgcgggguguc

SEQ ID NO: 14540 - RNA, 20404 nt, Homo sapiens
gacaccccgcggccccgccccugugcgcgcugguugguccucgcaggcaugaugaaacuucccgcacgcguuacaggagccaggucgguauaagcgccagcggccucgccgcccgucaagcuguccacaucccuggccucagcccgccacaucacccugaccugcuuacgcccaggugagccggguccugcgccccgugcccugcgccccgcgccagcauccuccucgcgugcccuggggcugcuccggaaggaagggguggaggaugcggucuucagccuggcacccggcagacgcgguucgcgggcgccugcugaugcugcggcuccugcgguagggagggcggggcggacgccuagcgauuguuacgcaccugacagcuagcggaaggaccuuucuguccugguucccugaagcaucgagagggaaccgcggccggcaggccggaccgcuccggagaggaggcagcggcaguuugagccccuguaaauguuauauguguacuuuuuuuuacuauguggcgucgaagccuguggacauuuucgcgguccgggucccugcggcggacgggucggaucgugcucguggccagggcgcagucaggugucgcgugguccugaucuaggaagagacugcggccuuaucaccgucucggugucugcuuucaccuucaacugccccccuccucaccuggaccgcucacccuccuccuccccucucaccccgccauccccaccaguccccaccugucucuguagacugcaagacucaucaagugacuugcugagcaaacccugccgagaagaggucuguuuagggacacaggcgaccaaguacagaaaaaggcaaaagaacuagcaugccuuuuucaauggcugucauuuugcagggcuggcuucagaugauuguuauagcuuuaaauaaaaaggacaguuuucaucucggcccguggccuacauuauuucuuuacuguccauugcccugggcgcuugacuaauaauuuaacagcaguuuuuuuuuuuaaauuuuaaaucaugauucauagcauugcuguaagaguaauuagagguaaaguagggcuugaaccugucuguaguugguuacuuacugagaucuuaauauaaaaguaaagggagagggugaaguuguaaguagcacuaaguggaauagaaauuaaaugcacugaaacugccauguccaguucgguaggcgcuagccaccuguaacuguugagcacuugaagugcuggcuaguccuaacugagauguauuguguuaaauacacuggauuuugucguuggaguaggaagaacaguguaaaauaucugcucgauaauauuuuauauugauuacauauauguuaaaauguuacuauuugggacauacugaguuaaguuuauuuaaaauuaauuucaccuuuuucuuuuaauggggcuacuaguauauuuaaaauuacauauguggcuuacauauauauuuauuggacagcacuguucuagaaguuuaggaagaaauaagaaaaauauugagaacagguagcggcaguaggaacuuugcccuccuauaagacugauuccaauaaaaauaauagguuauaguuuuaauuggcuuuuuccuacuagaaaaaauaaguguacuuuacaugccucuuuguucucccuuuuuccccuccaguuuagugguuagaauguauuuauuauagcaggauuaauacagggauucacuaagcagcguuaagaagacuuagguaacugauucccugaugaccauacuugauuuucaaagcacuuuccuaacccguuuuaaauugauauagagucaaaggcagauggcuuauuaguagucaucucauuuaaaucuuauggaauuuuuccaguaaaucucaaauaauuuguuauaggcuauuugggcuauuuggucaagugcauggaagagacagcauaggacaugugguacuucauuuccaaauugcuugagaugauuuucauucuaaccauauauuauuugguucugguuuuccggaaaagccagcuaaaccuuugguucuuuuagauauaaaugaaauaucaucaaagaauagcucaaagugacuuaugcaacuugaauguauauuuuuuccuuaggguguuuaucccaaacuauuugggcauuugcugcaauucgcaguuuuuuuaaaaaaaacaccaaaauaguuauuuuucaaguuagagauguuuuaauuaaaacaucuuguuuuugguguauccauugacauucucaaaacggaauguaucuggaccucuguguacaaucuucguagcacucagacacugaacagaaaggcagucaucacugccaaacagggcccaaaugccacacauggugcaaugugucauuuugagcuggcagcagccaaauaaaacagcccuuuauuucacaguugagaauuugaaauuggaaaguaauuaacguauguaagggugauuuauuugcuuccgggcuuauagggaugagcuaaguuuuuuauuagggauguuguugguguauaugucucaccuacuuugcuuccuuacugaacaaugcaacuuugagacagaaauauuugagaacauuuuugucagugaggacauuuugauagugaauauuuuguaucuucuauuaacuugaaauguuuuauuuguuauaaagccaggauaucugauaucaaauuaaauuguuuuuuuuuucccuuuagauuuucuucaaucacaucugaauaaaucacuugaagguaaccuagauguaauauagugaaaugcuugaaagagcugcguaucuuuuacacuuacagcaguaugauuuucuguuguacccauuauaugguaccugcagcuaguucagauaaagagggcauuuaacugucaagggaaccugagaggagacucuaguaaucuggaaagucuguuggaucuuugagggauuuugggauggugagaguggggcuaggaucucuggcuagguuggagccagccugcauuuguaucuguaucuuggaagcaaacuuagaaugcagagacagauguggcauggacgcugucagcucuagccaaccacuaaauccuaaggugggagagaugcaggcuuuggcuaggugcuaagcugcuguagccgguugaauguagaggucacuaucuuuuccgaauaccuguaaguaaauuaaaucauucucuacucccaugugccugccaaccuaaugggaaaucgcuauagaaaagaugguuuaaauuuuagucuuugaagugguuuaugcacguuuccggaaucaagauuuaaugcagaguuggauuggauauugaauauuuuugauuugucugcuuuucucuccauagaaagcuuauagcuucauugcaccauguguggcauuugggcgcuguuuggcagugaugauugccuuucuguucagugucugagugcuaugaagauugcacacagagguccagaugcauuccguuuugagaaugucaauggauacaccaacugcugcuuuggauuucaccgguuggcgguaguugacccgcuguuuggaaugcagccaauucgagugaagaaauauccguauuuguggcucuguuacaauggugaaaucuacaaccauaagaaggugaggagaaagaaaccagaugucuggaugcgauuaaacuucagaguuuguugguuacgaugauguuacauauucuguaucaugcuuuuuccuuugcaaagcacucuauguucguuaucucauuugcucuaaguauguaaauagggaacugaugaauaaaaaggugagugaaaugacuuggucacaaaaaaagugauaaaaauggggauuacaguucaguuucauugacucuuagaauuuuuucuccuucuccccagcuuuucauuuugaaaaaauuccuaacauacaguaaagaacagaacaacaagcaccuagauuaaauagucauuaauguuuugccauaguugcuugauuuuucuuucuacacacacacacacacacacacacauguuuuugcugaaucauuugagaguacagugcagauauuaugacacuccuaaauauauaagcauuuaucuccuaagaauaaggacauucuucuacauaacaucaaugccauuauuaaaccuaagaguccauaauaccaccuaauauccaguuaauacuuaaaugaaauuucccuaagugucccaagaauauuuuuauuuauuuauuuauuuugagacagagucucauucugucacccaggcuggagugcaguggugcgaucucggcuuacugcaaccucugccucccagguucaagcaauucuccugccucagccucccaaguagcugggacuacaggcaccugccaccaugcccagcuaauuuuuuguauuuuaguaaagacaggguuucaccauguugcccaggguggucuggaacuccugagcucagguaaucugcccaccuugaccucucaaagugcuaccaagaauaucuuuauagcugguucuuguuuguuuugagccagauuucauucaagguucaugcauuugguugguauguuucuugguauuuuuugagacuucuugauagauaccugucaggcauugauagagauuuacauccuaaucacauuuuggacauuuuuaucugugaacaauagcuuuugucauuguuuguugccugcucauaggaagacucuuaauaauagucuucucauuuaaaaaguuuuaaaauaguuauucaggaaauuccuuuuacacauuucuuuauuccuuuauuaagggucuacuaugcaccagacaucauuuuucuaggugauuggagaugaaauggugaaaaggaaaggcaagaauggaauuuccugcuagugggagguagaagaagagaguauuaaaaauuuuuucuaagucaaauaaugucauauacaugagaacgcuaggugguauuauggcauuaucagcuuggcuuuccccuuaaaugaaauaggaagugcccuguuucacuugaacaguguuauuucuuuuauuaaaaaguuacaagaaguuaaauauuuugaaaauaauuaauuucuauucuaaauuagccaaauguuauauuuguaaaaguagagaaguuuguuccauugcuucuaccaagcaucuaaguuuauguaguuggggcagcuagcagucugucuaaugagcagaauguauacuuuaggcuuauauaaaguauucagaaaucccccccacaccuccuuuuugguaaaaauaaaguuuaccacuacaauaaaauacagccagagguguacugggaguagaaggagacugaaugaaagaaaggaggaaugggguaaaggcuggggcaaagagcaggcccucucccugcaggggaguaucagggccugcagccaagucaaaugacagcaugacgucaggaggcaagauuugagggcuuuuauuuaaggugcagcauuggaguuugguuuuaggagaguaggaaguaauacauccguuacccaaaggacccuucuccuuuuuaaauaaguuaccugcaaaguuuaggccaaagagguggguaagguagauuugggaagcuguugcuuacuaauaucaccgaaugcuuuauggucacuaacccuucaggcaguucagcccagaagagucagcagaagacuguuuacaggcccccaccugcuaguuacagaucaucccugauagagcagagaggggugaccagguagugacuuuguagucacuggaggcaaagcccauuuuuggacaguucagugaggacuuauagacaaaagauucacaaauuauggagugaguuggauggagugugaagcauauuuaugggucaugcacauacauaauagguuuacuuuuugaaauuugaaagcauguuuuaagcuuaucuaggauuuccaccugauuuaaaccucuucuuucucuaaugucagccaaaaacccgaguacaaagaagaaagaggaauacaucaaggacuuuucauccucauaguuugccauuaauggcucauaguuugccguugaugguggagagugucagaauuggggaguagccuaaucaaaccuucuuacucugcaugcaguggcagacagucccuuugcuguucuuuuggggaaugcagacuaauaaagcgccaccgucauuuuaucuaucaguaaggaguagcuuuaaugcugcugcagugguggaagcacugggcauugucauccaccccuggggaccagcagcuuuguuuuggaucauguaucuguuauugugauggagccauuuauuuuucagggaaugaugccaaaugauguuugucccuuugcuuuacauuuuuauagcuaggacuuugaagcugaacuggaggaacuucuuagccaauacuaucuucucaaaucaaaaguuuauaguugcaaaagacacguuuuuuagugucauggcaaccaggcaaccuauuaucuuaacuuaaauuuagagguugagcaucccuaaucugaaaaucugaaauuugaaaugcuccaaaaucugaaacuuuuugagcacugacaugacauuacaugugcauuuugaugucacagucaaaaugcagguguaaaacacgcaguuuauuuggcguucccuagggaaaaaagacccucucagcccgcuucagcugcaguauaacuuuucuacacaugcccggauuuccccaugcaagcacgcccacaaaggguaauagaauggcacauguucaagcuggauacgccauuggcaggauccccacagaugggacuuaugugcauuauccauuguguauuuuugcuuauuuucugcucugugguguuaagauacugaaaaugucaaaaagaccuguagauauuucuaugagcagcagugauaaggaaaaguagaaacacuuauaacacagaaagucaagcuguaggagaaacuggacuguaguauaaagguauagaugacauggugaaaaugugugauagagauauugaaggacuagagcuaccugcauucauaacagaacaagaggucaugucaguuuauaaaaucaaagagagccuuccaagacaaaagccauuguuaaugaagcagaugacucuggagaaacauuuaaaagucaucuggccgaaugccucuucaaucucagaggacccgcuuccuaguugcucagcugcuucugauguuucuucucaccugaaaaaggaaaaaaaaauacaguguauaguaaccuuuuaaucaaaacgcagcauuguagguggagucugaaagccugccauuguuuguacagcuguuuaacagcugaugcagguauucuggugauucuacuaugcuacuuauuacuuucuuacuguauuaaugguaugucauauuuuauaagcauaugaaaaugauugcucaucagcagcauaauaaauucagagucaggaaugauggucaaugaugucaaacagccacagauuuuccacaugguagcugagauagugaccccuuugcuuucugaugguuccauguaugcaaacuuuguuucaugcacaaaauuauuugaaauauuauauaaaauuaccuuuagguuuuguguauaagauauaugaaacauaaaugaaguucauguuuagacuugggucucaugcccaagauaucucacauauaugcaaauauuccaaaguccaaaacacaaaacacuucugguuccaaacauuucagauaagggauacucaaucuguauauauauaaauauauguauguauuacauauaugguauguauauaauauacauuuccaucccuccacagguuacuguucuggcacauucccauuauguucuguuuaucagacugcaacuaaaauuuucauggguucggcuuuauguugaacagaauuugcagaauaugaguugaagcgaaccauaguuuaauaaugcugugauucuccuaaaucaccaaagugcaugaaaggauuauagagcucagaaauacugaagcaucuuugcaauaaaaaauuauuagugaauguacaaggagucuaacauuuugguuuugcuuucgcuuccuaagaugcaacagcauuuugaauuugaauaccagaccaaaguggauggugagauaauccuucaucuuuaugacaaaggaggaauugagcaaacaauuuguauguuggaugguguguuugcauuuguuuuacuggauacugccaauaagaaaguguuccuggguagagauacauauggagucagaccuuuguuuaaagcaaugacagaagauggauuuuuggcuguauguucagaagcuaaagguaauaauaaauuuuucuauagauuuucauuauugucuugguuguacguuuucuuuuaaauuauauuugaaaaucucuuagagagcaauccagaauuuuacaagugacuaaguuaugagucuuuaccuuuuuuuaaaaaaacagaggaguuguacucuccuuuucagcacuuaaauucuguaauccuugaaggaugauucuuuagugcagucguuuauuuuuugcugugcuaauaugcucuacaucuagcuugaucuuaagugcaguuuuaaguuuuccugugucauacuauaaucguaggguugacucugcaauuauugcauugugguacuuugcgcaguuauagcacagcaaguguuaggauuucuaaaacagcuuuauugauaauucacauaccauguaauucacccacuugaaguauacaguucagugguuuuuaguauauucacagauguugguaaacaacacuccaaucaguuuuaggauuguuuuuccaccucaaaaaaaaccaaaucaaauccuaugcccuuuaccuuaguuuuugcuggcaggaucaacuagguuuuuguuuguuuguuuguuugaagagauggggucuugcucagucgcccagcccaggcuggagugcggugguuugauagcucagugcagccuugaacucgugggcucaagcgauucucccaccucagccucccuaguagcuaggaguauaggcaugcaccacaacacccugccuccugugcccuuuagcuuugaauuccaucucuccauauccaucagcugcaccccugcaguuguagccccggcaaucaccagucuuucugccucuggauucccuauucuguauguuucauaugaacgggauuauauaucauaccggcuuuugugacuggauucuuucacuugguauagugcuuucaagauuugucuaugccguagcauguaucaguacuuacuucuuauggccaaaugauauuccauuacauggauacacugcauuuuguuuauucgcuugucaguugauggacauuuaggacauuauuuaccccuuuuggcuauuaugaauaaugcugcuauaaacauugguguacaaguuuuuguguggacauuucccuuggguguauaucuaggaguagaauugcugggacacaugauaacuauguucaguugaagaacugccagacuaauuuuugaaauggcugcaucauuuuuuauucacuccagcaguguauuaaaauuucuguuucuccacaucuucacaaacagugugugacuuuaauucuagccauucuaguguaugugaagugguaucucauugugauuuugauuuguauuuuccuguugacagugauguccagcaucuuaucuuaugcuuauuggccauuuguauaucuucuuuggagaaauauuuguucagauccuuugccauuuuuuuuuccuguuagggaucauuuuauuuuaaaaacauaauagacuuuauuuuuuuuuuugagcaguuuuagaaaaaauugagaggaaagugcagagaguucacauaugcucccccuacagugccccugcccaguuuuccccacucuuaacaucuugcauuacugugcuacauuuauuagauuugaugaacugauacuuauauauuaacugaaguucauaguuuacauaaggguucacucuuuguguuuuauagauuuuuggauuugacaaauguuuaaugccauguacccaccauuacaguauuauguagaacaguuucauugcccuaaaaaucuccugugcuccacuuauucuuuccucccguccucuuccuccuaaccccccagucauuacugaucuuuuugcuuucucucucacuuugccuuucccagaaugucguauaauaguuguaaucauauaguauguagcuuuuucagacuggcuucuuucaccuagcaguauacauuuauaguucuucuguguuuuuucauggcuugauagcucauuuauuauuauuauuauuauacuuuaaguucuaggguacaugugcauaacgugcagguuuguuacauauguauacaugugccauguuggugugcuugcugaauaauauuccauuuguuugcaugcaaugcaauuuguuuauccauucuugaauuacccauuucuaauugaguuauuuugucuuuuuauuacugaauuguaauaguuccuuauguauucuagauacaaaucccuucuguucaucaggguugcaggauacaagaugaauauacaaaaaucaaugguauuugacacacuuuaacugaauacuacauacuuaaaaugagcaaucaaaaugaaauuaagaaagcaacuucauuuauaauagcaucaaaaagaauaaaauacuuagaaauaaauuuaagaaguguaaaacuuguacucugaaaacuauaaaauguuguugaaagaaaugagaggagaucuaaauaaauggaaaaguaucccaugaucaugauuugaaggcuuaacauuguuaagauggcaguccucccuaaacugauuuacagauuuaacuugaucccuaucagaaucccagaugaguucuuugugaaaucuacaagcugacucucaaauucauauggaauugcaagagacuaagaauagccaaaacaaucuuuugaaaaugaagaacaaaguaggagaccucauauuaacugauuuuaaaacuuacuacaagacaaugguaauaaggacaauauaauacugacagaaggauagauguauagacuagugggauagaauugagagucagaaaugaacccauacauauaugaucaacuuauuuuugacaagggugccaagauuauucaguggagaaagaaguuugaaaacuggcacaggggcaaccagauauguaaccauaugcaaaacuuggaguugaaucuuuacccaacaucguauacaaaaauuauggauacagaaaaauggaucaggccaggcgcgauggcuuaugccuguaaucccagcacuuugggaggccgaggcggguggaucacgaggucaggagaucgagaccauccuggcuaacacagugaaaccccgucucuacuaaaaauuagccgggcgugguggcgggcgccuguagucccagcuacucaggaggcugaggcaggagaauggcgugaacccgggagacggagcuugcgguaagccgagaucgcgcaacugcacuccagccugagugacagagcgagacucaucucaaaaaaaaaaaaaaaaaggaucaaaugaaucaguuuugaacuaauccacuuaaauguaagggcuaaaacuauaaaaucccgagaagcaaacauagaaguaaauugucaugacccuggauuuggcaaagcuuucuuaaauaugagaccagcaacaauaauaaaaaucaaugaauuggacuucaucaaaauuaaacauuuuugcacaucaaaggacaccaucaagaaagugaaaagacggcccacaaguuggaagaaaauacuugcaaaucaugcauagcacuuuuugaugguaaacuugaggaagacauuuaucuuuuaucccuuaccugugcagcaguaacauccuaauaucucucucccugccucuuuuugccauucuuuaaauucuuucucacuuaauuuucagauuuaauauuggcugaagcagggauaaugagaucaaucaaagggguccuuaggacacuagucacaguguuuguacuaauacuggaacuggcuuauuuucaggcauuucuagugugaucagauggcaaagaacaagcauauauauaugucaguugccaggacugcugggaaagccugguaaagagaacacuggggaaaagcagccuccugcuccccugggccuucuuugagccugaugaucacuugauauggaacuuacccucugaaauuccuuaauuguucuuuucuauauccuugacacuguccuuuuccagaccaaauuaucucaucuggaauacugcaacaauuuucuuuucucagugcuuuuagaauaaccugucaaaaucucaucugauuauaguauugccugcuuaaaaccuuuuaauuacuccccauucccuauccggguuguguagcucacuugagcucugcuggcuggugagggaaucuggguccuuuuucugguauuugaauucagugcuacacagguuacuggcuggguagacaaucucaaauuguaaaucacgaguauuccauguagauaguccauuacgaucuacaauaaaacauugauguuuguaucaaagaucauggugaugagagguuggguacuguacugucugugagaauuuauugaggaaauuuaaguuauaugguuuuauucacauauaguguauaacaacuaguuaagggauagaugucuucuuaucugacuuuaaaguagguaaaaguggaucauuguacuuguuaaaggucugggaaccauggcuguguucugaaaauaccucagugaugacaaauaaaugacucccagccuaucauaacauuaggacuccaguucaucccuuugcuucauaagugugucuuuuccuuuuguguauuugcuuuaguauagaaaauagguuuucuugauuagaaaucuaagaagaagaaauugaacacuggagauuuuucuauuucuuugaauuacgaaaaguuaguguaauuuggcaguauaucccugugccauuauugucucucagguaaguagaugguagggcuuaggaaaauagaaaauuuuuuuuccuauuuugcuuauuuaauggguauguguuuguauuaaaaagggaaaauaggaauguagaugauguuaacuaaucgugaaaguuauugggaaggguuaccuaauuugaauaaagguaucauugugaauuucuaggucuuguuacauugaagcacuccgcgacucccuuuuuaaaaguggagccuuuucuuccuggacacuaugaaguuuuggauuuaaagccaaauggcaaaguugcauccguggaaaugguuaaauaucaucacugucgggauguaccccugcacgcccucuaugacaauguggagaaacucuuuccagguagcagacacccacccaccuauuccccauccuucuccaagggaaaaaaauuuuaaguuguauucucccaucauuugaaugauuuuaguuucaagaccuacuuccuauuuuguuuggagggaacacauuaagauuuggcacacuccaccauugaguaaauaccaucaugauagauguugaugauuguguauuucauuucaauaacuaauccagcccaagauuuucuggagcuguuugauuuacugcuguguuuauagguuuugagauagaaacugugaagaacaaccucaggauccuuuuuaauaaugcuguaaagaaacguuugaugacagacagaaggauuggcugccuuuuaucaggugaagucaauuaaaaaaaccuaauuauauuucauguguguuuaauugaaaugauuuguagccaucccuuugguuuuuacuauaaaauauuuacuguaugauuuacucuuuccuucauuauaggauggaaaugauuuuuuauaagcuguauuuaauagucauagucauacuccaacuugaguuacacuauagcuauguuauugguguuaagagugagucagugaauguucuuuagaauucuguguagugauuuuuaaccaauucaaauacuacuauuaucacaguuuauauauuuuucucuuguugaaguugauuucaguuuauaaaacuuggcggauuuuaaauaguaaaacuaugaucuugguguuuaucaggaauauacaucuucugucccugucuuaugcaaggcacauaacuaggacacuuccacuuccucuuuugcauguagggggcuuggacuccagcuugguugcugccacucuguugaagcagcugaaagaagcccaaguacaguauccucuccagacauuugcaauuggcauggaagacagccccgauuuacuggcugcuagaaagguaaggugcugucucugucccuuguguaguguaguuagaguagacuuguuauuagaaugaaaauggagucaauaaugggugauucuacugcugcuguauugacugggucaauuguuuuaaauugauuguauuaaaauagaaugaaauggcuguuggauaugcacuguguuguacacuguccucuguguacuuuuaucuguuaugacccaugcaauucucacaaagacccuaugaugauaaguaugcucuuuugaaaguaaaggugucugggcaugguggccuacaccuguaaucccagcacuuuacgaggcugagggagguagauuaccugaggucaggaguuugaaaccagccugagcaacauaaugaaacuccaucucuacaaaaaaauacaaaaacuagccaggcuuggugacgcaugccuguagucuuagccuuaugggagccugggugacagagugagaccuugucucaaaaaaaaaagaaaguaaaggcauaagucaggugcaguggcacacaccuauagucccagauacuugggaggcuguggggggaggucugagcucaggaguucaaguccaggcugggcaacguagcaagaccccaucuugaaaaauuaaaaaaacggguuuuuuguucguuuuuuuuuuuuuuuuuuuuuaaacguaaaggcauaguaucauggcuaagacugcagacuuuggaaccugacuugugguuugaaauccuggcucuacucauuuauguaaccaaaauaauagugucugcuauggggaaauuuuaaggugaaaugauauaauucauguaaaguaaguaggguagaacuuagcauguaguaaguacuuaaugaguguuagcuguuauuauuauuuuugaaaguacuguauuuagaauacugugggcagagggcagcuugucuguauucagugagcgggagaccuaguucccacuauggaggacuuucguagcauggaugagaaaaagcuagagagcagucucagugcaagguaaucaaugccgagagaauccaaaauagccaaggaaagcagaaugaggggaagggccauucuauauaagaauaacauccuggauauaaaauuaggcauuuaagaaggaccaaaaaagaccaagcuuagcgugggaccauguuggacuagagagagaugagguggguuagguaaaauagguagagagggaggugccaacugggagaaugguugaagccuuggcaccagaggagcugaggggagacuuacuuccuggugguggaguugaagcaggcgagggaacagugcuggauggggcuuguauguggugggcuguaaagucauuuuucuuuuuuucccuuguuuaguuuucaccauuguuaauucauaaagcuuugugaacucccaucauguuugauuuucaagggaaguuauuuucuuuaacaaguaaauggguauuucuuuauauaauaagguggcagaucauauuggaagugaacauuaugaaguccuuuuuaacucugaggaaggcauucaggcucuggaugaagucauauuuuccuuggaaacuuaugacauuacaacaguucgugcuucaguagguaagguauuaugauauucuuaaauaaaaagcuuuuuuuaauacugaaaaaaauguaagguuuaaaaaaauuauuucaagccauaguuuuaaaauguuauuuaaggaugaaugcaaauuaaaucccuauguuacugauuauuuaagaccacuuaagaauucucugaaucucuuuuggagugaagggaauaguaaauacguaguucaaccuccacauuguuggugucacuguugguguuuccccagggagcagauacauauuuucugcccucuaccucccauuucucuuauaguuucuugggcuacagucuauauacagugaggaaauaggucuuuuugguaaugcauuuuugauaagaaauagucauuuuagauauauuccaucacacaacuuaccagucacuagcuaucauugcucugcaaacaauacuaauuuuaucuuguagauaauguaucuacugagauuggaaguauaccccaaaucagacugauccaguguuauugagccuuuauaugcuacugccucccuugagagacuugccuuggaaggcaaaaauaucuuagguauuacaaugguuuauggcccuccaaaacaucacaguaaauaagcagauagacaggauagcucugguauuggaauuucauggggcuggggugagguuaggaaaauaagugucuaaaaaggcucucuagcugaggugauaauaaaaacaagguugagaagaaacacugguuuagagagauguggugcaggaccaaggaggcaaguuuaauaacuuauauagucuccccagcuuuaugugaaaucugguaaauggggaguggcagggggaaaauacccaucaaaauuaacacuaaaccaccaaaacgguuauucuuauuuuugugucauaauaccacuaugaaaggcaugauuuuuagguauuugagucauuguucagcuuagcaaaguuuugagguggacauucuuggucuaaaaacauuagaauuuuaaaaccuguuuagaaaaugacaaaaugguuccggguuauuuuauuuuacaguaguacuuuuggauuaaguacauauaaauggcuuauaaauacaaggucauuauuguggaaacuacuuuauauuaauaugaaguccaguauaguaguaaagcuuucaauuauuuccaaaaaucaaaucaaaggcauuuuugguggaagguuauguugacauuaaaguuaauuucucucucucauuuaagguauguauuuaauuuccaaguauauucggaagaacacagauagcguggugaucuucucuggagaaggaucagaugaacuuacgcaggguuacauauauuuucacaagguaaccacucugaaguggagggauauucaugcuauauuaagaaaaguaugaauuguuugacuauuuucuaucaucuuucaguaugacagugauauuuuugaguaucuugugagguuacaaaagggaaucugauaguguuugcuuucuaucucuuggggaagaaagaaauuuuaaugugucagauaauuuuuauucuuuaaaacuaguuacagcuggguaugagggcucaugcucauacccccagcugcugaggaggcugaggugggaggaucaccugaacccaggagauugaggcugcagugagcugugauugcaccacugcacuccugccugguugacagaguaagaccccgucucuuaaaaaaaaaaaaaaaaaaguuaaaaauaaauaaauaaaacuacuuaagcuugagaauccccuuucugccauuucuuagcauccuguggaauuaugacuguugcccauuguguucauuuuauucuaauauuagcaguuugguaggaaggaaggcauguuuugugaagcauugcuuaccucuguucaguuauuuacucccuucccuaaauuuguuuaacuuuuugucuuauccaccuuuaggauuggagagggagaaagaaaaacugcuuugugugccaaaagcaaaacucuugguguuuuuguuugugaaauaggcuccuucuccugaaaaagccgaggaggagagugagaggcuucugagggaacucuauuuguuugauguucuccgcgcagaucgaacuacugcugcccauggguaauauuuuuagaggcuauuguaaaacaaaaacaaaaaaacaccaaaaacaaaacaaaacaaaaagcucaauacccugagaaaauaaaaaucaauagcugauuggcuauauguuacauauaguuggcuauauguuacaaagugugacuuuuauagagaaaaugaagcuguuucuuaacuuugucccaaaaggauuaggccacauuucaaagugguguugugguauauggagagaagucuucuuccauagguuguuugagguggaguuuucaccuuuaaaggguaacaacauucugcucacaucugaacaaccaagauggaagaggcaaggcugcuacagcagcuaccguuaaguguuuuaaagagaaguaaagaucguaaacaucaugugacaaguagugagugcccaccaugcccauguggugcuguagugacccugagggaauagaguagugaagauacaagggguuugauuacauuauaaagaaccagguuucuuugguuaucauuucuaguugucuaaaguuauguugaagaacugaagacuuuuacuguacaggauaaacaacugacauuaaaugucuuaguugccucugcugaaucacaccuagauaaggauauaauuaaauauggguuugaggaaugaacugaaucuggucauuauccucucugcuuguccuaacuagagucacuaggcuucaggaaaccggugauuuggaauuugaugaaauauagugggacacugguuuauaucgcauauuguaugugaauuuuuaaucaguggcaaaaaaauacuguaucgucaucacaauuguuagaagagauggucucaccuaguaaacacugaguuaggucuaggcaagguauuuucuuaaugauugggucacucauguuuuguaacuuuuucugcuuuuugaaauaugcauuuaacuauuccuagaagggaaaguaaaaguaauagucucaguuaguuuuacucccuagaugacaugauauauguauuauuuuaaaugaagauuuauuuuuuguaucuauucauuaguguagggcagucauuaggaggcuuguaugugacuguaugaccuuaacauuucuuaagaucugguugaauugaugggaaacugaaucagaaccuaaccuggcaggcacuaaauacccauuuuaauuuagauuuucuucuuuucuccuuuaagucuugaacugagagucccauuucuagaucaucgauuuucuuccuauuacuugucucugccaccagaaaugagaauuccaaagguagguaaaucaacucaagguaaaacuguccauugccaucagauuauauuuguaauuuuuaccugaugcuccuuuuuuugucacgucagaaugggauagaaaaacaucuccugagagagacguuugaggauuccaaucugauacccaaagagauucucuggcgaccaaaagaagccuucagugauggaauaacuucaguuaagaauuccugguuuaagauuuuacaggaauacguugaacaucagguauaaugucuuuaaaaacauuuucaggaauaagacaguuuggaugcagagcugucauugcuguucauuuuguauuuaguuugaaugauacauguauuuaguuugaaugauacauguauuuaguuugaaugauacauacaucagauaucucucugauaggaugucccuaucagagagauucagagucucuguaaacaauuaucucuuuuguaagaauuacguaagaauuaaguagcaugaaggauuauaaaguagcaucuagaaucgagagagagaggagacuuacuacuaaucaucacugauuuucauuuaucagauuuuugggcaccugcugggugccagaucuuguuaggcacaaaugacuaaaacagagccaccaaguauuaaaaauaugcauaugaguguucuuuaaaaggcacugcagcuauccauauuaugaauacuuuagcauuuucuaagugaugggugauucaaagggucucauacaaguuacagucacgucuuaacauuuucuguuucgugaaaugagacuaaacacaaguauuuccugccauuuuaagccauuuugcucuuauaugcuuauucuuacagguugaugaugcaaugauggcaaaugcagcccagaaauuucccuucaauacuccuaaaaccaaagaaggauauuacuaccgucaagucuuugaacgccauuacccaggccgggcugacuggcugagccauuacuggaugcccaaguggaucaaugccacugacccuucugcccgcacgcugacccacuacaagucagcugucaaagcuuagguggucuuuaugcuguaaugugaaagcaaauauuucuucguguuggauggggacuguggguagauaggggaacaaugagagucaacucaggcuaacuugggugugaaaaaaauaaaaguccuaaaucuaaaccauug

SEQ ID NO: 14541 - RNA, 26069 nt, Homo sapiens
gugucccuccgggagcgcucugcgcaggcgcggacgcagguuacagcagcgcuuggccucugcugaugccgucguuauccuaccccucccccgucccagcucuacggcggccgcgcgcuccaggccggucgcuccaccccccggcucccgggacuguggacuccacgacccuguccucggcccuguccgcgccgaagcagcccgggacugcgcagcgccccgcgugccggugagcgaccccggacgugcaguccccagguccccuuccggagcgaggcugagcggcugcgccgcggcuugagccgggccugacaaggaggggaggccgcuggggugcugggccagccgcagguacggcggcggucagggcuggugaucgaguugcugugucgccucuaaugaggcccagccagggaacacucggcuucggcccaagcccuaccucuggguugccucuaggcccucacaccuugagcgccagguggcccucuuccuuuugcuguugaugaauguucuugccguggugccgggaucuuauuuugcagcuuuacagaguaggcuuugugcuagguguuguuuauggagcuuuucaaaggcgcuuguuuccuuaguucucaagcccuuuuagaacuaaaaccagugucuacacagaagaucaggagccauuuaaauuggagugcugugauauauuuuuucucuccaaacugagucugauauccauguugacuuucaguaaacuaaggaaccgcuauaauaaauaacacugagcccacagagguugcagaagagggucuagcaccccuuuuuuaaaccauugagucucccaagaauaaaagugguuacacuugucaguucucuaaggaaaaucuaguagagaaggcaagggauucccaguuucucacagagucuggcacuuguccaaacaccuacccuaaagcagaaucgaucauggcagcuauuagauuaggacagaaaacaggcucaaacggagagccacuugagucugccuuucugugucuuuuuucucaacgcgcuccaguuaagaugcagcuuacagccuggcuguguugacugagaucccagaaagagugcccuuaaggccuugcugauaaggcccaaugaucccaauucaucuaguguuccgcauagaccccaagguuacaguguguggggacagugauguuaagucuucccuauccuaccuguggcugacagguguugauuaagacaaugauuuuuuagaagucauaaaucauuuguauuuuugaugugggcagugauuuuuauaaauacauaguuuuuuuuuuuugaaagagugaaaaucucauuuuacauuuguuugcauaccauuuguauaguuuuuuaaauucuguuuauuugagugacagcaacaaguggauggcaugcgaauuuuauuuauuuuuuuaucuuuguauuuauuuuguguauauucauggaguacaagugccauuugcuacauugauacacaacauccuggugaagucagagcccuuagugcauccagcacuggagcaacacacauuguacccaccaagcaggcuccuaucaggcaugccaguucuagaaaguaaaauuuucuucauacucuaggaugaacugacuuacuuggaaugucuguuuuguuuaaucaaauaagugagaauuuuugaaagaaauacuaucugucugaauguauguaaucuauuuuuaggaaccgcuaaaagacauaucaaauuuagaaggaguauaauuauguuauuuuucaguuuuacuuuuucacuuuauuuuuucucaggauauaagcaggaaaauaccagcaggguguauuauaugacuguuaaguucuuuucagcuuuaaaaggguaugaccuuaaguauaaaguuacuucauuaucuaccugcagaaguuauuuuuguguaggcacuaguacuaauuauuuauuucuacuuagauuuuuacauuuguauuguuauuuugauacucuuauccuaaaauuuuugaaguuaguguucuaaauuuugcugcuuuguauugguaacuuauauuuaauauuuuggaacauuggcuucauaauuuuaacugucaacuguugaaugaaaaaaaaacugugauuuuggaauuuuggggcuuuuuauuguuguugcgaguguuuaaauguuuaaagcaagaaauuuaaggauggaaaagaguggugauuguauuuaucacaaaggugcgugaauuuucagaggcugaaacguacuacuuugaaguuacuuggugauauacaucaaauaccuaguuaucgucuacccaaagcaauuuuugccuuuagugcuaacuaguuaaaagguagaauguauuuuuauuuuauuuuaagaaaaaugaaaccugcauguuucuuuucagagaaccugcagguguagacuuuugucaaauguuaauguuugaaagcccauucucaucauaagcaugauaggacaucauuucacauuauuuguuuaaaaaaacacuucuggacucuaguaaauggcuccuuuguuucagacauuauuuugauuggauauaauccuaauccaaaagguauaauccaaaagguaguuugaacauucucuuaauguuuguucuguaaaccaaaaauaaaauucugagccccccaacuaaguggaacccgcuucucugucaagggcauuccaaaguaaaccuaaaaagguaguucaggccaugaugaaaagguggguggaggggauugaacaugccccguuguaccuuccucucuuuggaauucaggcacaacugaccagcaucaauuaaaacagagauuugaagacuaacaagagucucuuuguagcaauaagauaucaaaucccaaccugacucuaauauagaaucacucgacagauagcaggcccugagagaaauugaaauaucuuaccccaaaauauauuucuuugaaauggccuugcaaagcugucucucguggggaagauccacauucuguacagaauccccuuuccuuuccagaucuuuuccuaauucagcagcgauuuaaccaagagccuggaauauuuuaaggaguaauaagagacauuuacaaacuauucucucugaagccugcuaccuggaggcaucaucuagauaaucagaaccuuggcuuccacauccuccucccuugucuuaacuacaaacauuucuuucugcugacuucaacuccucagguagaguuuaaccguuucaaccaauugccauuaggaaaucuuuaaauccaccuaugcaccuaugaccuggacaccccccagccuuccaccccugcuucaaaauguccugcuuuucugggcugaauuaauguauaccuuacaucuauugauuuaugccucugccuguaauuucugucuccaaaauguauaaucaagcuguaacccaacuaccuugaggacauuuucucaggaccuguugagacugugccucaggccuuguucacucauuuuuggcuccgaauaaaucccuucaaauauuuuacagaguuugacuguuccuugacuguucuaaauuaauuaguguaaauaucucagaguguucuugaauguacuuuuuucccugaaguuuacuguaagauuuuuauuuuucuuuagacaugggaaagucucuuucucauuugccuuugcauucaagcaaagaagaugcuuaugauggagucacaucugaaaacaugaggaauggacugguuaauagugaaguccauaaugaagauggaagaaauggagaugucucucaguuuccauauguggaauuuacaggaagagauagugucaccugcccuacuugucagggaacaggaagaauuccuagggguauguguuauuguauuguuuucccuuuaaaugauuuuagguauuugcucaaguauuauaaaaacugugggucucaggaaccaccuguuuuagaggacucuuagaauuaaaguugaaacaucauaucaguuaccuucagucaaaaagaugcaaaagaaacaaauaaaguauuaauuaagguuccuaaagcaguaaagaaaaccaccucacuaccuccaguauuuuuucauucccaccugcuauuauagcagauauucacugucuuguaaaugaaaacuuuuaguccuauuuggcaucuguagagaugacaucauaguuacuugcuacuuugcuauaucagauguuagaagcaauuuaaguaauuuguugaccuauuuuuuuuuuuuuuuuaagagaugagaucucgcaauuguuggccaggcuggucuugaacuccuguccucaagcaauccucccaccucggcuucccagagugcuaggauuauagcaguaagccaccaugcccagccagaguuaauguguaaggaagcuuauucuuucauguuauuuuuaaaauuuuauuuuuuuaauaauaaggauggaguuuccccauguuucccaggaugaugucgaauucuugggcucaagcgaucauccagccuuggccucccaaaguguuagaauuacagcugugagccaccacgccuggccaaccuaauauuuuuaauucauuaucuaaagaagaagaauaagcuggcugugcccuaaugaguuaaagaaacucugugaagagggaugguacgugaaaaugagccaaauugaaaaaaaaaaauuguuugugauauaucauaggggacgucagaaggaaauaauccccugugugcugcuuguaagcuacuuuaggaacaguggcaauaaguagaaauaauaaagauacuuuaugcuguucucauuaucuucuuggugaaaguugaugugugacccuggagauacccagagggaagaaggucaaaguauaaaguauacuuuguguaccuuuuuaagaugcuuaaaauguaucuuaaaaugcuguggguuugaauugaaguuuacauuugcguuggccuuugaguaugaugguuuuauuuucacaaggauaguagcuauuuaagaauaaaauaauuauuguaguugaagggauuaaugcaccaggcucaggggguaggggaguacuguuuuagcagucugguuacauuuuugagguaugaccaguaaacuuuuuuggccgccuggauacagauuauggaaaguaggaaaucaaggaugacuccagaguuuuuuuggggggguuuguuugagcaacugaaagaauguaguagcaauuuauuaaaauugaaaaaaaaaagauuauuugaguguauaugucacaggagaguucaggagcucaaguuuagacauggauauuuggagaugccuauuugacguggaaguggauauguucauuaggcaguuaguuaucauaagggucaggaauucaauugcagcgcccagccucaaguuaccaauguauagaugacacuuaaagcucagcuggaugacagcagcaagcuagucagugcagauggcaaaaaugagacccuagcgaauccugagacacuguagcauaucaaggucagugaaagaauuaacaaaggacccugagaaagaaaaguuagaaugagaggaggaaaucauugugugugguaucauggaagauaagugaagaaaguguaccaaggaggaaagagugaccaacugucauaugcuacugauagauuggguagugugaagacugagaacuggccauuggauuugguuauauggaggccacagaagaguuuaaaagagcgguuuugguaaagacguguagcauguauagagugggcucaagagugcauaggagauguuacauagagagaaaauagauuuucugagggguuuggcuccauagcagagagaagagagguagucauuagaaggggcugugaggucaggagagggauuuuuuuuuuucuuuguaagauagagugaauaauagacaguuguauacugaugagaauuaucuguagagaaaacauugguaauucgggagauaagagaauuauuggagcaauguucuugaauagacagaagggcagaucuacugcacaagaacaaagagcugcucuuuuuuucuauaaaagguaaguuauaagcacaggugguuuauucuugguaauaaaagagaagguaaaguauggacacagaagcagguagguggauagaucugauaauagaagcuuguagaaauuaucuuccauuuaucacauaaugaacuaagaaugaggauagcgaagaagauauuaaagauuugaagagaguugaaguuauaaaauuguggucuuggagagucagcuugagaguaugaacuugggaaauguaguaugauuguugacaucauuaagugcuacuugacaugagugaucaaaaaugaaaccagugaguguaguuguguguuuuucuguguccauguuuagcucuguugauauaugcauaggagccagaggguugguuuuaaccaggguuguaguuuuagccagaugaauaccacuaaacaaggugagauauguaaacacacaaagauacagauauccauguuauauguauuuguauaauuauauaugggugugaugggggagcacagaugagaggaagaguauagaugugucgggggaaauaacagaagcauuuuagaaagcuuuuaaagagaacuugacuaucugauaccuuaauaguuaauaugauaagccaacuucuaauaagauuauaaaauuggcauuuaaagguccauuuauccuuuaaacuuauggauauagcucaacccaagaaagaaaucacggauuuugaagugacuuuaacauggauuggggugagaccugaaagggcccuggaaggcucauuauguagggggcucuuaaagcuugagacuucuacuucagaggccgguuuugguuuucaagggggacaaugucagaagcucugcagugauagagaugauagagguuucaggaaagggcgauaccaauauguuucuucuuuuaucauccagacaaccaaaucagagucuuaauggacaccagugaagcugaaggaaggccugguaaauuuagcucuucugaaagcuaggacuuagauuuuuuuuaguggaagaaaaaguaagcccucauuuguuauacuuuuuuuuuuuuuuuuuuagcuagacauuuacgugugaaaaaacacgcugucuucucuagaacuucugcuggauacuuucugaagacuuagcaauuuacuaaaggaaagagaugagugccagaugauauucuggucuuuccaaaccagauugugauggggagccauuauauuuuuaacuaaucauaguaauuucugaacuuacuucuuucacauuuagggcaagaaaaccaacugguggcauugauuccauauagugaucagagauuaaggccaagaagaacguaagugauucuaagaauauggcaguguuuuauguuuuauuuuuguuuuuuguauuuuuucaaauuauguauaauaacuaguuaaaacuauuaaaagaaaaaaugcugucacguaguuaaauuaugucaucauaugcuuuguauccuuaaacagacaagaaaggauuuucugguugggguaaggucuugaaagcaguaugguaucuuuaucuucucaaaucuauggaaauagaucuagaauagcaguacaaacacacacacacauaaaauuuucauuaaaaauuggauaauaagguguacuccacaaccccaggauaaaaauugguauuuaaacauggugacagcagggaccccaacggccuuagcagcuguguggagguugugaaggaaagcaaaaagaguuacuaaggaucauaugagcccugauacacaaagcaaauacuuugucccaaaagaagaggacacccagcaaauauuuccaagaauaaucuguaaaaaugacaagauuugcaugcucuagcuuggagaaagugcaaaaagaccacaagagaccugcuaaguaucuucgagaucagaaggaacuggaccauccuaaauccucagagacguuaggaaauguggaagcaaaaauuauugcaaaaggauacaaauacauauccucaagaaaaaaguugaguagaauccaauguuuacaggacaggaguuaggaaggaaggagagaacagauugacauauuagggagaucaucucaaaacuguggagauaaauauacauggaggccauauuuucaaauacuuuguauaucaacagaggauggagcccuugaacagugaagcuagcaaagcaacgcuggcauauuccaucaccgcaaaugaaaccuuuucuugaaaguacaaaagcucuuuucauuuaaacaugagcaccuggaaaggauugcaacaaagcauuauacaaauauacuuuuuaagaaguugaagaaaguaagcuaagcaaaauacugacacuuuaauaaaggcaugugaaaagagcagaugaacacuuuaacuuaauacuauaaaagcuauaacaggacagcauaaggcagaaauugagaagcucagaaaugagauaacuaaacaaugggaguaugugcaaagagaauuuacagaccucuggaaagaauuagaagaaaaacauuuccacaaaacuggaagaacacaaguacaaauacauuggaaauacagucagggaaauagaacauaaacgggaggaaugaaaacaucaacaacaaauuguguaaaggauuugagagaaaaugucuaaaagucacauaaagaaaacuaaacauguauguaauuggagcaucugaagaagaaaaccaaaggaauagaacuggacaaaugcaaaacauuaaaucaagaacacagggaccugcauauugaaaagacaccacaauccugaaaaaaaucaacccagguuagugaaauucuugaacuuuaagaaaacaacaaaacuccuaaauaccuaggcaaaaggaucaauuaauuuauaaauguuagaaaaucagauugacaugcugcuucuugacuacagugccucaaacggauaagcaauggugugacauauuuaaaucaggaaaauaaaacaaaccaaggauuuuauaaacagucugaccuuuuauuacaaaauguauagacagauaugaauaugaaggaaauuaggauuaaucccuuuauaaccuaaaagugggagaacuuuuuaaacuaugauuuugaaugcagaaaagauaaauuugacagaugaacuuuuacaggaugaagacaaaaccuuaacugaagucaaaauacaaauagcaaacuaaguaguaaaguuuacaaaucauaucacagacagagggccaauauccuuacucuauaaagagcuucagaauuugagaagaaaaaggccaaccuccaaagcaaaauagaagcuaugaacagcuaguucacaaaaaagaaaugcaaaugaccuuuaaacauuugaaaagauguccaaucuugcucauaauagaaaugcaaauuaaagcuacacuuagaugccauuucuaucacaguggcaaaaauccaaaauguugacaacauacuuuguuggcaguagugacugaaaacaaguauauucauuccuugcuagugaaugaaaauuuggcauuauuugccaaauuacaucugcauuuacuuuuuggcucagaaauccuacuuugaaaaauuuauucucaggauaguugucaaauauaguaaaugguauuugcgcaaauuauuuauugugccaauguuugcagaagcaaacaacuggaaacaauguaaauaccaauaauagaggacugauggaauaagauacuauguguacacaaugguaaaauggaaggagaacuauauuuuaccacagugugauauugacaauauguuuuucuuugaaaacaccacacacucaaacccacacauauacacacaaagagacaaacaaugggaugauaaaccaaaucuaauacaauugguucaccucugaguuugggaaggaauuuggaagagggaguggauaagcaaguaaagugugugugugugugugugugugucuguaucuguguacauuuuuuuuacauaacuuaaaagaugaaaucaaaaguaacugccaaaaauugagacaaaaggaaacauuauucuaacuguauaugaaguuggugacacuaacaaaacugaaauaauuauuuuaagugacuugaaaacauugugcugugacuauaaaugucgggaguuguguuccaaauggcaaagagaaucacaacaaauuuuaaacuguacuuaauaguugcauuauuaggaguaccuuugauguaguuuggaaauuuuauacuuaaauaaguuauuauguaaaugccuuagggagcaagaguuuuagcaauaagaccaaagagauacaaaaucaaagaaauugaauuuuccacuuuugacccaaauagaauaaugccugaaauaccccaccugaaaucacuguaaaacuggacaaauauaguaaacaauauuuucagacauuggacaucagccagcacagggcagugauuccugagaaagcaaaaacaaaggagauaagcccuaugauugcaccagcaagcccugugauuguaccagcuuacugucugagaaagguuccagccugcagcacaaggaaggaaccaacccaggcagagcucaguggucuuccucaauggagauggaacuggguguccagaaagccaaaaugacuagaguuagcagggcagaguaccagaagguagagagcuggagagggugcucuuaagccugcagcuguguccugaucaacauauaugugugaggaacauaccugaggcugaggaaagaccacccaauaggagcagagagaauaguccucagagcucacacaaggccaagaacaguuguuguuucucaauuuguaauaaaauuauaauauuuugggaacaacuuugggucuuuauuucuuuacaaauugagugauuuguaagauuauuagaaaauuauauuuaucaauugcuuuugucuguauacuuuagcuaugucauuuaauccucaaacauggauuuuaaagaggaagaaaaguaaauugcauuaaauacugcagguaggaaauggcaaaaauggaauucuaacuugauugcagauauaccacacaacuuucauaacuucauuagcaccuuauaacucccaggauuugguugcuaucacuagagccauaagaaaaaucauuacuaguuaauuuuguaauggagacauauauuuugucaguaaacuagccaacuuuucaauuuggaaugaaauacuagauggaauguuguuuuauugucccaccagguucaguaauguucguuauggcuacaaacgugguauacagaguaauuuagaacaugauucauuuauucacaacuaggacugacuuauaagcccuaaggacuagauuaugauggauucacccgcccauaaguaauuaaaaauaaaacgcugaaguguagaaaauccaacaaaguucagauuuuauuaugaugauguuaaacacuucuuaugccuuuuuauguauuuugguguguuauagauacuauaaacguguuuaaauuuccuauuagguaauccaguggggaucacuaccccuacucagguugagagaguccaaaaugagugagugggaacuguuuugauugcucaagacaacagcauggacuuaguagcagugacuuagcaaauuuguguuugcuuguauuauuuuguuuuuuaauaaaccaguuugcucuguucuuaacuugggcaacuuaaaacacuaagaaauauuuauaaaauaucugcaggaggcacuuuaauugcucuuguaauacauacaaagauuaaauccaucagagcauuuagaaaggaaaugguggcggagaguggaagaaacaauaaaauggaaaauuuuuguauaaguagauuguaaggaaaauaaguaauugucaugcaagacucaaaaacaaaaaaaggauguugugggcauccaauagaggacuuguauguuagagagaacaggaaauaguuauuugaacucugguuuugagguuaaccuugaaaagaggaaguuuuuaccuacaaauuuuuccuugucuuauaccugcaugaaauaucuuuucuugauuagaaaaagaaauguaacaacaccuucaaagcagaguugaucaauguaaaaaaaaucuuaaaaacugaguauguaaguacuuugagaugagaauacucaaaaaaagacuaauuauaguaagaaucauugaugagccaugugguugugucauuuuuuuuuaauuuuaaaaauauggaggaugugcagguuuguuacauagguaaaugugugccauggugguuuauuguacccaucaacccauccccuagguauuaagcucagcaugauuagcuauuuuuccuaaugcucucccuuccccaucauuauuauuucuaagaugguucugaugagcagucacuuuaggggaucauguaauggcaaaacuuaacaugugaaaauucugcuucagugaauucagagggaguuuugaaaugugcguuuguaugaagcuccucagcuugaaucuaaugugaaaacugcucuggcagucaaaaaaguaaauguucuauuguuuuuaagcccaaaauuucaguguccaaaaaugugauuccuuuuuuuuuuuuuuuugguacagagucucgcucucucguccaggcaggagugcgguggugcgaucucaguucacuccaaccucugccucccggguucaaacuauucuccugccucagccuccugaguagcugggauuacaggcgcacaccaccacaccuggcuaauuuuuguguuuuuaguagagaugguuuuucacuguguuggucaggcuggucucgaacuccugaccucuugauacgcccgccucagccucucaaagugcugggauuacaggcgugagccaccgcaucccgccgauuucaucuuuuaaagagaacaucuuaacacuuaauagacucagacucaaccauacccaauacuuucagaugugaaaauuugguaacauuuagcaucuuauauauguugcugcugauauaugggggaaauugaacauaccuucucuaauguuguguuauauaauuucugaugcacauguacuuaaauacccucuuuuccuuuucagaaagcuguaugugauggcuucuguguuugucugucuacuccuuucuggauuggcuguguuuuuccuuuucccucgcucuaucgacgugaaauacauugguguaaaaucagccuaugucaguuaugauguucagaagcguacaauuuauuuaaauaucacagugaguauaaauuuauaugaaaaauguuuaacuucauucuuuuauccuauuaagcagcaccuuuguccccauugagaagagauguuuguuaaaugugacacuggucagugugcuuucuguaugucuuuucuguauugacguucucuaccauuucugguucugcuaaaaauagcaauaauaaauacuggcaauucuguauauacagaaugauuuagcauuugaaaaugucuuuaggaggguaaaauaaacuaaaaaaagaaaaaagguauuacaauuuacuuuucagcauaugacucugaauaacuucuagcaaaguguugacauaguugauuugauagauuuuauaaauguaacauuuugauuucauuguauuugggaaauacaguuuuugccacguuuaauagaccauuccuuuaucagcuuuaaagaugaaauacaggugacugguuucucuuuuguaaauuagcauaugugaaaaugccguguuuuuuuuuuuuuaauuauuaaguucuaggguacaugugcacagcaugcagguuuguuacauauguauacaggugccauguuggugugcugcacccauuaacucaucauuuacuuuagguauuucuccuaaugcuaucccucccccaucccuccaccucacgacaggccucggugugugauguuccccucccuguauccaaguauucucauuguucaauucccaccuaugagugagaacacgugguguuugguuuucuguccuugugauaguuugcuuagaaugaugguuuccagcuucauccacgucccuacaaaggacaugaacucauccuuuuuuauggcuguauaguauuccaugguguauaugugccacguuuucuuaauccagucuauaauugauggacauuucgguuguuuccaagucuuuacuauugugaauagugcugcaauaaacauaacguguuaaugugucuuuauagcagcaugauuuauaauccuuuggguauauacccaguaaugggauugcugggucaaaugguauuucuaguucuagauccuugaagaaucaccacacugucuuccacaaugguugaacuaguuuacagucccuccaacaguguaaaaguguuccuauuucuccacauccucucuaccaucuguuguuuccugaacuuuuuaauaaucgccauucuaauuggugugagaugauaucucauugugguuuugauuugcauuuuucugauggccagugaugaugagcauuuuuucaugugucuguuggcugcauaaaugucuucuuuugagaaguguccguucauauccuucgcccacuuuuugaugggguuguuugauuuuuuuaaguucuuuguagauccuggauauuagccauuugucagauggguagauagcaaaaauuuucucccauucuuuagguugccuguucccucugaugauaguuucuuuugcuaugcagaagcuuuuuacuuuaauuagaucacauuugucaauuuuggcuuuuguugccauugcuuuugguguuuuagucaugaaguccuugcccaugccuacauccugaaugguauugccuagguuuucuucuaggguuuuuaugguuuuagguuuuuuaaauauuaggucuaacauuuaagucuuuacuccaucuugaguuaauuuuuguacaagguguaaggaagggauccaguuucagcuuucuacuuaugacaagccaguuuucccaggaccauuuauuaaauagggaauccuuuccccauucuuguuuuugucagguuugucaaagaucagaugguuguagaugugugguauuauuucugagggcuguguucuguuccauuggucuguaucucuguuuugguaccaguaccaugcuguuuugguuacuguagccuuguaguauaguuugaagugaugccuccagcuuuguucuuuuugcaaacaauguguguuucuuaggacauuguuuuugaaaggaccguguagccuugccacucaugaaaacaaaacaaacaaaaaccuuagagagguuuucuaccuguuuuacauguuaacguuuguuugaaaagagcacgguuugcuaacuauugaauuaggaaaagggauaauauuuauuggccagccaugagauauaugugagugacagugaucugccaggaagagugauaguuguuuuuucuugcagagguuaauggugugguuaagguugagguagagaugucugugguggugguuggaaagagggagguuugucaggacagugagugaaauggaaugguauguuaaaguggaaucacuacuuaauuacagagaaaaaauggaucccguggauccauuuauucuuauugcuuucugucaaaaguugccgguuuaagggcuuuuucuuuaaaaacaacaauauaggaaaauauacguauaugugaauaaaacguuuguaacacaaugcuaauuguaaauuguuuuaugcaacuggggaauuguuggguauuuucucacuuagcccuuuggaacaaggaacauauuuucuuuuuuauacacuguuuaaaacauuggccagacuuuuuuuggccuaccuccaaagacuuuuuucaugucaaauaacauaaauauguacuaauaaauaauaaaaaacccugugauguuuucuuuuaaguaccagcaaguauauuuaaaugugaauaucauacucuauuuuaaguaauuaugcagaaauucucacauuuuggaauacugccacuuaaacugagacagacugaacauuaaaugaaaaauaagauuauuuggaugaacauuaacuagaugacaaugagauaagaggcugaauuuucuguacauuaucuauaaguauguugaaaauggaacugcuuugcuuucuuaaaaugauuaguauauauuaguaguacuacuuuuuaguaacauuugucuuucuacuuaugaaaauauuugucauuauaagacauuugagaacuauaauguauaaagauuuuuacuucugcuaccuaggucgaacuauuaccauauacauauauuuacgaacaaugcauauacauuuacaaauguaaucauucucauguguaaaggauacacacauucauucacauauauacaaaugcacauuucaacugaggucacaguacauuuucccauguuaaauggucuuguguagucuuuuacaugaucauauuauaauuaauucaaccauuuucuuaaugaauguuuaauuuuacuauuacaaauauuaggaaaacaucuuugugcuuaaacuuuguuuccauuucagguuauuucuuuaggauaaauuccugaaaguacauuugccaauuaaagaucauagguaguuuagggucuuuguuaacaauuauggugaucucuuuucaucuuuuaaauuaaauggauucucacuacucugagcaacaaaugucuaaccuuuauuacuaaauuuuuauuuauucugucuuauuuuuucuuugucuuaauucucauaaggauuuguauucucaaccuguauuacaucauugaucccuuaaauauucuaaugaaacuguggacaguacagaaaaagacauguaccagcauaauuuugcauauacaaagacuuccaagauucuucuaaauuucaauccuuggucuuaucagaagauccauugaccucaaauuaacuaucucuuuccuaucaugucuagaaaugaaauugacaugaacauuaagagccaaauagauaaaauguuuauauauuuaaagauuauuuuuacuguguuugagaacauuuuugaaauuucuuuacauuugugacuauaccaauguaaaugacuccauaaauguaaucauauaauugcugacucuagcauauucuuucauccuuuuuuuuacuaaaacuauuuucucuccuucaacucaucccauauugcaucuuuucauaucuuucuacauauuccuauuaacauuuauguauacucacauauucagcuuuauaaaaaucaguauuuuuaaaaaauauuauuuaguacuuauuuaugugcaucuugguuuucacauuuguuaauaccuuguaaaaaucuuuccuaauuaucugacuuaauugauucuuuuugauggcuucauaauauuccauauaaggacuuaauauaauuuauucuuucuuuuuaugaauagaauucauuuuauugucaggauuuuuuuucccauuccaaauaacacugucauuagcauccuaauguuuuuauuucuguggaaucggugcucagaaguaggauugcccgaucaaagucuauacauaauucuaauuuuaauguauauaacuaaauuacugaugaaauggcuguaacacuucacauauuugcuagcaguaugaaaauauacccuuuucccauaucugugccaggaauagaauuuggugcuuucuauaaauuguacuaguuugaggaauuuaaagcaauauuccauuuuuacuuaaauaaacguuuuccuaacuauaaaugaauuugagcauuguaaaauauuuuuggccauuuagcuuuguaccuuuuugauuuguuuauguauguccuuuguucuuuuuucauuuccuguuagaguuuugucuuuuucuuuucaauuuguaagggcucuuugcauguuauagauuauaaccgaugcuuacaaauauuucuuuuauuuaucauuuagugucuauggauuuuguuuauguuaccuuuugguaugacuguuacagaucuuuuauauaucuguuauuuuuuauuuaacauuuuuaaauuuuuuaaugacuguuuucuacaguaauuugagacaacaguuguaaauuagaaauguagaaggugaucccagcuauuaguuguuacuuaagcaugugaaugaugcaaccacauuucuccccaaccaaccagacuugaaucuagcccauuucuucuucauagugagcuguuguaaaucucuacuaguguacaaguugaaauagcaauuucuuuuaaacaaaaaagauuauuuuagguacuguugaacauuuuaaauggucaucuuuguauuuaauagaauaggaaacagcuuacuaauguccauauucugaagcuauacauuuuguuuuuuuuaaauacugaauuauguuuuuauucuuggcauauuacauacauaguacucgugcauaaaaccaaauaauugguuuaauuuucuuugacauuuugguauuacuuucuuuuucuuaauaaaugaagcauagcuacagcugaaguuacuuuaauuuuaaauacauauuuguauauuuuuagcuaacuuguaaauuuucuguguccuuuuuuuguagaacacacuaaauauaacaaacaauaacuauuacucugucgaaguugaaaacaucacugcccaaguucaauuuucaaaaacaguuauuggaaaggcacgcuuaaacaacauaaccauuauugguccacuugauaugaaacaaguaagaaucaaucaugaaauacuuuguaagaguuaaaugaaugucagcuuuguauaucauauaacuugaaggaggugggggauuuccucaaaaacuugauuuagaaaugugucucugcuggguacaguggcucaugccugugauccccgcaccuugggaggcugagcucaguggacugcuugagcccaggaauucgagaccagccugggcaacauggugaaaccucaucucuacaaaaaaauacaaaaaugugcugagugugguagugugcaccucucuucccaccuacuggggaggcugaggugggaggaucacuggagcccaguaggucgaggcucgcgagccgugaucacaccgccguacuccaaacugggugacacagugagauccugucucaaaaaagaaaaaaaagaaaaagaaaugugucuuauacacauacaagaugaaaucuuugagaaucaagcuuguaaaaggagaaaaauuucuaauuauuugaaguuaugaaguauaucugaaauguuugauguuuugaucuuguucucuaucgaauuucuccuuuugccuuucagauugauuacacaguaccuaccguuauagcagaggaaaugaguuauauguaguaaguucugauuuauaauaacuuuuuauugucaaauaaugaaguguauaaaauaaaguauaaagaguauacauauuuuuuaauuuccguuaucagucaaaaagaguacauuauguaguauucuggcuucugguccucucuguuccucuuuuucaacauauauaauauucauguauauauacacauaaaauuuguuuuuuuauuuauuuuucagaauuaggguuauaccaugucacuuuauuuuucauuacuauguuacuguguuaaacuuguuacuauguuaaaauaauuauaaauuuucaucaucuuuugaauaagcguagauacagacuuuuaggguaaauaacaaccuaguuaucaaaauuucagaagaugagcaaaauauauaaguaauuuauagccugcauuuaaacaacccugcaacugcaguggcaugaauacauacauguuuuucgaguaagaagucaugaauauaucagucauuguuugaaguauagaaaauucucaaccaacaaaugcuuauuauauuucuuagcaucucuguuagcuuuaagauaggagggagaauuuuuaauuuauaauguaguaacuugcauuuguucacauuuuaauuucuuuaacagugauuucuguacucugauauccaucaaagugcauaacauaguacucaugaugcaguaaguacaaaucuuuuuugaaagagauuuugcuuguuaacauuuuggauuuauaacauuggcuuauaauauacacaacaucuuuauaaaugccaccucaguuggguuuuaagccuuacaagagugcuaugaguaaauaucacccacuuuaaaaauuacgaaaugguuguucagagaaguagugaaagacuacgugacugcuaaguagugaaucuggaugucacaagaguucaggaaaauggaaaggauacagggaacugagccccacauccaauuccuuacucccuugacaaauagucauuaacaguaauaagaauauuauugguuuguaaauuggguguuaucuaagccaauaaaacauuguugauuauagguuugguguuuugaccauuagcugacauuugauuaaccuuuuuuucuaugauaagagaaccauggucacuuuuaagcauauaaugaacuuuuauauuuuuaacagaagauaauuguuuuaaaauauuacacuuauuauguguaauuaugucuacagggcucacucagcuauccauuuuuguugucuguuggggaaauacuccuuaagaggauugugugcacaauauuaaguuaucauuaaucaaauauucucuucugggagauaauuuuuauguguuaaaguagucucacuauggaaaaacuucuaauauaacuauuaaaugucucuccucacuuacauuauuuuuagaguuacugugacaacaacauacuuuggccacucugaacagauaucccaggagagguaucaguaugucgacuguggaagaaacacaacuuaucaguuggggcagucugaauauuuaaauguacuucagccacaacaguaaaaacuggaagagauggauuuaaagaagaaauaucuauugauauuuccuauacucucaaugaagagguauuuccuaauaggagaccuuaaauugaacaaaccuaaaguuuacacuucuaagaguacaguuaaaaguauguggaccugcaguucuuguaacucuccacucuguguuaaugauauauuuguacuaggaucuuuuacuugaaucuaaauuuacugguugauuuccuucuccagccuauccccuacagggaaaagcugauacuuccccuauaguacaauaaauaauuauuuaaaagucauagcuccagucacuacugaaaacauaauuuuggugauaaacauaauuugagaaacuuaauuucugaauguuuuuauagaaaauuacugaaagucuauuacucauggaagacuuuuaaagaauaaccuuuuuuccuguuuuauaaauucccauuguuauaugguaguauuucagcuacacaauauuuuagcuuuuagcuagacauuuauagcuuuucauuuguugaaaugguaaucaucugcauguuuuugucacuuauuucagguuagugauugccuaacacuuauaagccaaaauaaucuuugcaaaauuccauaccuaaaauuuugaaagccccuaauguuuucacacaucuuucuguauuaguuauaguuuugugaaaucuuugugugaucuucaaacauuaucauuuaauguacaauacuguaaauaaacugugcauggcuuuuauacagcuuuaguaaaugucaaauaaagugguacagacucauuacaacaaguuucucauaaaaauacaauaaauaggaaaaugaaauucagaaacccauagacugggaauagguuccaguuacagcuuggaucuggcauaaaauaaauuugaaauaaaauauuuugaugcuccauuuuuuuauguugcuuuucauacuaaagaaugguguagacauguuuugcaacuguuagguacccaguuaucaauuuuaucaauguuuuagaggaggaaauuauuuuuuugguagaaauuguucaagaaauccuuaauugaaugucauuaaaugaugguggccaaaauaaaaccuauuuagaaauuuaaucacuuugcacaucacuuggaauaugaugccucuaguaguuacuuuuuuauaguuuucuacuuuugguuuuauuuaaaauuguuuucaaauauagauuauugacuuauucaacuuugcuguuuuauauuuucaguaucauuuuucauuuuuuuuuuuuuuugucuuuucacuuaccaaguucuagggacauuuaaaauauguacuaaguguaggagugguuaugauaccaaaaaauguagcuggguugagauuaauuucguucuguuuucucaugacagaaaucagguuucccuuuccccaccccuaagugccuaacuuaggucugaaacagccuguuuauuagucugacucucucaaccauaaaacauaagcuuuauuuaauucugccuuuaaacacacucagguuuccccuuaauuuucauauuauuuucugcaaguuuucuugaguaucuucaauucguugaaugugguuuuugguuuuuuuuuguuuuaacacuagucuucccuuaauucauugcuaacucaagccauccuuacuauuaaacccaaaucaguccuuuaaguucauuauggccuuucuaguauuuaaaaaaaaaaaaaucauuuucauuuuucuucugcuacguuuccugacuacuacugcauacuucucugauacagguucuguuuguauuuuuuauaucauucucauuuucucauuugacaugaucuaugucuauauaugauauagguccccuuuugucucaaaauuuuuaauuaugugacuucaaaaaucaccuguaucuguaguagggcuuccaaaucugcuucuccauaugugaccagucaccugucugcuuucacauuuagcuagugaacuacacauuuacuaaaauguguaaauuuuacacauuuagugacuguguaaaauaaaaaaaaaguuauuuuaucauauccuuucuauuauguucccauccuguccucaugucccauuuacuuuauuaucaccauucauuucuucaaaauuaucuuuuagauacgcucauacaaaaaucaauccuuguuuucuugcuugugucuuuuaaccuuggaaaauuacaucguguaaauuaaacagauuuuucugaugaucugugcuucuuauauacuauuagagugcaugauaguaucuccugaaaaggauggaaaguagaagcauuugcuuuuagucacuuaauuuugaaucuuuuuucuucaucuuuugaauuaauuuuuuuuauuauaucuacuuuuaguggaguuugagucagaaaaaaacaagaauuugaaacaaguaaaaagauagaagagaaauaaagaugguaugugacuacuuucagagagaguuaaguaacugucagaauaagccuggaacaaaacaggcuguaaauuaauaaaacuacaaacacacauucaggugaagcagaaguauagccauaaaacaucuagaaagagugaaugaggcuuuuagcuuuucuuaggucaauguccagugugcuuuuuuccaugggaauaggauagguauuaauacgcuuuucuaaacugcucucagaccuuauccagaggacaugguaaagauauguuacagaaauuuuucugauacuuccuggaauaacuuuaaguuacacccuaguagacuggucauucuaauaaaauccaguacuauaacaaaccucuguauguugauagcacauuggcccuuuuuagaguucuuuccuauguuuuucuuacgugauuucccacaguuccaugaguccaacaaaggagagugauaggcuccuuaucuuuuagaagaggaaggaaaggcaugaagaaguugagggacuggcugaagaucacguacuuacuaaguaguacaacuggagcaagaucaaguaucucugucucccauaucuguguucuaucauuuaaaauauauauuggaaaucccugcugacucagauugguaugauuaaaaaugagaggaaaguucaaauaguuaguagugacaaacuaauacugcuggacuaagauuuugguagcauuguuuucuaaaauauuuuaaauggagaaugaacacuuauaaaaugcuuuggaacauaaucuuuagcuuaauuuucuguuaaaauuuaguaccccuucaucauuccaauaaagauaagacugauccauugucuaaggaaauuauuuauaaauaauagagauuaauuuauuugagauuugaaauaagaauaguaugaaaauauuagauaccacauaaauuguuugaaauuacugaauaaccaucuuaaguauggaacauuuaaauggcuauauuuuauuuguguacaguuuuucugugccuuguuaggccagugaagcaauuauuuucucuaagaaaaugacaauaaaauauaacacacuucagauugucugauuuacaguuuggaaaggacaccgcaauguucaaauagguaggagaccaucaaaaacacaauuaaaguaacauauuaggagacuugaaacuucagccuaauaaauccuucaugguucuuagccuuauuauugugauauaauucuagauauuuucuuggagggcaugugcccaacucucccgcaccccauuuuguuugucuuuuaaaguucuuagaauaaacaguucuuuauauaauaauuauauuuuauuuaagaaaauaguuuguuagguacuuuuuaaaagauguaaauuuuuaaauuuacaaauacauaugggucuuugauaagcaauaggaauugaauuacaaguuacuaggguuauaagcaaaagguugcuuaccauaaugucauuaggucacgauuuuuagcucacaucuggaagcagcaacuacuuggcucaaguacauauaagaguaauuaguuuuauucucucuuuuuuauaaaaucggguuucagaugagauguuuaucuuagacuauuuuagggaaaaauuuuacauguuugagaugguggaguaaaaagacuguuaaacauuucuuuuaaaaaauuauuuuuacauuacaacaauauauuuaugauguguucagaucaaaaauuuaacuucugugucccagaucuacuuucaaagugagauuuucacuugucagcuuaaauuucugacuagaacuaacauuuguguauuuuugugcuuagucggaauacaaauuucacaguggauuuuugaaguuuguccuuaaauuggauaaaaucaagugauuaaaguuacuaaagagauaaaaaugguaauuuccauuuuuaaaaguaauuugguuguguuuauaguuauuuguacaaguauuuaucacagacucuaaauugaaaaauguaguaugaucuauauuugacccuaaaaauguuggauuaauuuaacaaauauggcagauuuuucauaacuaagucuuaagucuucuaaaaggaagcuguuacccuucuguuuuuaauuacauuaauugaaauguguuuuaagagauacaauuucagcauauuuuauauauuaaaaaacaaaaaaggauuaguauugagccaguggccaaaagguaauauuacuaccauguagacuguuauaguucaaauugucccacuucacccagaauuuuagaaacuagaagucugggagguacuauaucagcuguaguuggguaauuccaagugcugauaguacuauucaucuuuuuuauuauugugucagaugaaacaaaugccaaguugcaaaauaugcagauuuuuauuauauaaugguuuuaggcauaaauuauuaacaagccaugccuuauguguuucaucuuauauuuuucuuuagaacuaaacuauaacagauuuuggaaaaugauuugacgugcuugcucacuugauugacuuggucagauauuugaaugaugguauuaccuagauucuaauccuugauucuaguuauauaauaaauaauauagaauaugaaaauauguuugggcauuuacuguuuauauuauguaguagccuccaucaugacacacuuacuacauuuaugaauugagcaguucuguaauuguaauuauuauugcuguucauguaacaaaacaugcuuauaauagcaaacaaauagaaaugcccccaaaaugcuauuuuuuuaauucaguuauaacuguuacucuuguaguuguguaugacgcaauaaaauuuguaaaaaaauuucagcaugaaaaauaaaauuuguaucacuuauguau

SEQ ID NO: 14542 - RNA, 1007 nt, Homo sapiens
cuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccaug

SEQ ID NO: 14543 - RNA, 1044 nt, Homo sapiens
uuuuuuuuuuaauuuacuuuuuaaauguuuacaauuuaauaaaucucuucauugcagacauguauggcuguuugguaguauucagaaacaucacagcaauggcaguuuuuccaauugguguguaguccucaauaauuauauauaaaauugcugucaaaucaguaagacugcauuuaugcaugcaucauuuucaggauuguuaguaaccugggcauaauuuccccaaauaacuuugccuccuugcaucacaaggcccaauucgcucauauuuacuucaaugacaguaccuuugguaauaacaucgaaaguuguauacaguggggacaaggggcucuucuuuacaccaaguauucguaggcaaaagguggcuuucauuucaggauguguuacaugggcuuucuugaaaugcaagcccauuggccugaugaaucuuucauauuuaggugguuuucuuguaaacccaucuccaacaaagcagacuuuaguaaccauccucuuccaugccuucuucuuucucuuuccuguucgaauaacuuuuaauacuucuguuucucccugggcacguacuuuaggcagagggacuucccauuuucccacuuucucuuuucguuucuguuuaauccuauuggaaaguacuuuagcucgagauuguuccucucuguccagcagauaggcagguacugcucccuguggagucuuuucaucauucuuuuguuugauguuucucuuuucaugcaucuugauagucuuuucauuuguauuuucucagcauggcgcuguuuaugguaaagcuuagccuucagaccaaucauuuucuuucccuucuuugaacauucaugagccucucgacuuuccuucuuucccuuuuucucaugguaauccaaaugguauccauaguguuuacaguguaauucaauauauucguucuguggcauggugacagccacagagcugccaggagcagucccuggggugcgaaaacgcucuccauuuuugggucucagagacccacgagcccacgccgcacaggccgggacaggaaag

SEQ ID NO: 14544 - RNA, 13052 nt, Homo sapiens
gucccaauuuccgacucacagggcugcggagcagcaacucucacgauauuugcugcgacccgcaggcgcuauccgcugccggguucuggcgcgcccuuucaguucugcuugcugucggcaccgcugcguuacccggaaccgccgggccgaacagcaugacguccgcuuuggagaacuacaucaaccguauccucaagcuggccgccgcgggcgugagccggggucgcggagaggccgcggucggggaucggugggagguugggaggccuggccucggcgggauccugggggcgggcgaggagaugagggccccggaacgacccagaguucgccggcggcgccucgagccuucccgcugcugcgggcccagggguccuuuccauuuugccugcaaaacccaaauaaaaacccagugugauuauuccgaacuuuucugucuuaaaaaaaauguacgcucuugauucuuacuuacuauuucccuauggcauaaguguuaaaguuugugaauaagaugaacagucguccuggcggcgacaacaguuuugcaaaucuuuguacuuguuuuauucacauaauuugcucguucgaggauagcaaaaaguuuaacgaugguucacagacuguuucugucccuuuaccacuugaagucccaacuuguugguagaaugaaaaaaaaugguugcuguuguaauggauuauagugaggagcaaguaacaaccccaugggaagucuuaaaauagacuuuacaaguguuaccguuuuaaagucuuaggacaaaaacacuacguuaagcucagguacaaacugggugacaaaaauuaaauaccgaaugcuuuuaaugaugcguuauugguacccugugacacugcuuauauaguuucuuuacuuuugaauuacagaagccuguccuggaagacaguuuuuuaacaugcuggaaaaucguccaacaucgauuaauuuaguacucauccacuuuucauuuuagaaauaaacaggccuaagaaacgaaauauccugccugaaauaauagauugguaaccuuccuaguagaaaagugucaaaaauccaggauauuuugagauaagauacaccgaucacauacagaaagagguuuucuuuuucuauuuuuucccuuuuuuaaucauguaauuaucacaaagacaaaaacagaagcuuuuuuuaaguuuuuuuuuuuuuuucuuuuuuugagucgagggucucacucuguugcccaggcuggagugcaguggcuugaucauggcucaaugcaaccuugaacuccugagcccaagcaauccuccugccucugccucugccuccugaguagcugggacuauaggucaccaggccaggguaauagagauggggguaucgcuguguugcccaagcuggucucaccucaagugauccuccugccuuggcgucuaagaaacuuuuaacguuuuuauguagugaacuuaguggcuguguugaauacuuauaccuaguugucauauuuauucuaaaaauucaaaucauucccuugccagagucuguuuucaauuugcauucccuaagaaacacuuucuuugauucaguuaucaggaacuguugccguuauuacaucagaugggagaaugauugugguaagucuuuggaauuuucauucucugcuuuccuguagguuuauugguugcaaguuuuaugugaaaccucuaaucucuaaugccuagacagcacauuacacccguagugcaauuuuauuauaauucagcucuuuaucacuuugcugucaauccauguuuuccucacuaauaaacauuguguguuaccuacaagguuucucggagcuagaauaauagauucugcccucagagagcuccuagucuguagaccuuuauuaaacuuacuuuucuucuuccauuuuuauuuccuuccccauucagcaccacaugaaucagaauuuuuuugaaauuuugcauaugcuuaguaacuuuuuaaugauuuagauacuauuaauaucuagauaacauuuaaggcuuguauacaaucuuaauauucuuuguuuuuagguugugugacaugucuucuguaggacacauuaugaugauugacucucuauauauacacauauauauguaaaauuggcuuguuccuugaaguuguuucucccuugcuaauuuaugucauauaacuaagauaaaacguuccuauagugauacuuguauuuggaauuugaucugaggaauucaucucaagauuuuuggguacuugguuauuucuucacuuacaauucauacuuugaaugcuuucaaaagaauuuuaaggcuacugaacuuucucuauuuucuaaccuuaccuaguuucuuuaaauaauuugaucccuuauuuuuccauucuucaguuuugcuuuuguucauuuucuuuuuaagccuugugauuuuuuuucacuggguccuuagugacuauuauuagucaaaguucuagcuuuguccuuuacuaaauuuauaucaugugccaggugcauauauguuacauuauuuaauguacaguaaaaacuuaugaagaauaaguaccccuguauucuagauuaggaaacaaguucagagaaggugacucacuuucucagagucacaaggguagcaagugacagaaccaaacugggauuuaaauuugguuugacaucaaagccaaggccaguugccuggcuucuuucuuaaggaagcaaugauguuugcuuaggcaccucacauuguauuuuuucaaauauggacaguuugacauauuuuaauuucaacacuucaggaagccuauugcuguuaauagauauuugcauuuuuuuuuaauuuggugaaaaccuuaaguuuaaauuuucuuauuuuuguugacaggguagauaauaaacugagaaauuauuuuuaauuuuaaagaagaaugaaagugauauaaaaagcaucuuaaguucuaaaguucaguaguucuguauuucuuugacacauaauuuauuugaugggauaauguguaaaaugaagucaagaaguuaugaauggauguuuaugauaacaaccauuugcuaacuaguucaauaaauacuccauauuuuguuucucuuccaaguuacagauuucauucucauuuuauuucauucucuuuuuuauuucauucucauuuuauauauuuugacuuucagaagauaaaacaguuuaagaacuugagagguuuaaccaucaaaaccaauguuaguugauauuucuucagaaacuugaauaccaugugaguuacucuguuaugcuagacccaugucuucuuuuauucaauacuaagcuuucauaaaacucucccugauuauuuccuucaaguucugguuuuaauuaguauagucacauuuguaucuaccuuacugggagaauuaaacaauaaauccauaugauacacauuaaacaauacaugugagacacacagaacacugguaacuaguauguacucauuagguguuacauguaacuacuaguuaaauuuuuaguauauuuaugggacugauuugaaucugaaaaauggcaaauuauauuuacuuguguauaauaguauagaauguuaugguuuaguggucuggcucaggagcuagccuuuugugguucaucuccuggcucugccacuuacuacccaugugaucauaagacacaccauucugugccucaguuucuucuuugaaauggggcuaauuauaguacuaaaucaaaggguagagaugaguugagaaaauguguacaguguguuuagcacacugccuagugcuggcauauagcauauagugauacuauuacauugcuguaguugguauguaugguucuuccuuauuuauguauauuuggcuaucauuuucccuuaaauauccuuugucuuaguuuauaccuuuagcugcuggucuacauaagcuuuuaugcuacuuacuuggagauagucacauuaguacauagguguccuuugcaacugcugucaacucuacauaugagugagauguguggugcagguccccccaccccagccaaauaaccaagagguaaauuguguacccucgaauacuguugguuauaaaaaaggcauuuuauuugccgucguauagguacuuguauuggaauaccuggcaacuaaaaugacugugagguuaaauuuacacuuucagguaaaccagaauauuucucuuuuucuccugaauauuuucuuuacagggaacacugaaagguuuugaccagaccauuaauuugauuuuggaugaaagccaugaacgaguauucagcucuucacaggggguagaacaagugguacuaggauuauacauuguaagaggugacaacguguaaguaaaauauaucuguuaaaauuauaaaugauacugccuuacuuuauggagaagaggcuuuccccaaaauacccuacuguauuguccauacauaguuaauagaaucuugcauucauuucuuucguaaauauaccuuuucuuauguuuguguaaaauaaggcauauguauacauuuuaugucagcacuucuuuagguuucaaccaaagcugucucucuacaaauuaaacuuuuaccugagauuugcccauuuuucuacuaguuaaguagccuggguagaguccagaaagggcucugccuuauauuaaauacuucauuagagagacuucuuaaaacguucuuucaaauacccagaauuuuagaggaacauauuucuagaguccaaggccaaaguuugaaaaauguuuugaaaucucugauuugaacaauauuaauucaugcucaauaacauagguguauuuauaaauaaguacuuacucguuauucauuuucuuuuaauuuuuuaguaucauugacacacuuaagaugucccuguggccucaguuuacuugggacagacagauauaaaaguucaagaguaauuggccaggcauggugccuguaaucccagcacuuugggagucugaggcaaguggaucaggucaggaguucaagaccggccucgccaacauggcaaaacacugucucuacuaaaaauacaaaaauuagccaggcuugguggcgugcgccuguaguuccagcuacuugggaggcugaggugggagaaucacuugaacccaggagguagagguugcagugagccgagaucacccuacugcacuccagccugggugacagauugagacaccaauucaaaaaaaaaaaggccgggcacagugguucaagcauguaaucccagcacuuugggagguggaggcggguggaucacuugaggucaggaguucgagaccaacuuggccaauguggugaaaccgcgucuuuacuaaaaauauaaaaauuagccaggcgugguggcgcaagccuguaaucccagcuacucgggaggcugagucaggagaauucgccugggagguggaaguugcagugagccgagaucgcagcacugcauuccagccugggcaacaagagcaaaacuccgugucaaaaaauaaaaaagaaaaguggcuaaugugguucacgugccguggcucaugccuauaaucucagcacuuugagaggccaagguggguggaucaccugagcccaggaguucaagaccagccuggccagcauagugaaaccccgucucuccuuaaaauagaaaaauuagccuggugugguggugcaugccuguaaucccagcuacuugggaggcugaggcagaagaauuucuugaaccugguagauggagguugcagugagccaagguugcgccuuugcacuccagccugggcaaaaagagugaaacuccaucuugaaaaaaaaaagaaaaguggcugaugugacagaggaacugaauuuuaaauuuuauuuaauuguaauuaauuuuaauaguuacauguggccaguauuaguauaguuauagaggcuagaagaaugccaaaucaguuuucuagugaguacuacacugaaucaaaauauaguuggaaagaagcaaaagauacauuagcaauuuuaagcuagaacauuuaacaaauucuaggggacuaacuguccccuggaauaacuuaaaaagugcaggaauaauuuacucauuuaaguuguuuauguuagcaucaccuuuagaugaauaaauaauuugaucuguaaucaaaaaucaagaguuuauaaaauauuuuagagaugacuuuuagguggaguuacaaggugagcuguaaguaaugagagagagacagagcagauagggcccaggucucuggaucagaacaacacuguuuauauuggagcugugcauaguaauugauuuuaagguuucuccuacuuaaaacaauuuuuuuuucuugaacuucagugaaaaaagucuugugcuagagccagcuucuacuggcccaugaaagcauauuguuauauuuuaaggaauuuuacaagcugguuaauugaugucuuguuaguagcuugaaauuggccguggugggaguguuugcacaauggauauuaguaaaugcagcaaaucagucucccgcuuuuuuuccagagagcugguuuuuaaaaauguaucagcauuucccugcuuaccauagggauuuuaaaugauacugaauauuaucauuuaaaauuuaagaauauuuaagaguggaauugaggccuuuaguuugagaaaacuuaauucauucugccagaguuucauauuuuucauuuauuagaugauuuaagacuuuauauacuuuaaagcaaaauuuggcaaaucccuuauuacuaguauucgucuuuagaauuuggccgggcacaguggcucacaccuguagucccagcacuuugggaggcugaggcuggcgaauuaccagaggucagagguucgagaccugccuagccaacguggugaaacccugucucuacuaaaaauacaaaaauuagccgggugugguggcaugcgccuguaaucccagcuacucgggaggcugaagcaugagaaucgcuugaaccugguaaguagagguuggagugagucaagaucgugccacugcacuccagccugugcaacaagagcgaaacucuaucucaaaaaaaaaaaaaaagaauuuacucucauuaaaaccaaacaaauguaaacccaaccaauacuuuuuaaaaauaauauuucauagacaucuuguggucugagugauaacauugaauauuuccaguuagagggcuauggguugguuaucuagcgugguauuaaugaauuuaaaguuauagauacuauguuaguguugaacaagaaaaaauuuucuagcuuuuaaccugagccaaucacgucaaaaaugauuuguuagauaccaaaguacuuguuccuacuauuauuuuuguauaugaagaacuggcuuuggauuuaacugaaaacuuaggaaaacaaucuaaucgcuguugucuauaucauugauuuaauucaucaaaguuacucaaaugauugauauuuuuacuugcuaauuauuuuaggagugauuuugugaaauuuauuuuuaauacaguccuagaauugaauugaaauaugguuuggaaguuugaggguuuuuuacugugucuauccuugugugucuguuuccuuuaaagauucaugauacaaucacuguguacaauguguccuuuaauauugguuccuguaauaaugugccuucaaauuauuucuugaguuuugugacuuaaauaugcaguucacugacucacgccaauguuguuugcuuuuuaccuuaauucuuuuuacugugcucucucaguuuuauuuuuuggaagaaugguacucagugcuuugauuugauuaguaagauuuuugaaacacauguaauuuauuucagaaaugugauuguuuuaacucugacuuuuuuagugcagucauuggagaaaucgaugaagaaacagauucugcgcuugauuuggggaauauucgagcagaaccuuuaaauucuguagcacacugaggaaaaacuacauacuuggacaucuguaaaucuuuguacagaaacugauuauucugaggaugauauauggaguuuuuaugagugugucacuggauuuugacuccuuauugauucauuguaauauguaaauuaaaauauuucuacauuuuauugaaaaaaaaaccuuuuuuuuugccuaaauauaaguuugguagcuugguuucuuuuuuuuauuaaauagugugaaaauauaaugggcauuuugaaaacuuuuagaaaaaaguaguacuuuuugauacuuuaguauuuauggaaacuaguggaaaagagaaauuagugugcuauauaaaucaggcauucaaguaacaguaauacaggauauauguguuuucuuucccugauguuuaggaaaaucacaggaggguaaaucuuugcuggaguuaucugaaucauuggcauuuauccgauuccacuggugguaguuugcuagugcuucuaaaaguugcucccuagcacugagagguguggguagguaaaaauguguuugcuugagaaaagcaaaaaugcuaacaagguuuugauagauuggcccaaaauucuaacuugaauauuaagaaugacuaggaaugguagaauugacagagaugauuaguaaagucucuugaugcccaauugguuagguaugaaaguaauaugaacacauuaauguugaauuuuacagacaguauauuugaaaaaaauugauuccauguagucuucaauuuuuaauuuuuaagaauuggagaauuucuaauguuaaaguuaguuuauaaaugugaguaaauaaacucuaaguuuguauugaaguagugcuagcuauuauugucagcaauuuuccaugauucauuauccauaaaccugauuucagaagacgucaacucaguuuuuuaaauaauugaaagaaacaauguaaguaguguuuagauauucaggcuaguccauaaaauuucugaucaacucauguauaggcccaagugugugucuuugugaugagaagaacauagaaaaauauuuacauccuuguaauugaaacaaauuuaaauaguuuauuuguuuuguuuuuaugaaagugcuuaaaaauaguaguuggcaagcuuuuucuaugaagauccagauagucuuuuaggcuuugaaggccauguggucugucacagcuacucaccucugcuauuguggccuacaaauaaccauagauaauacauaaaugaauaguggcugucuuccaguaaaacuucauuuauaaaaauggagguggggguuggauugggcuugaaggcauaguugcugacccuuggcuuaauacaaguucaauaagaaaaaaugaacaauuuguauaaauucuggaauagauccuuauagagaguuuagagguggguuucauucauauuuuaaaauauuuuaaacuucauacuuauuaaacauaauagcuuuuugggggaggaaaauaucuucacucaaaucagccuuauaaggggagaagcacuauucucuagaauuauuugguugauguuaagggcugucucugggagaauuagagaaguuagcuaguauuggcuauucauaaguacuugacuuguaguauaauguuuuauaaucaauuuauuaauaaaaugauggaaaguggguaaggcaaacaggcaaauuuagggacugugaaugaaauauuguaguauauggcauuuugaauugguaaaguaauuccaaaaauuaaauaagaauacacauuguucaguugcuaagaaaaaugcauucuaacaguacaaaugaaguccagagucagaucuuuucucaaaauacuuggcauaucaacacauuacacauaaacaaauaaaaaccaguccugucccucaugauaauggguuucuaaugugauguauucuugcaaucugaaacaccuuauaaagcuguauuuuccugauugauguuggaaaaagcauucccaaaaugugaauuauuguuuuuaugaauaguuacagaggaugugaugacaauaugccagauaaucuauguaauucuuuauuccuggauacaagcacaugguggacuguuuucucacaaccgauuaaaauuggauuuauuuuugcaugagaauuguaagggagccacaaccaugaguaguaacauaauuaauauacagugucaauauuuuauauuuaaugagacauuuauucuauaaucaguucuuauuuauaaagaggcgcaaaucaauuucaaccuguaauuaccucugugcuuugugacucaggcacaaucuaaacccagcuuaaugaaucaaagagauguuucuuggcaagauauuuucauuaaaguuauuuggaaagggcaauuaacugcaaaagggacuuuuuuuuuuuuaacugacaagauacuaucuaaacuaauaguuuaaaauaacauugcuuuuaugucaaagcacuuugguaacuuggccucacaugcugacaguuuuggcuaaauauuacaaaucuugaucccagaagagcaagagagaaaguuuuacuaauauuugcuuaaacauccuguuuaacaacuuuauaacauccuucggaauuuuuaagguaauaaugugagauauaaguaugauaaaaacaacuuuuaaaugguauuuaaugcaaauacagaauaacgaugucaacauuuuccucagccguguaaccugagauucaucaugggaaugagaaaguaaaggcccuuuguaauggcaugugaaccagacaauuuaguagccaggguuguaaggcaacucuuaacugacaauauaguuaguauauucugggccuucaucuucaaaauuaguagguaguauuuauugagugcauaucaugugccaggccuggugcugagugcuuacaaugaucauuuuauauaugggaaaauugaggcucagcagggucaagugacuuguaagagguagcacuaguaaguaacagugcucaaauucaacuaggucuuucagcuuuuuauacaauacugccuguuaucagaaaguauagucuuaaaaucugcuaucaagcaucuaucagaagccugaugagaaauauucagaugaucuaacgcaguucccaaaccugcauugugggccguuuucauuacaauuaccuaaggugcuuuaaaaauuuucuugggcccuacucguugugguucagcagcuguguaauggagcaaaaaggaauagucacuaaacagcgaaggaaagugguggaauuauuaaaagaccuagcacuuaccugcugggaugagucucuaaccccacagaauugauuucaaacacaggaucuuauucaagauaaggauaauaacagcuaucuucuuggguuguaaaaaguagcauuagacugcauuuuaaacauuugguaugauuuugaggacauaaccguaaacagcuauuuaauacuauuccagguagucaaaggccaauguauaaaaguuaaaaauauaggucuugucagcuuuuuaagcgucugucccacugacuaccauaucucuacaagagaauagaugaggaauugagguuaugugggaaguacguguaaguuuacaguauuaagaaauguacaauaaaauuuguuucuaugucagcgaauauucuugacucaaggaguuugaaaguguaaacucaaaggucuuucacauguaaagaggaaccucuccauucuguacuuguauagucauuaccucauauagauuuaauuuuauuaaauuaaauuuuacuuauuuuggguuuaaaaaaacuugggcugugaaucucaguuuuaagucaugggcaaauuugauaaaaauuccuuucugucuacauguaauacugaaaaaaauguugauaagguaaagcuaucuccauuuagauugauacccauuaaauagcauagugcucccauuaaacuagcgacaaauucauuuaauugugagauaucuaguacuuaugcuccauccuguuuauagggauuauugaugugagauuuggucagaugcuuugaugugaucuucauuccucuguauagugggaaaccaugagacgugcuuagucuucauaaaucgaugcugccuccuaguggccauugcuuucuuuucuaccuguccacaaacuucaaaaaaauagauuuuggaauuuugucagggacacuuaucaagccauuaauacaugccaggcaguaugcucaaagcuguggauaggccagggaacaguauucuugugcuugugaagcuucuaucugucuguaucuaccucaaccaaaucaucuugacucagauuuacugucgaaggucguguuauuucaucagauucuuucaguauucugggauauaauuuauggguucuggauucauucaaaacaacuagaaacagucuuuuuaaaauaaauauaauucaagucaauuauuuuccccaucuauuuuuuuucuuuuaagauugcuaagucuguagguugcauaauucuaaggauaaaggcgaaauaggacuucaccaggagaauuucuuucauuaguuaacaguaugccaucuccuacuuacuggcaucaucuggggaaugaaggagcugagaauuguucuuccagauaccuuuccgaccucuucuugguuuuggcauuaaguuuuuuuuuaacucaauuuuuguguuaguuuuuuguuaugccuuuucauuuccuucuuuuuuuaauguuucuuuuuuuuuaaguccuuuaauuuuuauuuauuuauuuauuuauuuauuuauuuauuuauuuauuuauuuuugagacacuucuugcucuuucgccaggcuggagugcaguggugcaaucuuggcucacuacaaccuccgcauccuggguucaagcgauuccccugccuuagccucccgaguagcugggacuacaggcacgcgccaccacaccuggcuaauuuuuuuguuuuaguagagacgggguuucaccauguuggccaggauggucuugaucuccugaccucgugaucugcccacuucggcgucccaaagugcuggaauuacaggcaugaaccaccacgcccagccuaaguccuuuuauuuuacagaguauuacuuguuagaaauggcacagaucaagcauugcuacaacugguaucaaauucccaucaaugucccuaca

SEQ ID NO: 14545 - RNA, 6092 nt, Homo sapiens
ugaguuuucuuaccauuugcugggauucugugauauugccaucugucuuccugccauaauuuccaccuagugcuugccaacacauucccuucauacuugguucugcuugacugccugaauuuacauugccuuuugaugggucuucacucaaauuccagucacacccuaauugauuggucuaguuuuuagguucuggccauccaugccuguucccauaacugaauaaggcacguuuguaaaaacuuggaugucuagcaaaugugauaaauucaugggauaguugggaacacuggucugaauagaaggaaaguuguggagaaaaggaaaaaggggaaaugauuuaugaugucauuugcauaugugcaagcuagugacaauaaaaggaagaaaagaucaagaaagagagcccacuugagcaacaugauuuugguagcuauauucucaguuuuuaugucucacccgaggaagagcuguugagaccuaguuaauuaagucaacauauggucagccuugcagcccaagcuggcugcugccauuuuuuaagccaaagugagaaccagcucaucuccauuucggcagaauugguaagauucuucucuaugaaccagugacucguaaaacaccaccaauauaaaacucacaacaaaauguauaauuuaauuucuagcagucauuuuggaaaaauauguauguuucuuaaaucaaacauacuauaucccaaguauuuucucuagucaguuauagggaauaauauugcugauaaagccaagaaauagaugaaaauuauagaaauauguauagucaauaaacuaacuguaugaguuauuuaugggugucuuauguugcugacaugauauaucuuccuuuauugcugugaguaguaaucaaucaguuaacauugcuuucuacaaaagaaaacuaaccauacaaagauaauagaacauaacggcaauugcuagaaauaauaauucuuugcagcgaaaacaaaugcauugagaagaaaugcauucuucuagaagaaaccaaggacacuaacuuuuuuucuuuuucaucagucaaucauuucuacauucaaaccaugaaauuugaaaugagaauuuacaacaucuccaguuuuccauacaugguuauugcuaguauacauacacacaaauaauaaucaaaugguuguuuuacacgugguaggaugaggacacuugugaguucggauuagccagcuagaaauaauuuuaaaaacaaaagauuuuaucuagugucacaaacaaguguuuuauuuaguacagcauuggaguaagcuggaaguuuuaaaacacaccaagaaaaugaaaagagcagcaggcgaagacaaauaucuaauauucuugguaacuauuugauuaucuuuccccaguuguauugugggugugacaaaaagcugauguaguggaauaacaguauaauuccugagggaucuuucugagaaaaguagaaauuggcagcuguuuguaaauagacguguauuccuuccuuuuccuuacauuuuguuucaaauaacugaaaauuaagagaagaguucuuuguuauuguuguuguuguugcuguuugagagagagagagagagagagagggucuugcucuguugcuaaggcuggagugcagcaaugcaauaaugacucacugcagccucgacuugcugggcugaagagcuccucccaucucagacucuugaguagcugggacuacaggugggcacacagcaucuggauaauuguuuuuauguuuuguagagaugggauuugcuauguuucccaggcuggucuccaacuccuggcccagccucccaaagagcugggguuucagacaugagccaccaagucuggacaaaagaucucuuauauucuauaaauuuugcuuucugaagaggaagcaugcuaaugaaguuauaaauuuuugagagccaaaauuaugguagaacucuugguaucuccuagcacaguucugaguuuguaguaacaauucaauaaauauuuauuaaaucugugggugaagugaguccaaauuucuaaacuuugcaugaaggucagguuucaauaaaguuuaagagaaaaguuuucuaggauuucauaggaggguacugauuugggcacuucuuuaaagaauuaccugguguguaaaugcaaaugacgaugcugaaaguaagcuuauggcaugggauggaaaugaugugauacgaguuuucucaggguccuuugcuauugccaugagguuccugcuucagugguucuuucaauaacuaagaaacuuugcuaaguagugccccaaaaugguuggcugagagcuggguuguccuagcagugaacaggagagaggaugguacuaugccuuccuuucucuaucccucaguucaaauaaaaaucugacuguguucaguuaucuaccuuccucucuuuggcccugugcuuuagagaagggcugucccaggcacagguaauacaucuugauugguuuaaaaccuggccagucaugguggcucacaccuguaauccuagcacuuugggaggcugagguggguggaucaccuuaggacaggaguuugagaccagccugggcaacauggugaaacucugucucuacaaagacaaaauuagcacgacgugguggugcauaccuguagucccagcuucucgagaggcuaaggcaugagaaucacuugaacucgggaggcagagguuaagugagcagagauggagccacuacacucaagccugggugacagagugagacucugucucaaacaaaacaaaacaaaacaaaacaaaacaaaacaaaacaaaccaguuaugguagaaccauaguucuugugaauaauugguagauauaugaguaugugaccagguucuagccaaucaaucaaagggauaaucugcugcagaacuccugggagagguuugcuagauccuaagagaaacucauaggagaaaauaccuucuuccuuuggaaguaaugguaacugaaaaugaugcuugaauuugcacagccaucuugugaccauaagaggagguaccugaguauaguaugauuacucauugugugugucaggagaguaaggaggaaaaagaacugauuccuugauaucacuacugggcagaugaaucgcuauuccuggacucauuguuaugugaaacauauuuguuuuuguggcucuuugagugcauuugcuaguuugcauagggaggccagauucaacuaauacaaauguaggguuugcaauucaauuugaauuucagguagacauugaauaauuuuuuaguauauguauguccagugcaauauuugucccaugcaacauuugggacaugccuauaccaaaaaauaaaaaauuguuguuuaucugaaauuuaaaucuaaugaggugucuuguauuuuaucuggcaauccuaagcuuacaguagaaagcagucuacuuaauucaguaaugaaaggauuuucucaggucuuauuaggucuguauacucuuuuagaagugaggugaaaguagauuuaccagucauaguuuaaguacacauauuugaauuucagcuucauauucucgaaaacuaacuuuaaaaaguucgaaaauuuuccucuuaagucuuguccaaccagauuugaaauuuuauuguaaugcagauaaacaguggaaagaaucagacagaucuuagaaucucagcuucuuuauuuacuaccugugugggucuggcaaaaaucagcuaucugaauugauuucaaguaucucaacauauaguuaugaggaauuaauaagauaaauugugagaagcaccuauuaugucagacacauguaauuuguucaaaacacauuaggugucuaucccauauuaauuguaaaguacuggcuuaggaguacuugugagggucuuguacuaagaaggaauagcaacucauacauccaaacuccuguguuauccuuuuucucuccacaacuuuagcagaaugaauagaauaagauaugaacaaacaagcugccauacggagugaggaacuuguauucucuuacauauagcugaguuuuacuccugacacugggacugacauguaugugauuccuuguaaaugcuuauuuuauuacuuuuugaugucauuauuauuguuauuauuauuauauaauaagaaaggauaguuuugccuuuucuuggaggguaagaacuugucuuaguaucuucagcaugaggcacaguagauaccaccacugaaaugauacuuauuggagaacaccuggccacagaauuggguuccugacuaauggguaguaaauagaccauacaauuuuccuaauauguuauuacauauucaaauuuuuaugugcauauuaugauauuucuauccuccuuuuguucacacacacaaaaaaacagaucucacagagaaaaauauagaacccucagaaugacagcugcgaugugaagucuuacugugcuuccacaauucugggaaagagaagaauuggagagggagggaagaacagcugccuucaaguaguugaagggcugucauaugggaggaaggcuugcucaugccauggacuccaagggcggaacuaagguugaaggguagaaguuaaaaggugguauggucaaguuuaagcaauaaaaacugcccauuacugcaaugucucaaauguggugaggucuccucuacugaaauguugauucacugucucugaugaccauuuaucaggaauauuagagcaguaacuacagcucuguuuucuucuuaacuuguaaaauggggauaauaaucccaauuuaucgacucacaggagagggauuugauccaacgaaaucuaaagagacccuuuugcuaguuuuuaggcagcuguaaagcccucguugcaggguuuucaaauuuugcugcaaacuagaauuaccuugggagcuuggaaaacccugugugucuaggccucaccugcagagacuccgauuuaagugguaucaggcaugccagagaauuaggguuguuucaaagcucuccaagugauucucguguacaacaauuucgagaaccauuaaacuagaguacuaagagccauuauucuggauuuuacuuuggaaucuagguuggacuacagaugugacguugagcaacuacuuuaucuuggaucuguauuucuuguuuaccaggaagaagaggacaugcauacuucuaaaguaacuuccucuaguauuuuauuacuuuaaggcaguugacccuuaaagguauacgaauuaaggaaagggcacuuaacuaccuucuaggaguagaagaggaucucugcuuugacacaugggaauuguuggcacucuuuuucucaguuuuaauagcagucauggacuccuuucaaugcggggauguuuauaccucuccggggaauguauggcaccaacagcauuuggauggcugguuguuucagcaguccuuugcuuaaaauaggcaugcacccuaauuugagaagaaacuggcagaggauaaaaguggguuucuuugcucuuccccaguauucuagaagcugcuucauuaucagaguuggagucaucugauggauaacuggacauguuucuugguguuuuuuuuguguauggcuauacuucuuuauacucuuuuggguugcugucuuacauacugcuuagugacuugcuuaccaauaauuuuccuagccuaacccaggacaaccauguugucuuuuggucuugacuuuuccauaugagacugcaugucuuauugucacuccagucaugcagcaacuaacucuagacaggcagucauggacauaggauuccauuuuuuuuuuuuuuuuuuuuucugcaaggaaauccaaggacuccaguuauuaggucaaagauguugcucguauuccagguaauucauauuugcuggugaaguuuuauuugccaugcagugcccacaaaaguaauccuagaaaugagcaguacugugaggcauagcacaacacauccacauuuuauguggaggauaugauccaguggcauuuuauuuagugugaaacuucugucuucuaaaagggaagauucuuuuggaaggauggucuccugcuguguaauacuucaugaauuucuagu

SEQ ID NO: 14546 - RNA, 26499 nt, Homo sapiens
cagugaggcaagcgccucaggcgccaaagugguuuuuuuuuuuuucuuuuuuuuuuuuugccggagucgagcgggugcugcuagcggaggcgccauauuggaggggacaaaacuccggcgacagcgagugacacaaauaaaccccuggacccccuuguucccucagcucuaagggccgcgauguuguaccuagaagacuaucuggaaagugagugcgcggcgcuggcggcggccgccagugggacgugcgggcgggcaagagcgcgaguggacgggcagcgagauggcgggagggagggggcggcgggggauguuucuuucucacgguaacuggcagccucguugugggcugccggcccccucgaccccccugacgcacgcgcgcagugacguaagcgcguauuucgccguuggccccgccccucugacggacucucccuuugacagugauugagcagcuuccuauggaucugcgggaccgcuucacggaaaugcgcgagauggaccugcaggugcagaguaagucggcgcgucuacuacuccuguucgcugcgcgcguucagugccagacuugcuugucaucacugcuagcgccuagugcucuuucacuguccucuggcucacuccgcuagugcauaaggaguugucaaaaagaacuggcagcccugaaucucgccuuccccuucccucccaugcuacuuuuuucuggcuuuugcaagagcaggaggcauugggacacguguauuccuuucuagaaugugggauugugcaaaaaauauuucucuaccgucauugacauaguuaucuauguuucaauggacgucagcauaauaaauguugagaugucgucuugagccuuuucguaucgaacuuagauuucagcauuuauacuuauuuuaaaguucauccuauucacaguuuuucaagaguggaaagcacagaagcagagguuauauauagcucuuuagagaccauggcaaaugucaaauuuugaaaacuuaguuacacauuagauacauuuuaaauuguaacagaaucgucauuuucuugguuaaaaugagugacagaaauuagauuucacuguaaaguuucuuaugugcuguacuaaaaauuuuagcaguuaaugaacauuucuuuuucuuucagugauagcuugguagucucuaggacuuuuuccccaaauuaacuuugcucuuucauagagcaacgacuauaaauagguggcucagggaccaccugcugcagcuaagaaccuguccuuuucacugcuccuggcuucucugcccaugaccacacacccacuucuauacccuuugcuuaugaguauauuuuuccgguaaguuucagguggcacauaauaaaaagugguggcauggaagccacuuucuguucaguggauugugauaugaaguaugaauugugugugugguucuccagcuaucucacaaauucauuuuaauuuuaguguaguugaaaugcugaagauuugcugaaguaguguucucugcaggacugagcacagacauugaugucagaucugaguuuguuuuagggcuuuacuaauuuacucauugacucugacuguauuaucacuugugaggggcuuacauugucuauaaaaagagaaucauccaaggauuuaaaauguuacacauggauuagaauuucuaguaucugauacaaaguaggcauuaaauaaaggguaacuuacuuuaaauuauuuuuauauuuuauuguuuaaaauuuuaaauucucuuguaauuugggcuuacauuauacauauuacaggcuuuuuaaacgugcauuucuuuacaguaacuagaauuuucuaaaguuaauagguauuauggauuaacagaacugugugccaaauaaauucagaaaugcuuauuuaaacaaaggaacauacuucuaaaaaauuaaccauaggacuucauagagucuuuaaaaggcuauuguggacuggaaaucuccaaaagaaguauauuaugaaaagauuuuucucaacuuacauaacaacagaaucuuuuuuauuaauuuuuccuuuuuuuuuuuagcagacauccaaugagaugauuagucuuggcauauaauuuggggaaaacuuaccuagaauuaauguuuaaaugauuguaccuacuacuuucaguugggauaugacaugaugagauguuuaaugccauauaccaaauauuuuuaucacuuuuucuuguuaaaagaaaugugaggauuaucuaaugguguuuuaauuguguuucgguacauuugucugauuuaauaccauuagcuuuugaccuaaaggcuuuauugcucaaaaauuauaguauagagccuaucuacuuuggcuguuggaaaaaauuuugaaguaacaaaaacaaaaauaaucugucaauaaggaaaauuguaacuuuuuaaaggaagauaauugaggcauuauauauuuacacaaucaaagcauaacauauuuaaguuacuggcaaggugaaagaguguguauugucagauuuuuucccucccuaaaucaaaccauguauauuuaguauaugaauuuggucauuuaauaugaauuuuuuuuauuaugucauagaugcaauggaucaacuagaacaaagagucagugaauucuuuaugaaugcaaagaaaaauaaaccugaguggagggaagagcaaauggcauccaucaaaaaaguaugugcaacacuuuggauaauuuaucaagaaauauugggacccucugaaaaagauauuucaaaauuaaauaguggucuggauaucaaaaugagagaauauuaucaaugacuccuuagaauauaaauaauuuauugugguuuagagcuucagauagggauuuuuagucauuaaagcguuuugguaauuaaaaauauuguuucaauaauuacugaguauuagaaagugacagaccauuuaaaaguuacuuuuuuuucuauuaguuuguuuuauucuaguugagauagaguacuguauuccaguuuuggccacaaacuagguaaauaaacaugagcagaccuugaagaauauuuuauauauugcuagguacuuaaauuaguggacccacagaagaacgaaaucuuaaaaguuagaaggaauuuaagaaagccuucuaguuuaaacucuaaauuugcacacgaauuggucuggaaacauagaauucuuugagguuuuguuaguuuuauaguggcuauagcugucuuccagaauugaaugaguauacacguacaucucaaaguuugcuuugaaaguaugauugaguucauuuagggauggauacauuggaaaaacaacuuaaaagacuugaguuuggucaugauucugcuauuuagcugugugacauuaaaucuuaauauuucugaauaauaaugccuuccuaaacccaauguucauagaauuguucaaggaucaacuaagaggccuggcgugguggcucacacccauaauccuagcacuuugagaggcugaggcggguggaucaccugaggucaggaguucgagaccagccuggccaaccuggugaaaccucgucucuacuaaaaauacaaaaauuagcugggcgugguggugggcgccugugaucccagcuacucgagagacugagacaggagaaucacuugaacccaggagguggagguugcagugagccuagaucgcgccacugcacuacagccugggcaacagagugacagagugagacuccgucucaaaaaaaaaaaaggguccacuaaggaagaaauuuggaaacuacaaauugaguaguucuguuaugauauguuauuuauucuaccacauggagggaagauuguuucucuuaggaaaaaaaaaaaucauaaucuauaacagaagugguccuagcuuggaagauaccuggagggacauguguuugugaguaaagacauguuauauccacaucccagagucacuaaucauuucuuuaaccuguggagugcaccuuaaguauacccugaaaagucuaguacuccauggaaauucauaguaucaucuucuuucccccucuuuuuuaaaaaaaaauuuaauaaguugaggcaaaaucuaaaauacagauugaguuguaugaauauauaccuaauuuaaagugggaguuauagaacaacuggaaaauggggaaaugcagaucagaauccuuucaauagcugaacuuuaacaaaaauuuuuuaauggaaugcaaauguacuuuacaaguuagaucaauuuuaguuaacuuuuuauuuuaaauacuguucauuaacucauauagcuuuuucuagacuuacaauggcauuuacuuuuaauuauauccuuucuagaaauucugaacaucucccuuuuacucuuggccauugugcauaguuucuaauccuauaccauccccacccuauuucuaacagguuuuuguuuuguuuuguuuuuuguuuuuuugagacagagucucgcucuguuguccaagcuggagugcaguggcccaaucucggcucacugcaaccucuggcucccgguucaagcacuucuugugccucaaccuccugaguagcugggauuacaggcgcccacuaccaugcccggcuaauuuuuguauuuuuaguagagaugagguuuugucauguuggccaggcuggucccaaacuccugaccucaagucauccguccuccuuggccuccaaaagggauuacaggcgugagccacugccccuggccucuaacagguuuuuuauuacuaagguaggaugacugugauaacaagauaugauaaugaaaaugcaguuguauguccugcauaugaauauuuuaaaaugauuaauuuauuuuugaaaugaaaauguuuucauucaggacuacuauaaagcuuuggaagaugcagaugagaagguucaguuggcaaaccagauauaugacuugguaaguaaaaguaaugugcauacugugccauaaguacuugaauaacagauuauaucuuaaauuguauuggcuuaaauguaguaggaagaagcaacuaaaacugaaguauugcucucuugaucacaucuaauuugacauuucaguguccauuuuaugguuucuuuguggaaaagucagagugguuaguuaauguggugagaacuguacauuuuagcaagucuauacggcgguaaggugguuucugauguuagauauuuuuuaaacaagaauuaauguuuaacuuuauuuuacuaauccuugucuucuuaagguaguguguuuacuugccuuauacaucauuuugagauuguuucugugguaaaauacaccuaagaagacugcuuugacaagaguucuugguagucugauuaaaaugaagaagaaucauuugaaucaguguuuaugugagugauguuaaaagaucguauguaacagcugugucaguuguuuaagcaauacaagaugacaaacuuuaaacaagauucuuuuuuugcagcagcacuucuaaaagauugaaaacaccaagaagauagauagaauauucacuauuucucauauugaugcaauuguggugcucuuuuucauuugaaacaucuucuccuaaaauauacacuuuaagaaauagucauuucuguuuuugcauuaaaguaaauuaaagcagaaaacacaugcucacuuuuggcuaacuucaguguauagauuucauacuuauguugucuuuccuggguacagauuuauuacugaacaaguacguguaaguaaaaugucauuggugagcaggacacaagauaaaaggugaacaccacauauggugugaauuguaaaugcuuauaccacaaacuugaaaaugugucauguagagccauggaaaaugucuaguuguuuuuauguaguacacacauuuuaauggugcuaacaaccugggcucuuuuguucauagaguuauucugaaaaaaauuucauaaaagacacugccuaaagauagguagaauaggcuguagcuugauuuacuguggaauaaaaaccaaaaaaaaaaaggucuuaauuguuucagucuuuaauuaugucuauaaacuuagaaaaaggcauuuacauuugaaucuagacuaauuuguuuaguaacauucuuccucauauucaaugacuguauguaucaguccuuauuuagagacugccugcuuuuuaauucauauagcucuuugguucuauucuuuguuuuguuuauuauuuuguuguuuuauugcuuguuagaccuuuacuaaagauauuuuguguauuuagaaaaaauauaacauaaauauaugcuuuuuaaauauguguguguguguauucaucucuuauuuaaaaaccacacuguucauccacucugugccugaaaaaagggagcuguaccugggucuaauggaggaauaaaaaguaaauacuaggccgggcgcaguggcucacgccuguaaucccagcacuuugggaggccgaggagaguagaucacgagaucaggagaucgcgaccauccuggcuaacauggugaaaccccaucucuacuaaaaauacaaaaauauuagccgggccugguggcgggugccuguaguuccagcuacucgggaggccgagacaggagaauggcgggaacccgggaggcggagcuugcagugagcagagaucgcgccacugcacuccagccugggcgacagagagcgacucugucuuaaaaaaaaaaaaaaaaguaauacuagaaauggcucuuguccucaaggugucuguaaacuacuguuguggggcagacauaccugcaaacuaaaguggagaauccauacagaaacauguaauaaacauuaaccaguugaauauuaaggggugucuacugaaaaacauugaaguaagucaugcagaguuacuuacugauuucuuagaggguauaggaagaguuuugaacagaguuuguuuagaaagucaagguccugaauuagguauuguauugaggggaaagcauuucacucagagauaauggcauaaacagaaggaaaguacaaauucagaaauuaauugagaagggauagauuccaaggcuaaagagugaaguaauaaaggcgagguaguaaauuuaauaaagcauaagaaauacaacagaaagcaaguguccauaauggauccaugcagaugugaguucaaacccuagcucagccauuucacugacaccaugacuuuggaaaaguuauuuaaucuugaaccacaguuuccugcuguaaaaaagcaauauuaauuuauaccuuacugaaggguuugcauuagaauacauacaaugcuauuaguuuggcagauaguaggauuugcuccuucuuuaagaacucaguccaucucauuuccugaacuggaauuuucuauuuuccugaagccacugcuucccuuucaacucugccaaguggaagcugcugucucucacucuccuaguaucucugaggcuucuuuuugucuuuucuucuuuuucuucccccacccuuucuuuucugcccccaccuuugcucuacccucuuccuuuuuauuauuuuuuuucuuuuucccuuucuccuucccugccuuucuuuuuaaauacuuuaauccuauuucaggugaacauuauauccuuaauauaaaaaaucccuucucuuucagacuuagugauaaucaucucaguuacccucugccucuuaucacuauaauuuaauggcuucuaggugaggcucagauugaaaaacugguacccgguucacaguucucuguugcaaucaucuuauacuaccuagucaucuacuucuuuggcuuuuguaaaugcuaauccacuucagucgccacagacugaaccugaucaucacuuggaauugcccugccucugauacuucuugcgucuacacuuccuccuauuuuaucagcccuuuccuauucaaucaagagacugguugagcucuugaccacuuuucuuacagguaccuuccacauuguugcugccuuagggcauguuuuuacuugcugcaucuuugcuucaucacuuaugccuucucuuuuucaucuuuagccucuuuucuuucuauuggcuucuauaccacagcauuuaaacaugcucaggucuuccucauauuuaaaaagaacucaggcaaucuaauauaaaucgugucgugaccgugacucugcuuuagcuaguguagucuuccuuaauuucucauucagacucuuugacacucccuuaccuucaauuuauuccuaaauuuauggcaauugggguucuauuuacuaauccucuauaacuucauuuaaugaauucuuuauugcuaaauucaucagacagcuucaauucuuuuuaacugacccuauugguaaauuuaaugcuuauugccauucguuuugucuugccauucuugaccuuguauuaccaugugacugccugcucuagaugcucccaccuuugugaccuuucuuagucuccuucuuggguacagcucauaaugaugguguuccucaggguucuguccuugaccuacaugguuucuuacucuucaagugguucucacaugaaggugauugucuuccccucuucuaccugccaagagggccaggaagaacaaauuccacagcguaaagaccuguucuuucaaaugcaaguuuuauccccaaccuuugcacaccacccaaguugagagacacuccucuauugcaauuccauguguucucuuaguguuaacaauuauacguuaauuauuccugaagcccaagcuguuucuuugagucuuuuaaucuuagcugacuauucccaggcccuagaacucaguguuuugaaauuuaaaacucaaagcaucuccuuuuucuucucuaacuacccuccccugccccaucaccaacuuuuuguuucuaaaucucacaugaaccacacugaccuuguagucauucagauuagggcacugaaagucacccuauacuccuugucacuuccucacauuuuuuuuuuuuuuuuuuuuuuuuuuuuuuuuugagacggagucucacucuuucgcccaagcuggacugcaguggcgcuaucccggcucacugcaagcuccgccucuuggguucaugccauucuccugccucagccucccgaguagcugggauuacaggcgcccaccaccacgcccggcuaauuuuuuguauuuuuaguagagacgggguuucaccguguuagccaggauggucucgaacuccugaccucgugauccgcccgccucggccucccaaagugcugggauuacaggcgugagccaccacaccuggccuggcaaacuauuaaauaaagacuauuuuagauuucgauaaguacacaggaggaaauaaacauuguagaaagagaggaagggggagaaagggagagacaauugaauaacuggcgaaggcuguuaagaauguagucuaaggagaugacguuugaggugguacuuggaaaauaagaaagaaccaccuguuggaaaagcuaaggaaagaauguuucaggcacgugguauaccaagggcaaaguuuggaguggaaaagacuuggcaaguugaaccaagagagaggccggggugguuggucuguggucuguaaugggaaaggagcagcaugaaaggaagcaggcaggagcuaaugcaugggggccuugcgagccagucuaggaggagagugauucuuagucuaaagcggugggaagccagugaaggacuuuaaacagaggcguggaauauagaccuuaaaagagauuuuguguagguaugccuuugcuuaaacauuauauuauaggaauuuuaaauaagcauguauuacuuuuacagaauuuaugguacaucaccauaguaugcaauuauguuugauuuuaucccucaguguuuuauauggcguugcauuuuguuguauuuuuucauugaaauauuuuauuuacuuuuaaaccaguaguaaacauuuuuuuuccugugaccaucacugcacuggucaccucauuuauuaaggaauaaaccaaacuacauauuaucaacauauuaucaaugaagaaauuuguuuuaggguuccgguagaagaaacugacaguuuauuuuaguagccguuuuagugaaauuugacuaacacacacaaaaaucuauccuguuaaaauaguuuuguucuagaagcaugauacucauaaauaguuguuaaauacuuauuuguguuucucagccagaugucacugucauaaggauguauuggauugcaauaccuaauaaaguugauuuauacauacccugauaaaauuugagcuuuuaguuaaugcuugaaugauuuuagcagucucuugcagugcucaauacccuugaacuugcuucuuuuuuuauauccuggccuguuccugagaugguuauauuucagaugcacauuuuaccuauaaauuugagaguuuucaucugauacucuaauuaaggaaauaugugaguuugaccuuuugauuucuguccuguccuuauugucuuucaggaagaugauuagacagaguuauaugcuaaggccucucaaguauuuguuucagcauaacaauaggucacauuuucaucuaguuuaaaucuaauuuagagauauaaagaaucauuuucaugaccuguuaucugagaaauacuuugcuaucaugguuucuucuucuuccccaauuuacccucuuuacucgcuauuacuagaccuuuucaugguuagaaauuuaacuuacugcugucuauuucaacuuagaauguaacagacuugauugccucuuccgauagggcaagcuagacaucuaaauuuuauaaauugauuguauuggaagcaguagaucauguagagacuuuaaaaaagcuguauuuaguuuuguuuggguccauuagugauacacuuuaaaugugaauauuagaaaaccagagagucaaaaaagaaagagucaaagauuacaacucuaugcaaauauuauaggaugaaggauuuuuuguuuguuuugugcagaggggccaaguaugacuuaaauuugcuaugaucaugaguguguuaacaaguaauguugguagaauauccuuugucuuuaaagaggcuagaaaaauuauaggaguuuaaacuuaaagcuguuaugauuugggguuguagaauaugauuugggauuauagggcaaggaaacuuuguuuauagcacuuguugacauuaacugggaaaaaaagaaauaauuagacucugugguuagcccuguuuuaggaaucuguggcuaauggaaaaucucucaauuggaucaguacccucuuuacuauuguaaaucagucuuaugaaagcagauguuuguggaagggugagguaacuuacauccuugcuuugcuugaugccuguggggacaacauggugaucagcuagaagaggugcuguaaccguucagaaucauguagguugagggaaugcacaugauggauuucaggcaaguucacagcucuuauuauggcuguuuaauauuguuuaaauauccuagugcuuuauagcuuaaguuaauucuuguggucaaugggacuuuccaacuucuaauuugauuuaguacagcaguaguaaauagaagaaaaauaaugcucauugccuaauaauugcuuauaauauuaaucaggucauaaucucuuuuacauaugaggaaguaagaaugauuggaagccgucuuauaaagaugccuaccacaagugguuaaggcuuuucugucuuuguuuauuuuaacuaugaauuugguuuuuagaguuauuaacccuuuagguucuagugccuuuucugagcuaucuaguauugaaagucuugucauuauuuuuaacauuuucauauguagugaacuuuaucaauaauauauuuaauaaaaugaaacaauccuuaaaugcagaggugaagugaguuagggcaagguguaugguaugaaaaagaaaggucuuuaucucacccuaacacuacccccucaaccuaacauucuugcucacugugcuuuauauacauauuacacgcuacaucauacuuuguuuuucucuaagcauacuguuugucuuucugucucuacauuuuuuauugugauuccuuuuuuccuucuauuugaauacaauccaucuucaccgucuuaauucguaccuccuucgugucuaccaguguuacuuuuuuauguacaacuucugacucuuuuugaacuguugcuuauuugugacaucuagacuauauuuuuaucccuuauuauauuaaaaaucauauauaaaucuugauuugucagcuaaauucuaauuccuaugaaggcaaugauucucuuccauucuucauauauccuccauuuaauccagcaccaagcacguaauagcucaauauuuauuauuaguauaauuguagguacaaaaagcaauggaguguuuucguugcauuaguggucuuggaacuuaaauaugaauauuuuuucugauuucccuugagauuaaauuuugacaaugaaagagguaugcucaaauaacagacgucuguguucacacuauuauuggaaaggaaguuccauuaaaggaugcucaauuaccugcagauucuuugaauaggagcaaguauccauaauaugugauguuauagguuuuuaaauauucuagaacucugaaaaguaauguguguguaaagguagaaggaaaacuggcuuucaguuuuugaaaaaaucacaaaccaacacccuaaugauuguuguuaauauauaaaauacaaauaauaggacaauauuacuaguuuuuauacuugaguuauauuauucugaagaauguuuuucaaaaaaaaaacaguuguuuucugcaugcagaaaguucagaggucaaugucagguaaauggcaaagcagaauuuguuacaaauaaaguuaaauuugguuucuguaaugcauuagcuauaugaccuugggcauauuacuuaaguaacccuuccgagccuuaauuucuucaccuauaaaguagagacaguaauaacuucaaaagaucagaucgagggcuagaaaagauaggucaucugaugcgucaagcacauuaccuccucuucauaggcaucuaacccaugcacauuguguuuugcuaccuuucuccccuucuuccucauguuaguuacacauuauuuaauucuaaaccuuacuuaaaauguugcccugguagaguaucauagcacauguugauaucuguaagaaaguuauuucuaauucuagcaguaauccagugggaaacuagacuuagaaaaggauguuaucaauaaugugacaugaauauuuuucaaagaauuuguguauuuuuugguuucacuucaaaguaaugaguuugaaaaaauauuaaaauauuuaauauuaaguuuaaaaaauacauuaagacauuuuuuguuaguuugaagugucauauaauuuucugaaauuagucaaaagaucucucagugacaaaauaaaauuuugccaaguuaacuagggaaauaguauuauaaauaaaauaauuuuaaccagauccuuugaggaauggaguuuucuggcuaacaaucccuuuuguuucaccucuucacauaaauguuuacaagcauuaugauucacucucaugccuuagaguaauagauguauagaauauaggaacuucuuuguagacugaggaucuuucaucauucuaaauaauagcuuuuaucguaugacaguguggaugauggccuuauaagcaggaggagauuaggcucuaaguaaucacagggcauauuaugaaaagugaccagccuccaccauccccuccucccauucucuaaucccuaaucaguuuugcuuuaauuuucauguccugacuucugaaaauggaguauagaacauuuccuaacaaguugagagucugggucuuagaacuuaaaauuuauugaaggagacuugggagauuauuuagccuaacacccucauuuuauagauuaaaaaccucugaggcauagauuaauugacuugcucaaggauacuaagcagauucacuaaaagaaacaaaaauuuagguuuccucauuaagcugacacuuuaacagugucccaaauuuuggugguuaucuuugaucuucuuugaaacagguagaucgacacuugagaaagcuggaucaggaacuggcuaaguuuaaaauggagcuggaagcugauaaugcuggaauuacagaaauauuagagaggcguaaguaaaauuuacaguuuuccaucaauauuggacaguacaugugcaaaucgcugagaagaccuugucccacagaggcuuuugaaauccugcccuucaauggaugguggcauccaggccagauagcuuggacccuaacaguuggaaauguuugggucaugcauacugagagagauaauauaggauaucauccacucacucuuuaugaaacaacauauuaaaucauuuuauauccacauauacuaguaaguugagugguaagaacaaauuuaaagaaauguaaccaucgggagacaaauuaaccaucuugcauuaaguguguugacuuuacucugccucuuuauacacuuaagcuuugaggaaaguuguuaguuucucuucuuaagaauuacuuuauggcuuuuccuuaacugcauauacugaaaaagacucacauugguuucauaacacuaccucuuuuucuuaaagaaguguuuucuucuuucccuuagcagcaagaaaccauuuugauauuucuuugcaaggcucuauuugaucuccugcuauaacuuaccccugucacuucuuuggugugacuucccaaaaauggaagcaugagcacuguuuccuuaacuaauuuagcauuucuucaaccuaaauagguaauguacauaaaagcaguuagugugguacuagguguagaguaggcacucacuagauguuaauugaaccaaauuaauauuauggcuaauuucuacuagaauuuaauuaaaacuuacaaaccuucuuuuucuuggugcauuucaacaguaagaauauguaccuguuucuacacacagaugaaagauuucuuuacagugccaaucuauguaucucucuacucacuagaagucagcuagggaagccaaucacagaucugucuugguauccauaguugcauuuuuguguucaaaaguagauccaucacuuuagauaaucauccuauuuauuugugauacuuuucuucuggaggaacccuauauaaagauaauaaguauuuugagacaaaauuaaaaauucuguaucugcuuugauuuuuuaaaaaugcugaugauagcugugaguaaugauaauucaugccuauucaguacugcaggaagguuaauaaagcauccucucuaaggacacagacauaugaaacaaaauuggaucaaguuauaaaaacugcuccacccugugcccugccauaauuucaucucaagggaucaaaaauaaacccagaaaaauguauuuagagguauuuuaaagcuugguguuagagauucuauuccucacuuuuugcgaacaaaaucccuaacuucuuuuaggaagucuuuauuaucauaaugucauuuuaaugaucaaauaauuuuuuucauauaguaaugucccccaucacguagaacuucagaaucucccauuaaaaggucuucaacucaguaaaacuagguugacucuuaccaguaaugagauuacaauguccauucauccauuuauauggcacccacuauggugaauucccuaauuagacacgaguaugccuugagccauuuuguacuuaagauuaauauugggaaaaggauaacuuauuguuuagagagaggauaacucagugugggauggacaguggugauccucuaacaugucuggcuaaaauaaauacaggcauaugcaucagaacuugcuaguccucugcuggguaagggaacucauugccuguaguugagugacaugugaaguucugcggugacauuuaauggugguguaucucugugccucucuucuuuuaggaucuuuggaauuagacacuccuucacagccagugaacaaucaccaugcucauucacauacuccaguggaaaguaaguuugguguagugcagcuaaguuuuaaaaacaaugaaaaccuuauuauaucaccuauauguucucuuuuuuuaacucuacacaaccaauugagaaauaaaucccuucuuuuuuuuucauugcaaguacuggcagacuugucuuuuuccuuggggggagcauaugugauucggaaaugaguauucuguuuucucuuaaaugcguagaaggagaauguauaguacuaauagcauauauucccuucauacacauaccugauucuccuuagggagcuuuucaacugagcauucuccuuagggagcuuuucaacugagccaaacaauaagcuauuuuguaauaggcccuuugucuuuuucauccuugcuucuccagugcuuaaccuaauguuuggcauauaauuaagucugaaugguugguaagucagugaguggaugaauuguuaguuagaugacuggcuggcugguugguaacagucaaaaaaugacuauaucaguacaucuuuugacacaucaauuuggugggaaacuauuuuaagugguagauuguguuuugaaaacaaaauuucccucacauuguaugugagcccaugguguaucuuggguuaucuuuaguacuuugcuagaaguuuuuuaaaugguggagaagucuacucuuaauaaacaugugacacagaguucugcuuguccugccuucugaggaaacaucauguucuguauuuuaugaggaacccagaucauacuguuucacauuuuaacuggauauaaguauuaugccuuguccauaguucucuaaaguuuaaaaacacaugaauuuuuuauuuauauuuagaaaggaaauauaauccaacuucucaccauacgacaacagaucauauuccugaaaagaaauuuaaaucugaagcucuucuauccacccuuacgucagaugccucuaaggaaaauacacuagguaaguuaauuuucuuaaauaugauugcuuuguuuguuuguguuagaguaaggggaaauaaaguguuucaggauuaaugaaucauacaguuucuuuaccugguuaaaguauacauauggagaaagaagaaaaaggaaaaccaaauacauuauucaguugacuuaauguacaagugacauuaaaaauuuuaaugauuauaugucugugcugggaaauaauguaauuuagacucacuaacauuauguucucugcaaccauuuuuauuucuuuuuuacaucuacacagguugucgaaauaauaauuccacagccucuucuaacaaugccuacaaugugaauuccucccaaccucugggauccuauaacauuggcucguuaucuucaggaacuggugcaggggcaauuaccauggcagcugcucaagcaguucaggcuacagcucagguaaaaaguaaaggguuuagagacaaaauguuacauuuugucggaaucauuggaaaccuaauagaaauaacgggaugugaacaaauaguuuucuaacguuguauauuuucauuuuuaagucaugauuucacgauaugugauauuuuauuuaaugaaauaauacauaggaauugccugauugauaaugaaaacuaaaaaauagguuuaucaugcggauuacaugcagacccuucucacaauaacugcucauguugcccauguucuugacugcaguccacagcacaugcuagcauaguucuucguucuuucugccaguuccaaggcuuccccuguagccuuggacuuaggucaucuugaguuuguucacuucuguauaguuugccuauauuccaaauuaagaagcugcccaucccauaguuuauauucuaacuguguaaaaucuuauuuuaaaucuuuaaaugaaaaagguuaggccaggcauggugacucacaccuguaaucccagcucuuugauaggccgaggcagguggaucacuugaggucaggaguucaaaaccagccuggucaacauggugaaacuccauuucuacuaaaaauacaaaaaaauuagcugggugccuggugggugccuguaaucccagcuacucgguaggcuauggcaggagaauugcuugaaccugagagguggagguugcagcgagccaaaaucgugccacuagacuccagcccaagcgacagauugaaacuccaccucaaaaaaaaaaaaaaaaaaaagcuuaaauuccagugaugaaaauaauaguuuaaacaauauaaauuaacauuugauaaaccaaaauaaaacuauaauuuguaaaacuugaaaaagaaaaucuacauauuuacauauauugaugcuaucaaugaaugucuauuuaagaugaaggagggacgaagaacaucaaguuuaaaagccaguuaugaagcauuuaagaauaaugacuuucaguugggaaaagaauuuucaauggccagggaaacaguuggcuauucaucaucuucggcacuuaugacaacauuaacacagaaugccaguucaucagcagccgacucacggaguggucgaaagagcaaguaaguuuuauuguuacaguagcccuauaccuuuacugaacacuuggucuacuugacacuucagccaggccucucuauguuaaaggcaggauauaacggauuaaaauuaaccuugcagagguagggagacaugcgguuuucauuuuauagugccauacuuugaaggugucaagucuuuaaaaaguguuagaguuguuuuuaauuuuucuagagucauaaauugaguuuguuaauacaugacuucuuuuuaucuucuuuuauucauuaagauaaaucauuuuauggaacugcuuuucauuuauuacccuuuauuuugccauguguuucaagguaaauuaaugcaaugcaaauuauauccuggugauuuuuuuuuuuuaaacaagauuuuucauuuugauuaacagcaagcaaggcgucuucauucuuagucuugggucccaaaaacugaugguguaaaaauaucccuagauuuuguauaugagacuugggaugacuguauaagcuuuaaauaugaaaaccuaauagcauuuaucacugucuaucccagguaacugaauaugcuggguguuuauacauaaugaaaguucaaaugcuaggccaaaauaauuaguuaccuaguaguuauauuuucuguauuuuaaaauauguuauauuuuuugugaauuaaucccuuaaagaacgaucaauaugaaauaaccacaacagaagugucaaacaucuuaaaaauuaauucaucuuaaugguacaaguuuaauguaauuucuuaugauaaaguucuauacuuuuagaauuuaaauagcauagggcuuagcaguaaauuacuugugaauuuuuacagucuugguucccugccauacucaugguagguauucacacaucaguugaugguuauaaccacuuucaucaaauguuuuugugugugugugcuuuagguuuugaugaagaguauucaguuuacuuaaaaauacgaauaaugaguggcugggcgggguggcucaugccuauaaucccagcacuuugggaggccgaggugggcagaucacgaggucaggagaucgagaccauccuggcuaacacgaugaaaccccaucucuacuaaaaauacaaaaaauuagccaggcaugguggcgggcgccuguagucccagcuacucgggaggcugaggcaggagaauggcgugaaccugggagguggagcuugcggugugcagagaucgcgccacugcacuccagucugggcaacagagcgagacuccaucucaaaaaaaaaaaaaaaauacaaauaaugucuguaaaguagccagaacuuauguuaauucuucaaaguacuaccuacaauuuaagucauugguaaauccggauuacuuuagcuuacacuuuaauuuauacauuugaugucauuucauuuuauacuauuuauuuaggaguuauucucaguuaacuucuggauggugagcaaauaaaacuuauacuauuuuuuucagaaacaacaacaagucuucaagccagcagucaucaucuuccuccuccucuucuuccuuaucaucguguucuucaucaucaacuguuguacaagaaaucucucaacaaacaacuguagugccagaaucugauucaaauagucagguugauuggacuuacgacccaaaugaaccucgauacugcauuuguaaucagguaaaagucuguuauaucuauaaaaguauaaucugaauaaacuagaaggaagagaacuauuucauuuuuaagcacuuuuuuaaacucacuuaaaauaccuuugcuuuauuuguauacuuuucucccccuucuuacaaaagugacauuugcuguaaauacugaguauaaagaaaaauguuacccauaauccuagcccucagauacaaccuguaacuaaacauuuuugguauaccacuaccauauaccucaugugcacauuggcugccuuaauaaaauacaacagacuggguagcuuaaacaacagaaaauaauuuucucacagguaugaaggcugggaaguccaagaucaagguguccacugacucaguucuggaggagggcucccuuccuagauggagacugcugccuucucaccggguccucacaugauagagggagaaagagugugcucuggugucuuuucuuauaagggcaccagccuugucagaguaggaccccacucuaugaccucauuuaaccuuuaccaccuccucacaggcccuguuuccaauuauagucacguuggggguuagggcuucaacauaugauuuugagacauaagcuugcauuucauaacacgugucuaugcagauuugcacaugcauguguguauaaguuugucaguaggaaccacaguguauacuuucuuguuacuggcuuuuuucucuaaaucagguauaccgaacaugauuuuucuuuaagaucauauuuuuaauuuucacauaguuaucucuuaugccauccaguguaguuuucuuaaccaauaccuagcuauagauuauauuagugguuuuaauuuguuugaaauuagggauaauauuacgauaggcauuuuuuaaauguaauccauuuuauacaucuaauuucuuggauaaucuuuuagaaauaaaauuaggcuguaaauauuugacagacaccaaaauauauuuucuagaaauuuauuaccaaaaauuaauaaacauaccgguuuacuaaacccuguccaacacuggauauuauuuucuuuuaaaaacuaaguaccaauuugguaguuuuauauuaugauuguuuuaaauacacuaguauuauugaaguuggacauuuuuugaccauuuuuguuuuuuacauuaugaaucgacuccuaauggugucggcugauuuuucuauuguuuuuguuauguacucuaaauauuugcuugauuuaguuuuuuaaaaauaauucuaaaauuuuaauuuuauguaguuaugacuguuaauuuuuuuuuaugaagcaagccauggauuauauacuuagaagggcuuucucuuuggcucuucuuucuacaaaaaauugucuuguauaauauuuucuccuaguuuuuauaugguuuugucuaguucuuugcaugcuucaguuucuucacauuuaagacuuagucuaucagcagauuauugugucuaacaguaugaguugccagucugauuuuuaaaaauuuuaacaauuuguuagcuguuccacuaucacccgauaaacauuuuucaguacaaaugauagaaaagcauauccuguauccugacaacaaaaguagauuacuugcaaaagaacaaaaucagacugaaccuagaguuuuccucuguaacacuaaaaaacuagaaggugauggaauaugucuguagagcuuucagggaaaaauuaagagcccccaaaaacuugauauucagagaaguuauuucucugcauaggaccauguaaauauauuuucacucaugcagagaaucagaagauaugccaucuaguuaauccugucugaaaaauuauucaauccacugagaacuucagugaacucaagaauuagcaaguuaugcccuaaagugcuggugaugaagagcaaaagaaaaaugagaaaggacauaaaauagauaaguuuagaaguuucaaggaaggagacuauuaauugcaaaaauauaaaugaccuaaugugacccaagaaguaaaaacuuucaguaaguaaauaaucaagaaaggaacuuaaaauuuuuacaauaagaacuacccagaaagaugacuccuucauccgggugauuuauaugucaaguucuuccagacuucugaagggcagauaauuccugugcauuucuucccacccuugccccacccugcccaaaagaguauuucaggaaaaaauuauuauaccuugauucucaauguaauuguauauucaguguauuucccuuuauuuuccagcaguaucauacauaaacaguuaauugguaucuagguguuuguuacauagucauaauaaagacauuuaauuuuuuuuaacuagguaucuuauggugagauggugggaugugauaaccaagauguaaguauuacauuuuucuauuuaggaaugaaaaaaaucacagguuguuauuacuugaauauuugucuuauuugcuguaugguuuggucuaagaaaacagguuugcagguauauuaguuauauuaugcuaaugcuagaauauuccucuucaaaauaggguagugucccuuaauguguucccuauuuuaauuuuuaaagcuaauuuuaugguuuuaugugcagauugucucagaaguguuauguuguaugaaaauuauaaauacccuccuuucccuuuacuaaaaaauacuguguuuacuagaauccaguucauuuaucacauugaagaaauggaauuuuaaaacaauucauucuuucaggcugcaccgugcuaaagugaagggugggauaauugaggaucuaaugugagauuaucuuccucucaugaguauaauauuuuuuccuguacucugcaggugucagcugauaagagccaccccugaucuaaaaaguaaaggaaauuugaaaggaaggaauucuugguuuuuaggagacuuaauuuuaguuagagauacguuuuuuauucaauacugagaauauuguugucuaguaauuuugacucccuccuuauuuaguagugacaggauccuaagauuaacaagaguuuuaaauuuguaaaacaaucugaagauugagggagcuggcuaggugcauuaaaauguguacuuuuccuagaccugauaggguuacagcaacaugcucacguagauugggacagagccuccuucuguuucccugucuagaaucccuuguaggcuguuugugguuguugcaaaaacaauauugcccaaccauuucaagaacaucacuguaaacucuucuggggcaguuagugaaaaugaugaaugagauuucuaugaguaccagcaucaugcuucucugauucuucuuauucccaguugugcucuucugagugcuaagacuuucaugaaagaguuuucugcuuaauauguuucaaagaggaauaauuuuucucuacauuucaaggaauagaaacacccacguaggaaaugcagggcauaagacauaaauuaaugucuuuaauuacaaucagcuuauucuacuuuaugagacagcaaauaaggcugacuauuaaauaaaaucuuaaguuauauuuaccuucuacauagaagauucaucccacuucuuuuugcccuugaaagcugaaaacuagugaauuuucauucauuaggaugaggggacuagauuacauggaccucaggauucuugaagaugcauaauuuuucugugccuucauuuccucauuccugaagcuuaucauuuagucuaaaugaugucuaaauaaucuagaucuaaaaauucugaugucacacaucuaauuauuguuaaauuaaauggauuauucagucuccugagcauauuuuaauauacucucuugucuucagaaguacugaaaacuuguuuuuugcaauuuugcuuucuagugcccuauagaaugguuccauuauggcugcguuggauugacagaggcaccaaaaggcaaaugguacuguccacagugcacugcugcaaugaagagaagaggcagcagacacaaauaaaggugguccuuuuguuugaugaagaaauaaacuucagcugaagauuuuauauaggacuuuaaaaagaagagaagagaaagaagaaacaaugcauuuccaggcaaccacuuaaaggauuuacauagacaauccuauaagaucuugaacuugaauuuuauggguuguauuuuaauaauguaaguaaauuauuuaugcacuccuggugugcuaugaauauuauuccaguuagccuuggauuauuucaguggccaacauaugcagacauuuguacuccucaaccauuuucucaaaguaaugggcauucuaugauuuagacuucaaggaauuccaaugaugaagauuuuaaggaaaguauuuuauauucaacagguauauucugcugcauguacuguacuccagagcuguuauguaacacuguauauaaaugguugcaaaaaaaaaaaaaagucagugcuucuaaaaagaauuuaagauaaugguuuuuaaaaugccuuuauaauaagcuuuguuucuuugugaaacuaauucagcaggcugaaggaaaugguucaugugauaaugugggcugguauccucuagaguaccuggguacauaaacagaaacuccuguagguaaaaaguaauuugugccauuagucuuucuauguuucugcauccagauagagugcaguucaugagggagggggcgggggacugaaggggaaagggcguuaaagugauacauuuuuauaccaaauguguuuauuuuuuugugcaaguaauccuuaaaauugcaauuguauuagguguuaaaauaaaguuuuuaaaaaauuacuuguauuuauacuuuacauacuuaauaaugaaaauuucugaauuccaauuaacuuucaacuuucauaaucuaaaaagaaucagagacccaggacacagaauacuguguaaucugugaugucuuuaaugauguuuagaguuugugauauaagaauacaggaaagacauuuuuaauguaaauuugaaaugccaauguauuuuuuuaagaacaucaucuggcuuuuccuucagucuaaaagacaugaaagaaguguaaguauagcaguuaaaacgaaaauaaugguuauggguguuuugacuggaggcaauguagccaaauagaguaaagagaccccccuggucgggagcuccaaauugagcuauuuuugauucuaccacuuacugauaugacaguuaauucaaauuuuguaucacucugggccuuacuacaccagggugaugcugacugcagaauagaucuuauucuaaggugcuauuuaaauuauaaauuugcauaguggagguuuuauuuaaaguauaauauugagucuggucgauagaaaaauccuuaacuuuuaagauacuuaauauaucauauauauuuuauauugaaacuuacuggguccaucagauuucugcuuuaauuaaaccacuuaugagcuucuuagaacuuauucagauaacaguguaaaaucuaugcagugcuacccaaagggugugagguagauaggggauuucaaagaucucuuccaccuuugagaucccaugauucugagcugccacagucugauuauacaacucuaccagcucccuaaacaaguuagguucauuugugaguacucaucauuucauaauaucaugauuaucacgauuucaugauacucaauauuuugagauuuuauaacccuuuaagaagugauaaauaauguaguauucaauucguuuaucaaaguauauugccuggaaaugcucacauguaucauuuacauccucuauauauuaugacuauuccaaacucauucauuuuauagaaauggucaaaggaaaaagccuuauguacagccuuauuugaagagaaaguucuuugucugagucaggaacauccuguuauccagcugcuacauccccuuucagugugaauuccacuccuuaccaaaucacuuagaaaacacuuugacaaguuuuaaacucaaacacugaauauuuuaugaagcauguguaaagaaagaaaccaaaauuuggugcagguauuuaguaauggguagaaccuguuaauaucugagucauauauaauggggccaaacauggaacuaccucaucaaccccccaaaaauguggccaacuauuaauauucuuugugacauuuacaccaaggggcauaguaaguauuuuugguauuauaaaauacacauucaaaaucucuguuguacaaaacucauguaacaguugggacaaaauauccaaauguggguucacaguucacagguggugaaaauugaggccuuacugcuauggaguguauaucaaaauguucauggugacacauuugaagcaauaaauggcuuaauuaaaugccaaa

SEQ ID NO: 14547 - RNA, 48054 nt, Homo sapiens
ccgcucuccggcccuucccucuggccggcccgggcgcccgcuugguccuccaccgccagggggcgggcgcggcuucccggcggcgggggcccauuggucgcggccgggaagcgugggaggaggcccagcggcgagcuggcuuucuccuggccacuugccggggugaggggcagccggaggaguccgagaggaagcggaggcgcgagcuggaggcggcggcucccgucggccuccggcaggacugagcgcugggaggccggaaggcgggcgcgcgcggcggagaggcgggcgggaggccggugagacggcugggaggcggacggagccggggcucagguucggggagggauggaggaggccggggaagccagacgcccaccuacgacuucagccuccgcgcacugcggucaccggccgggggcgggccccgggcccggccgcguugucacggcguguccggacguuggagagggcgcaggcgggacuggggucccggagagccgcuggccgggguucccggccgccgccccggcgugggcauccccgggcuccgcggagacggggcggcgucugcaccuggcgcuggcacucggcgccccggccuggggcgggcaccugggucgcaucuuccccagguuggcuguggcucgcgccccugcagcguguaggcugagagcuccgagagguggggacggaguuggguguugcauuccaacuccauagggggccguuuugacucacuuguaaaguuuuagugucgccuauacuagagguacuuuugguuuuuuacaagcuauccagcccuuugauguuuggugucucuucuuuuucuuccuauuuguuugcuacugcucucacagcucgggaccacggaugaugauuaguggcccuagaucugaauaugugagugacggauuggcaauuugagauugagagcuccagcuguuuuacuugugggaggagcgguuuccaucauccucuaccuuuuuuuuuuuuaagaaaaaauauuauugccuguaauauagaacugcuaucuaauugauaggacuuuuccuuuguuucuuuuuggccaacauggugaaaccucgucucuacuaaaaaauaaaaaaauuagccagguguauguauccauauauauauauguauguauguauccauauauauguauguauccauauauauguauguauccauauauauguauguauccauauauauguauguauguauccauauauauguauguauccguauauauguauguauccauguauccauauauauguauguauccauauauauauggauacaaugacauaaauaauauuagauugcuuacuguguacuaggcacugccaaaugguuucgugugcucauuuauucucacaacagcucagugaauaagucccuuuaucuuuucuaguuuuacagauggaaauaugaacucccgagaguaaaggucaaugcugauagcagaggccccgaccccuuggacuuguggccaauuugcaguuacguuuucuuaagucuugggaaccguuacuauuagucauacaguaucuuacagaguaccagcagaucucuauugaauuuagaaaauaaaaguuaaucacuuacugaaagccauuuaacaagaaauuggcagaaucagcaaaucagcauccgguuuuggucacuucaucgaccuguaccucuuucuagaggcuacuaguagucucuuguguuucuuggcuguuuaccaauaaagucacaagguuuucaguuuuauacagguauuagaagcuuuguuucacagauucuuguaauguuuucucaacucaauaaagacuagcauuucuucauaggaagaaauaagaagaguuggagccaauaaaaggaguucaguccagcaguucucaaccugaggaccucucugaauuaccaaugggaacuuuguaagagggacacaggacagguuccucaaaauccucauuguaaggggcuucuguuucaaaagggaguaaaaauaagacacuacuggcuuaaagugacuuuaaaaauaaacuuaauggauguuuuauuacaauuacagauuuuuaauguggauugcugccuuaagcauugucaacuaaucuuucauaauuuaugaagauacauuaaaaaggaaaaggaaauuggaaaagacagccaaaaggcuaagaggcuauggaauggcaaaaaguaauguucccugaggggguaucagaagacucauauauuuuccaccauauauuuuagguuuugaacgauucauuuuucaaaaauuuuuauacucuuaaaaauacuggagugccuaccauguaccaguaauuguagauaucauggauacuaugaauaagacagccugggcacucacaaagcuacuuuauuuucucuaaagcagggaaucuuuuuuauuuuuauuuuuaugcccauuucuuaaagcugaaaggugcaagacccaaauagcaaaagauuuuuauguuagcgcugagcuagauagauuuuugugcgaccuugguauaauagcaaaaguuugucuugaauuuaguccagaagcgucucuguucuugggaucagaugaucaggauuugaagcauugauucuguauuuaguuauuucaagaguggcauugacuaaauuacuuaauaucaugcaguccuuuuuaaucugauugaguagacugaaccagguaauuucccaaaaucuuugaacuuuuaaaagguuuuguacuuucuuuuaaugcaauucuuugagacacaaucggcugacuuccucucagaggaggaaauuaaguguuguaauaccccuaagucuuuccaguguacccauuaauauucuuuuucuucuucauuggccugcuccauuugauugaagcuauucuuauauuucccuuauuuuuaaucuaauuuugaaaauccgcuauucaugauuuuucuaacuucagugaguuuuuucuuccaauuuucuuuuuuaaauuaaauuccuguaacagaauuuuucauuuuauuuuuaaauuauuuacaaagacaggguaccccacuguucugcagacuggagugcaguggugugaucauaacucacuguagccuugaacuccaccuuagccuguggaguagcuagguuuacaggcaugugccaccacacacgacuaauuuuauaauuuuuuuucuuaaaagacgggaucuuacuauuuugcacaggcuggccaaaucugcccucaggugauccuucgaccucagccucccaaagcucugggauuacagacaugagccccuaugccuagccagauuuuccauuuuaaaguguggcauuuagcacguucaugauguuaugaaccgucacguuucuaaaacauuuucaucaccccaaaaggaaaccccauauucauuaagcaguuguucauucccuucucccugccaauccucggcaaccacugaucugcuuucugcccccauaaauuuaucuauucuggauuuuccuaaaaauugaauaauucaauauguguucuuuugugucuggcuucuuucacuuagcauguuuuagagguucguccucuaaaucagcagguaucaguacuucauuccuuuuuaagggugaguaauauuccauucuauauuccauucauauacaccacauuacauauauaucauuucguugauacguacugcauuuuguuuauucauuuguuaaauuuuugugugcuauucagaaaguuauaugaacaucucuaaauugauuuucgucauaaucucuacaaggcuugcuaagguaguguuauggugucaggugugcuaccuaacauaucauucauuacuugcaguuaagugauuguuaaaugaguuuugaaagacgcaaggucaacaaaaauggauuuuuaaguugguucaguugauacguggugugguuugguucugcguccccacucaaaucucaucucaaauuguaaucccugugugucgagggagggaagugauugcaucaugagggcggcuucccccauguuguucucgugacagugaguucuuacaagaucugaugguuuuacaaauggaaguuuuuccugcacucucucucuucucucuccugcugccuugugaaaaaggugucuguuuccccuuagccuuccuccaugauuguaaguuuccugacaccuccccagccaugugggacugugagucaguuaaacuucuuuccuuuauagguuacccagucuuggguauuucuuuauaacagugcaaaaacggacuaauacaauacguuuucacaaaauuuuacaauagaagcaucuuuagaguuuauuugaacaaacaauucaugaauugagcagcuccaaaccagaucugggagcuccaccaggggaauccaggagggaggcuuuuauaggagggucacagauguaaagcaaagaaaauauuugauuggcugcaguuauacaguuguuuuauuuggucugucguguuggaagguccccuagauauguaauuagaaguuuguuggauguuucugauugauuaagcuuaaguucucuuuuucuuuagcauaggcauuuauaagaaguaacuucauauuuugcuuauguuugcaaaucaagugagguugaugucacuuaugaggccuaauugguuuugucugcucggggauucuucaggcaugguuuccauuuuaauuuacuucagcagugcuaauucucauucaguuuuugugguacaaauggugugccaauacugcauuucauccaggacccuugggcgauggaaccauucuguuucuccaugucuucauuuggagggugugacugauggaauuaugucuacccuggugcacuuaaauucugcagacuacuucaaaacagcauaaguagaguggauaccuaagggaauucuuaaacacguagaacaggaaccuauaacuucucaucuaguacaaugugagauaguuacaugagaugaagauagcaguucuacuguauguaaauguguaccuuucucuaaucucauuuuagcaguuuaugagugggacacuucauuaccccauuuauguucaaccucuaacaguuaauauauuucauuuuauuguugucauuguuucuaagaauagcuauuucuuucuguccauccauucauucaucuauccaucucucccuggaugguguacuauaggauuaagguagcuuagaucacaaguguuuaaacaauuguagaacucauagcaggcaaaacugaaugucauuuuguagaguucugucuuguuuucuguuuuggguauguuuguggucuugguugcagaaauccagucaccauuucauuucguuaaguggauuauaacuuuuuaagcaaaauucugcuuugguagauaauaaaaacugcaagaaaacauuugaguaauauuaaaucuaguacucugguuuaaccccugcaaacaggaguucuugauuauuuauuccucaccacauuuucucuggauuuaucuguugcccaccaaaacugaagacccauucugguggcagguugacuguuccagaaagaaugaaaaaucuugucaugugaauuuuacuuuugaacuuuuuugguuuagaucugccuuaccuucccccccccccccccccccgccccacacagccuuuccuguguguguggauuggugugcuguagaucugaagcucucagaucugagcacgaaugacagucaucuggggagcuuauuaaacaugcaagagcuuuaaucccacuccuagggauucugauucuccagguaugcaguuggcucaggaguuugcauuuuaaaaaacacacuaguaauucuggugugcaugcuauagguaacccuguaguaagagguucaaagaacauaugauguuucauugaaucuaugacgccacagaugguaagggucagaaucugguagcuuucagcugcaugacuccuaagcccuaauuuccaaucuuguggcuaauuuguuaguccuacaaaggcagucuaguccccaggcaagaaggagguuuguuuugggaaagggcuguuaccaucuuuguuuuaaacuauaaacuaaguuccucccaaaguuauggccuaugcccaggaaugaacaaggacaaccuggagguuagaagcaagauggaguugguuaggucagaucuuuuucaccauuucaguuauaauuuugcaauggugguuucacuacuaagaaauaaaaaugugguuguaagccuuauccugaguuuaguuaaaaugagggaagcaagaugcaaaaugaguuuaguuaaaauaaauaggguauuaagugccuggcaaccagagguuccucuuauuaucuuaacagguuauuaugaagcauagcagauaugagauuuuaaaaaauuacaaagcaacaguucuucagaucuuuuaccauauaaauuauuugauugcaaugaggaguuuauauaagguguccuuaguugacaucuauuuguaaugaaaauuguacugaugacuuuguuuuaaaaugcaacuuagguguauauggggguguaauagacuccaguuuggccccauauuaauuucauccuacucauuuccagucauuuagauguugcuggcucaguucagaagucugauuucuauccuccuuguacuucagugauuccuguuuuguaauuauaguccacugaaauaguaagguguggcauaaucauuugaugucuaccuuuuuuuuuuuuugccacuuuccuguuagagaguccacagcccucauuaaugccagcuaggugauuauacacauauauaccagccgcauagcaucuuguacugaguagugguaggauguaauggcaauauuugggguaaacaccaaaucugugucaguguaaaccugaacucuggcugccaacucagaaaugcuguaguggcauauuggguacugaaugagggcuuaucuguagguuagaacaaaucuuuccccauuaaugagaauucagugaagagcaaccccaccugcuuaaggugcuuccuucaguaguaguagcuuggaaaacaaaauaucuuuuuuaggaaaaaguugccuagccauguuauauuuggguauagaggagcagaagagcucagauccauuuaguuuuuagcuccuugaaguguuuuuggaagacaugguuaaauacuuguugauccacuaaauaccagauuucugaaaagaauaacuguaggucucuuuagcuaauucacauugauuuaaggggguuguacuaugaaauucuuaacauugagaugaaucauguuggaauacuuauguucucagaauguaguguguauggccugucaggcuuggcugccucucccuacacuaagucuuuggguaaaaguuggccuagauggggcacuuucaugauuuagcugagcacuuuugcuaaccuguuuuuaaguggagggagaagcagguauuauauuuuaccaauuucauucuuagaagaauggaguuuuaucuaaauugcuguagauagaaguuuuccgaaguguuuuucuccauucacugucaggagcgccaaaugaaaaacaagguagagcaguuuaugguggauuguggaggaaagcugaacuugccuaguauaaucccaauuugcuucauaucuggcauugguuaacauucuaggggaaauuuaaaaacacuuucuggcucauuugugcuuuuccauaguauacuucuaauucuauuucuguuucuuagccacauuuagauguucucuuuuaaauguaauuucaauaugaugcuacuuaagaaaauaagaaaagccagaugauguugauucagaaaacugucaaaaaucuaggcauagaucaucuguauucuuuucccaagauuuucaauagaacauuaaacauuuauuuuaaaacucuuauugguucacuugacccauuguuuauaaguuuuuggucuguugcuuuuugggggacacuuugcagaaggaguggauacauuuacaucauaaucauuggugaucuuuugaaaaauuugucauuccuaguauuauagaauucauauggaucaccucuccccacacccccaauuuuguuuuuguuccuuuuuuucccuuuucaaaaugugaguuuagcuugauucuuuaaaaaucugggauacuuuucuaguugcugguagucauguaaaaaucucccuuuauuugugaucaagucauacccaccucugaagcuguacaacaggagugugugaguguguguguguguguguguguguguuaaaauggugguuucuuuuaaaagaguguaccuucuaggauucgguauccugcuaguauuaaauacuuucucaaguuaguaacuagauuuuucuuucaagccuuuaguguuaaaaacaccaaauuuuguuaaauuuacaauauuucuaacacaaugauagcagcucagauauccuacugaguuuuuaaauguuaauauuuuuucaaaugaaugcagucaucuuauuccuuuccauuuuguuauuucaaaaauguagccagcuuugcaaagauguguguauaguugcauucaggggagacaggguacuugacagccgucugcaugugcaauaguaauaacuuguuauuaaagacaagguuuuuuaaagcuaaauauuuggaauuuuagaaguuuguuaagcauuagaugcacauuuacuucacucuuuuuuuaaaccuaucauaaaaauaaucccauauaaacacccacauaaaggaaauaguaauguaaguuuuuucccaagaacauaauuuuuauaguuacugaaguguaauauagugagauuaauuuuuauugguuucuuuacauuuccugggauugguuuggaaacauaacagcaucuagauuuguuuccaccuuugcuauagauggauagcuucaucuacaggaugggaaggacuuuuuucuuccuuuugaagaggauccauucuguuguuucucauggaauuaugcuucuuucuguggagagcagauuaugaaaauguuugaugaacacguguggagcacagaaauuaggauuguuucaucuguccuacaucuguaguaguacuucuaagaggaccugucaaagccauguggaaguuguauguccuacacguagcccagcaaaaaaaguuggacuguuagagccugguugggaaagauguuuauuccuuuauuuuuaaauuuuauauuuuuauuucuuuuuauuagggguugacaaaguacaaccccuaggccuguauggcccacaagccaaaacugguuuucacauuuuuaaguggguugaaaaaaaaucaaaagaauaauuuugugacacaugaacauuuuaugaaauuuaaauuucagugucuauaaagaaagcuuuauuagaauauaauuagacucauucguucacauguuggcuaugguugcuuucuagcuacaacugcagaguggcguaauugcaguagagauuguaugguccauaaagccuaaaaauauuuaccaucuggcccuuuuauagaaagaguuugccaacaguugcccuguuuuacucacauaaaaguaguuauuuauagcaaacacaguauuuuuuaaaaaauaccaugcuuuuguuuguaaaugcaacaucggaguaaccuacccuagugacucuuugaguuguagcauucuuuugauuuuaguauuaucucauuuuucucuuuuacuuuaaaugcucuggggauaaaaauuuaauuuuuuacauucuguucuugagggggucuguauuagucugaguucuauagaaaaacagaaccaauuacauauauauauauauauauaugugugcguguguguguguauguauagauauagcucuagauauauagacauauauuccuuauaauacauguggagauagcuucauuuauauacagguauaugauuuguaugugcguguuuguguguguguguguauauguuuauuauaagggauuggcucaugagauuaugaaugcugagaaguccaagaucugacaaguuggcaagcucugacaguccaggagaaugaaugguauagucuggucugagucugaaggcauugucucaguuuaaagauaggcaaagaaggcgaauucucccuuacuuauuagaaucccuuauuauuagaaucaugggaacuuucuaaguugguuggguuaaaauugucauuuguccagcacugaguugaaguaggauugaauugaaugauaguuucucuauuuguagaggauaacuugugguauuuuccugugguuuaauuaagugcuguuuguuaauauuaaguagguacaucaaaggguguauuuguacguuuaauuuucuuguaucauuuccauuucaaggagggguuccaauacccaagcuuagucauuuugccauacuguugaauugcuggaguggguaguuuguagcaauucccaaagcaguuugcaaaagccaaguugauuggcaugacauuuugucaacaagccucuuauauuagagugugucagugaacagcuggagugaaaaggaaguggauuuguuuguagcgugagcuucuuacuuacccuucaugugacccuagagaaauccccugaucucauauaugcugcuguuuuaaugcccccagcaacuagaggcuggugggaagauuacauaaaauaagggugugugugaauugcacugacauaaguauguauucauacuugguuuauguuaacuggcaagaaaucccccuccugguaaauaauuuuuuaugacaauuuugucaauauagagugauguuucugugguuuaugugauuuaguccacuucccaaggaaauaauggaaguaucacuugaccuuugauuuuacucuguuguuccugaaguuaauuuauucuagaacaaugacuccuuauucacauaguagcuugauuucuaccugaguaauaaaacuucacuaaauuagaucagaguagauaguggggccaaaggaauguuuaaauugucaaccauguaaagaaguuuaguacguccaucugaggcccuaguucaggcgcucuuuccagcugcaguguuucauuguccagcgacauugugguggcuguccuugcuguugaaucucaggugauuaugaaccuuacauauuagcaacuggauuugguucagugacauauauuuaucaaaaacacuaaaacaaauuuuggccuauguaacacuuuuuggagcaaauguauaaauguacuaaguugaguuuugggguuuuuuuuccauccuaaaaauauccuucugugacucauuuucugguuuugguaaguggcucuaauaucuauauuucuaccuuuuaaugaacauacuuauauauaagcccuuucgccuguugccucuagauuuagaguucugaauuucuagcaaaggccuuuuucucccuuuacuauugugcuccuuuucucuggaccuguucaauccuuguuuaauuauugaugguuuucagccugaaguuuccauuaaguuuuugcuucccucacccauacaagauaauuguauguaaauauuuucuuugcuuuuacaugcccccucuaagaagacaaauaggaaugauuuagaauuagcacauuaucaucauacauagaugcuccuugauuugcucucaaauauauucaauacuccuauccugauguagauucuugaaucauuaauuugcuucuuaaggaaauuaauugaggcauguuauggcugagauuuaauuugaugagauuuuaauuuagaaauuuuacuaaaugugaauucucugagacauuuuaauggaaaacaguuguauucagcuagacaaucaucauugcuuauauuguggucuuagggaugaguuuagaaacagguuuguugggagauacaaauggguggcagguacaugcagcauccacugcaagguguggccugagcaggccauggaaacagugaaauagaacaucaaguaccuggugcguaacugcuuaucacacuuucaaagaaauuuuccuaggucacacucagauaagagugaaguuauuuuggaaaauuagcuggcaggaaaagcauguauauguuaugaaagcugaguucaguuuugccagaagccaacagaggauuuauaaccaguugggguuuucauuuaaaaagcggagguuuuuuucugcuuuuaugugaugguuuguggauacuucaguaucuuguuuccuuuuaguauuuuccuagccuguggcuagguaguugaaauagauauauaacauugacuuuuucuauuacguggaagcuguucagauaauuaacaaaggaaaucaaugacacacaacucaguuuaaguguuguuuuuucuuuaggguauguugugcagaagaaagagagcuagccuaagagcauuggacuuuugggagcuguccagacucccccgccccccagaacccugcugaagcccaccugccuaguccagugaauaaaaaaagugcaugucucacuucuuuucaguguccuucagagaugugccauuauuacuauuuucuugacacauucugugaauuacuagaucaggcaacaauauugaaacauaaauaucaaaauacaaucuaaaauagauauguacugcuggcaaaugggauucauccaucaaaauuuccuuuugaauuccauuccuuuacaauagguugaguugacuguggaagcucuccagcuaaacuugaauguggcuuucuuauuaaacuuacuuauuuuuucauuuucuuuucaaaaugucaccuauuuugaguuauuucuuaggaggaaaacacccaugcacauacagauuuuuuuccagcaucuguuuccuguugaucuuacaguaauaucaaagaacaguugauccauuugauguauuaacauuacucugucaaucaugauaauugcugggauauuuaaaauugcaguucuguacuucuuaacauauuauuuuacaaacuuaaaucgaaaaacaugaagaggucccugguauugaaaucggaagcccuugcuguaaaugcuuaugguaguggcacuugaauuaugucauaucaaaaaugaaguggcaucauguacuggagugagccagcugaccucaauuccagccccaugucuacaaauaauuuguuccacaacuagauaagcagcuuaaccucuuuggacaucaucugcaaacugaagguuuggagcuaaauaucaaaaguuucuuauagaugcauaauccaugagaauaagaaggcauucucuucuauucacaagcuugauaacacacuuuuacucuuuggucauucaguuagcugaagacacagcaggguaagacagacccuccuugaggucuuaugguccaguggaagacaggcccauuuuuuuuuuuuuuaaugccaauguuggcauaauacuuagaaaugucauaaaauuuacuaguuuauaugccccauuucaaacucaaucuaaggaggaauguuugcucuagagcuaaugauauuugcuuuuuguuuugauuuuuuaggagcauauuaaugaaaagugccauaaacugaaaaaccaaacaugaggguagcagguaagauauuuaauuuaguagaaguaauuguacuuuuuguguaaccuguuuguuaaagaauaacuaaaggagagguuaaauaaucuuuauauugagaagguuaaacugaaauaaacuaaaucauucagcccuuuguuuuuagguaguuggcaaaucacaaauuggacauuuagucaguaucacauaaauuuuuuuuuuuguucaagucuuuuguugaaauuacacauugagcuucuuaaaucugaagaucugaaaugcuccaaaaucuaaaacuuuaugagcagcaacacaugaugcucaaaggaaaugcucauuugaguauuuagguuucagauuuucagauuugggaaguucagcugguaaguaugaugcaaauauucuaaaaucugaaaaaaaaaaaaaaaaaaccuaaagacuguauauaaugcccauauaaagaaugguuugacaaccuagggaggcugauuuuuguuuuugcuauguucuagcgucuugagaaaaaugaguuauaaaguuuuaaaguuuaaaugucucauauguauguacuuaaauuaagaugugugugaaggauucgauaaaauauguguuuuugcucaguauuuguucaaguuuaaucugcauaggugaguuuauguguaagaacuuuaaucuguuuauuaagcagcauauugagaaaauugaaaaacaccauuagauguucauaauauuaagguaguuauauuuaaauauucuaaaaagacacguuuauaaauaacuggaggggcugaugaccucuuccuguguaguaaaaauaagucuguuuuuccccacccuucccaucaaccaaagcccuagaagaaaugcauacuuuacauggaaauuucuacuaagcgugugcccaacauagguaacuuguaauuucucaaaaucaagauaauuagucuuuuucuuaauugucaucucagcagcaaaccaauuauuuuccuaagggagcaucucuuagaaaugccuaaagucaagcugggugaacaaaccagucuucauacuguggucauaauuguguagaaucaggcgcaauugauuaaacaucaugauuauuaaacaaagauaacugagggcuguuacaaaugcuuuuguagaaacuugaaaaacugaaucucuugugaaauuauaaagcaauuuuaaaaaaaguaacgguacaauuguucaagaaaaauauucucagaaacgaagaacuuguuuguggucuaaauaaauguguugcaaugucuuuuuauguugcaugcguguguguguguguguguguguguguguguguguggauguucuuugaguacagcaggacuuacuauuuaugaugucaugucuccagaugauuuuuaaaguacauuauuuaagcauggcaauuugaaauaaaguaaguuucucuuucucacauaauuuuaaauucauguuauuugaaauuaacuuugucauuuaguccauuucucugguucugacaauucccagguuaauugaugaguaauuauucacugagugcuuauuuuguguuuggcacuguuccuaguauaggucuugagggaacugccuugaaugaaugaauaaggacaauuagcuauuaauuuauugcuuuuaacuaauuaaucucuucuaauuuuuuuaaaaaaaucugauugcuuugaaauauccucauagccauucuucuuacagugaggcaugaaugucugaaguuuguacuucuuggcuugugaaaaacuggagcacacugauauuagugcagucugugacuaggaggaagagggaaucuuauggaaagcuaagaaugggaauugugguugguauguuaggccccaucaaguccagaaugggaugcugguccuggagucaggccagcuuugggggcgaucucuguaacagaaguuccagaacucuaaccccauggagacugcuaguuucuccaccucuaacuuuugucugccuuagagcuuuucuuuccuccuaguuccucugaugguucaguguaagugaacaggucuugguuuaagacucaauguugccgcugacuaguuaugugaccuuaggcaaaugauguaaaauuuuagcccuguuuuccuuauuuguaaaaggaaaauaaugccuugcaaaguuaugcaaaugagauuauacuuauaaagcauuuaguucuacagaagacacuaaguaaacgguauaugugagugucauauauauauauauauauauauaaaauguuuguauauagcuuuuuuaaaacuuuuaggcucaaggguacauguacagguucguuaucuagguaaaauaaauugagugucacaggggcuugguguacagauuauuucaucauccagguaguaagcauaguaccugauagguaguuuuuugauccucauucucuucccacccuccacccucaaguaggccccagagucuguuuuucccuucuuuauguuuauauguucccuucucaguguuuagcuuuugcuuaugaaugagaacaugcacuauuugguuuucuguuccuguguuaguuugcuuaguguaauggccuccagcuucauccaugcugcuguauauagcuuuuuuuaauguaggcuuacauuuagcuugguauagaauuuagaauguuuguguuaucgucuugauauuuuaauuuuucaguuuugaacaaugaaguuuucauaugacuguuuuacaggacagggaaaaguuaucucugguugcaugugccuaugauugcuagaaaauaagaugguaagaccaucaugugacauguaauuuuugagcucuuggucuuagucuuaaaugaucaagaaggacuaugccaccuguuaccauuuaucuacuuagcaaacaguuguugauaguaucaguguauacagugcacuuugcuagauccuggggagaagaguucaaagccuaacagaauuuugcucucuuaugcacuaaaaauguaggcaacuuguaaguugcucuugaaaauaggaagcagauuuuggaggggacaagguaggaaauggaaaagggaggcagggauugauuaguauuauaguuagacuuccucauugcucuuucauuucuacauuaauaguguuucuuucggauuuuuuaagacuuuauuauuuuaaagcaguuuuagguucacagcuaauuugagaggaagaugcagagauuuucuacauacucccugucccgcuccccauguaguuaucaguagaguguuucuauacagaaaugaguaggcugugagaagcaguagcucucugagcaucaucaguucauugaagagucugcgcacuuggagcuuuccauguaacuguguuaugaagcauaugugauagguaccaaauuauauccugcaggaauggagaaggccugucuuaagguacuaagguauuaaguaugaagaggaaggcuuuguugaucgccacaccaggagggcuuauguagcuccaggagauguguugguuagugauaggacaauaaaucuguaacaugucacuugagaauuccucgcuuaguggacauuguggccuuagcauccccagaaguuccacuguuuuugaaaaauccuaucuaguauugcuccuuauauuuaugaaggauaaggaaucugccauucaacaaacuugguggugguguuccauuagucaugacacuuuuuuguugucagcaacuaauagguaauuuuuuugcauauaaaacuaggcagaugguucaagcaguccuuuggauagcuagauaaucugagaauucuuugaucaggaaaauucuuuaucuugaugaauuguuuguauaauuuuuauguaucucauguaaaauuaagaucuaauagauacaaaguagaaauguauugaucuuaaaaaauuuauaaacauuuuucauagaaaugcaaaauaaaaguucugugggcuuacaaaguuaugcugaaauacuucugccuuuuaggugcugcaaaguuggugguagcuguggcaguguuuuuacugacauuuuauguuauuucucaaguauuugaaauaaaaauggaugcaaguuuaggaaaucuauuugguaaguuuuauuuuuuuccuuucuuaaaucuuauuuuugauguggccuaaaguuuuaucaguuaucagcacugagucacucagugcuagaaaacgaaaugugauuauuauauauccauaaauaugauuuguuagaauauuuuacaguauauaauuagauauuuuggaauuaauuuaguauaaaacaugaaucuucuauucaacauuuugaacauauguaaugagucuauuuuauacauuuuuaggggcauuaaucauggcauucuaagugcacauucuaaaacauaaaauaccuccaggcuuaaauuguuuuccuguuuaaguuggcugcuagaaaacuugaagccaaaucuagcccucaguuagccauaugauuaggagucacgguaaugcauuuuagauaccagccauagaaauccgucuugcagcuggcugugguggcuugcaccuguaauuccagcuacucaggaggccgaggugggaggaucacuggagcccaggaguuccaggcuguggugagcugugaucaugccauacugcacuccagccugggugacaguaaaaccucaucucuuaaaaaaaaagaaagaaauccauggugcuuucuuauccuuauuuucccucuguggcauuuuuuuuuucuaacccacucauuuaauguugccauacuguaaauguaccauuauaagguaccuuaacccaguuuuuuaacagaauccuuacguucauaaaauaacauuugaaauguuuucauaugaaccaguuauacauagugcuauuguagaugauuguauaugaauaucuuauugaaucucaaauaauugugaaguaugcauuucuuuucuauaaauauaccgcuauaagacugaauaauagaauuuaauuuugacacauuaaaguggaaaacaauuauuuaaccaaggcgcuauauaagaucacagucaugugucaccuaaugauggggauacauucugaaaaaugcaucauucggugauuuuugucauugugagaacaucauagaguguacuuacacaaaucuagaugguauagccuaccacacaccucggcuacauuguauagccuguuccuccuaggcuacaaaccuguauagcauguuacuguacugaauucuguaagcaguugaacacaaugauaaguauuuauguaucuaaacuuggaaaagguacaguaaaaacauaguacuauaaucugauggcacuaccacucuauauauggucuguuguugacugaaaugucauuaggcagcaccugacuauaauucugaaucucuucgggaaacuauuuuuguacacuuuuauuauugaagcuagagaaaugaugagauucuucauagauccuuguacuuacaucgaguaaacuaugacuaaauuguuguuuauaauauuaaauaagcauaaaaagugauacuauaaacccuagaaaccauauuuuggucuagugggcagaagucaaaugaaagaacugagauugcuggacuacugaguuuugcuuuccauaaauucauguuugaaaggaaaaauccccaaggcuuaauucaguuuccauauuagguucucaugcugcugugaagaaauuugccagacuggguaauuuauaaaagaaagagguuuaauugucugacaguucugcagggcuggggaggccucaggaaacuuacaaucauggcagaaggguagcaaacauguuauucuugguggcagaaaggagaagugcagagugaagcgaggggaaagucccuuauaaaaccaucagaucuugugagaacucacuaucaugagaacagcauggagguaauugcccccaggauucaauuacuucccacuaggucccucccaugacacauagggauuaugggacuacauuucaagaugagauuugguggggacacagccaaaccauaucacuccguuucacauuuaaucucaagacuguuauuccaguguuucucaaacuuuaaugccgaaagaaucuccagagaaucuuaguaaacguagauuucugaguuagugucuggaguggggccugagauucugcauuucugacagcuccaaggugaggcugagaucccuguccauggacugcauacuggguaucaaggcuuuggacaauucugauauguagacuucaguuuuggcauaaaccuuuucaggugacuuuucuuacagugacuacauaaaaguacuuucuuguacagguugaacaucccuaaucagaaaauucaaaaucugaaaugcuccaaaaucugaaacuuuuugaacaucgacaugaugcucaaaagaaaaugcucuuuggagcauuuuagauuucagauuuucggauuagagaugcucagcugguaaguguaauacaaauauucuaaaaucugaaaaaaucccacauccaaaauacuucugguccuaagcauuuuggauaagggauacuuaaaccuguacugcacugaauucugccuuuuguacucccaaguaauuucaguucacugaucuuguuucugccugcuagagcccccuucuucaucagugauuccucaguuaaauuguagucguuguccgucagaccuuccuuuacaaguuuucaucuuuuccaguaacagaauccucccuuucagccauuucucuugauaaacugguuauuuuccuccuaaacuuguuuguuuuucagcacacauccuaaaaugaaguauccagguuccagcauaaaaguaguuacugcaaaguauagugagauuuuacuuuacuuguucuggucuguguacuucuauuacuaccugauagccagccugguggccuuucagaacacagcugguuucaguugaaugaugggguggaaaccauauugaaggcauagaggacucguuccauguugcucuggaagcaaugugcauagcuaauucuucuaagacacguugaugguaggagaagcagcuuaugagaugguaacuugacucaaaagcaaguugcacauauuuuucuuuuuuaaaguaauaggcuuucacuugucuauaggccuuggaugaaaguucagugaaggacaaaugaaugcgaagagacugaaccagcaaggaaaggaggauguuugggagaagggaggcagugggaccauuggaacaaauagaaguuacaugggaaaagacccacuguuuuuagaaagaagauugaagagaaggcugggugaagcuacagugugguauagucacugugcacaugcagcugaugguuccucuccagugauaccagucaugucuguccucacccuuugucccccaucuuugcccuaguuuggaucuucaucucuaaucuguacuguuuuuaugaacaucauagugauguuccuuucucuucucaucucugauaucugccuaucucaccacuuucagagccauuuucuuaaaacucaacaaucuuuaguauuuccaguuacuagaggauaaaguccaaacuccuuacuuaggguggcacccaaaucccccagccugccuuucucagcuggucuucaccccuccuuccugcaugggucacacucuugugccagucugcacacagucugcagcuucaaauccccuccuguccuuucaacccugaccuuugcucguccugguuccucacccugcacaucuuucucauuuuuuagaacuuugcauaaauuccccuucuuuggaagaaauuguguuugaaccucccucuuuaagaauguauugcuccuuuuucugaacauuuguucugauugcauaguacuuauauuucaauuuggcacugauuuuaaucugccuugcauuauauaauuuuuuuucuuuuuuuccucuuuuuccugugucugucccccuucacccaagagugagucuuaaaggcgcuauuuuggugcuucacccagcaucuagcacugggugcugcaaucaguaaaugcugauugagugaaaacaaauguagguaacagagaauuaggauuucuacauggaaaggaagaguauuuccaaagugggauucacauaaagcuguauuaguuggaauaucacugguagucagcuaugaacaaacguugaguuacuuuauucuccuacuuuuuauuucuugauuuuuccugauguuaagaaccugcaaaguguuuuugugugcauuuuagcuauuugauuuagacauuaugagggcagaugguuauuuugaugucaaaacugaaguguaguacuuuguaaccuuacugguugccaaucuguugaauuggccaaaauuuaauugugugguuuuauuuuaauucucauuucagacuaucuuaacgaagauggauauaugguuaucuucgucauuuguuuaacaucuuaguauaugaaagguuaacauauuuaauccaguaggaggauucuugcuauaaucacuaucuuaaggacccauaagauuaaauaguucuuuuggugauucguuuuccauuuuuuaaacuuacuugacaauuucuauaaauuauguagcuuuauauuuauuauaugguauuauuuuagaaaaauaaaacacauuucuagaaaggaagaaugaaaauuuugccuacaauuaguaguugaaauuaccaaugucgauuaugaauuuuuaaaaacaauuuuuuauaaaacuuuauuuugagauaauuguauuguuuuuuacaaauccauuugaauauacagagagauggugcauacuguuuacucaguuucucccauugguaauaucuugcaaaacuauaauacacuaucacaaucaggacaucaacauggauacaauucaccaaucuuauucagcauugugguguaauguaguguuguuuucaguuugaauacuuagcuaguaagugaacugaacacaguccaaauuauuuuugucuauauugcugcaauaaguacuuaauguucuuuuuuuuuuucuuuuuuuuuuuugagacggagucuugcucugucgcccaggcuggagagcaguggcacaaucucggcucaccacaagcuccaccucgcggguucacgccauucucccugcccaccaccacgcccggcuaauuuuuuuuuuuuguauuuguaguagagaugggguuucaccguguuagccaggauggucucgaucuccugaccucaugauccacccgccucagccucucaaagugcugggauuacaggcgugagccacugcacccggccauaaauacuuaauguucuauugaauuuauuuauuuuuaccuuuucagauuuaaaccauugguauauaguauauacauaaauuacuugagacauuauuaacaacuaaagugcaaaauaguucugauucauuagcccgacuuacugaaggacauucauugaugaaaugcaauaacaaauguuuauuauuguuccaugaaaugaaguguauaugcagaaagaaauuaagcauugaagcuaucaguguaguuugaggggaaaauaguuguaggagaggagggauuuugguguuuguauguuguaccuguauucuauacuuggacagcuguuuaugaaaacuaauguaccuguuuggccaccaggugcuaauguuuucagaauugcagacuuaguacagggcuuuugauuuugauguguauuggauaaaaaugagcuuucuucuggaaagaaaagucuuucacaggaguuucuucaccuuaaaguaucuacuccccuuacuguuacacaaauuaaauggaggugauguuauuuacuuaaaauccugauuuuaaguaguuaaaauccugacuuuaaguacuuaaaauacuuaaaaaacugauuuucccaaaauuauaucccaguaaaguguagauaagguuucuuuucugcuuuguucugggcauuaagcuuuuucaauguuauuauauuaccuuuauggcuuuaauggugcauaauauucuacugaguguucuauugaguuaaugagcuuuuauuuacuuggucauuuuccucuuuuuaaacauuucaauacaaucuuuuaacuuucagcuuacuaguuggaguauuggaccuacaggaaguucacaauuaucuaaaauaguacagaacuaaaaacugugugacuauuuauagcaagacagcugguuaacauuuaucacacugcauacuuauuagucaaaucaggaaauggcuguccacaauacucugaugaucugaguuauaaucuccugggcugggaucagauguuagugcuuuuaaaaagcccuacuauaauuaugauagauggucagguugagaacuacuacauucaaauuaagauuugaccucauggauuccuugaacugauaaauuguaaaucuuuuaguaaugaucuuccucaucccccucccuggcccucgcaaucuccuaaccucaccacuaagauagauucauguauauucucuggggcuuucuuugcguaucuguacaacaccauacagcagcaacaacuuuuaaacaccaucauauucaccaaauuuauauuuauaaacauugaaagguaaguuuguagaguaacuuccugauugaaauuuaaauauauaguaacuaaaauucaaaacaaaaugguaagggaaaaauaaaauguuuuaucaguaguaaaauacuauccuccauaauuauuuaauaguuuauaaugaauguacagugugaaguuacuuucucacuuuuucuuaagugauauucauguuuuauuguauacugaaucauuauuugaacacuuauuuuuguggaccuaaauauauuuuaaaaguggauacuugccaauagacucauuccuucuaacaaaaguaauuuuuuuuuuucagcaagaucagcauuggacacagcugcacguuguaaguauuucaucucaauauuuuauguaugauuuauucugccuuaggcauaugagagcuuauauucaaagugucaguaguucaguaugaggaaaaacugcuuuagaaauugcuuuuuaaaguuaugaggaugcuauuugauuggacagcccaaauauuuuuggcaauuauucaugauggauauuuuguguuuuuuagcuccguuauuauaaguacagaaauuggugugagaaggaguuaagaguguacaugggcaagguagucaauggaacauuaggccuuuuuuaauuauccuggaggugacgauuuuuugugcauauauggacuagaagugcaaaguaacauucagaaccccccacauccuaaaauuuaaaaauaaacucauaguuagauaaaauauauuugcccuaaugcagaucauauuacuugacucauuugcauccauuauuaguuuguuuccuaggaagaucuggugucuguuguggguuucuuuguugcuguuuuuuuuuaaaaaaauuuuuugagguucuuugaaacccucaggggaacaaauuagcuuguauuuuaagauacguguaucuugauguuuuucuuaaugcucuuugugguuugagauuugaaguaaagugagguaaagucuguuaacuuguuuucuaaaaaaagacaucauguuuucucccccaaagcuacaaagccucccagauauaagugugggaucucaaaagcuugcccugagaagcauuuugcuuuuaaaauggcaaguggagcagccaacguggugggacccaaaaucugccuggaagauaauguguaagucuuuguugacuugagacgauaaggugugcuauuaaauugcagccaauugaaccugaguuuaauggauauuuugaaaauguguucgguauacuuuauuaauggaaagugauuuccauuuuuguuauguaguuuuuuucucaugaauucaagggaccuuaaaguucuuaaauuuuauauuagagagugacuaagaacguaacacuuauucggcuuuauagagauaagagauuuccucugaguaaauucucuagaucugcacugucccauuugcuagcaacagaacacauguggcuauuuaauuuugauccuuaaauauuaggaagaaaguuaauucacuuaaauuaacuaaaaaguucaguuccuugguaucugucaccgcaguucagguguucaguggccacaugugguucauggucaccaaauggaacagcagagagagcauuuucaucguggcagaaauccuauuugcaacauugcccuggacaaugaauguguucucuuuauuuuaaaugaaauccaacgucuuucauuuaaaauauuugagugcuacuuguugaagugugaaaugauccagugauaaccucaguuccauugcagcacaaacugcuugccucuaagcugaaugguuuccuauguugagaugcuuucuaaaggaugguuuuuaggauuuuugauauccuaccucagugucaacuguugcucgcaaguuccugcugcugaaauugcaaauccuacuuuuaguugguugcuuuuaauaugcuauugccuagaaaacuagacaugggggcuuauuuaaauuuaauauaaaauaauaaauuugucacgaauuauauagaauaaagagauaauuuuauagcaaagaggagaccuaggcagcuuuuccuagcuguuuaugugccucuucuuuuuaauauugaagcucuuaaauuuuuauccuagccucuuuugcaggcaguuagcuguaagaaguuuauugagcuucaugggacaacacuuuucuuguaaaauuaagggcuugagcuagaugaucauuaaggucuguacugauuuccuuuauuuucccguauucuaaugaugauuuauuguuaauccauuugucuucugauuucucauuagaauaguccuguuuuacugaugcauaauaaggcacuugcauuuuagaaguuuguagguuuuugaaaacauucucauuuccacucuuuaucuuguuugguuaaauagaccccaaauuugauucuaaaucacaggaacaaaguucuuuuagaauaccuaacccauggaugauuuuggacaucuauucugcccccuugaugcaugugaauuuuaguucagagaagaagagaucagacuguuuacuagcagguuuuuuauucacagauuaaaaccguaaacaacaaaacacacucagaaaaaaagcucaacuguuuacccacauccugacccuuauucacuucucuccagaucuuccugaucuuggggccuuagaguauacucuucugucuaggauggucuuuccucacucuucacuuggcugucuuccuucuugaccuuugguucucagaguacacaucacugucuuagaagcuguucucuaucccucagccuaauguugaacagcuaaagaucuaaggucagaaagcgaacagugcauagacaguggagcuugguaaaauacauacugggcuuagagccagagaauuugcuucuagcauggugggcgugucauguagcauuuguguuucaguuucuuuaaccauuaaaugaggcaggccaccuauccauccuuauuucaggaaccauucugccauuaccaugagagauuaaauacuuggugggauuuuauacccaagccucagguuaaaguccaaagaaagagucuuaaguuuucugagagucauuuauucaccuguucagcaaguauuuuugagcauaaucccuccugucauggaacuuacaguuuaguaggggugacagaugcuuaaaaaaaauacguacuuauaaauugugacaccaggcugggcgugguggcucaugccuguaaucccagcacuuugggaggucgaagcggguggaucaccugaggucaggagucugagaccagccuggccaacauggugaaaccccgucuuuacuaaaauacaaaaguuagccgggcgugguggcacaugggccuguaauccuagcuacuugggaggcugaggcacgagaaucucuugaacccaggagauggagguugcagugggccaagaucgcaccacugcacugcagccugggugggcggcagagcgagacuuugucucaaaaaaaaaaaaaaaaaaaaacaacaacaacaacaaaaaaugaacaaacaaauugugauaccagcccugcagggcagcagggugugaugaguacuggcgagaguggauggaaagaggugucuaacuuuuagauugaggguuauggaacaguuucuaagacagugauguguauucugagaucugagggauagaaaggaagaccauccuuggucuucgagcaggaggaagaagccugcucgaaggcccuaagauuggauagcucuggagagaagugaauuagggccaggcugcauaggaacuuguaggccacgcagguaaaggguugagacuuuuuucugaguguauugagaacuuguggaaggauuucaaauucuggcaugucgugauuuuauuuauauugaaaaaaguuaucugguugcuguguaaaauaauuaaggaaguggaauagagaggacaauuggaaggccauugccaguuacugccacagcacuuucauacugccucccuguugguaacagacuuuauugcuuauacauucacuaaaaucuauaaguagauaauaaaaauaacacaagcagagaauuuagucuuuucacagcaccugcucugaguacauguaacucacuuuggagacuacuaaucuuggaucagugugucucaaugggggcaguuuugcuuuccagggaacauuguaauuuuggguugucauagcuuuggagguacuccuuguagaggccagagaugcuguuaaacaucuuucagugcauaggucagcucauccacaagaauuaucaggcucuuaaaaugagaggcuggguuugagaaacucugauacagacaggugauaauuacaauuaggaugguggucauaaguaguugaagucaaaauacauuaugcugauaaagauguguuuuaaaugucucauuaguuagaaaaucgcagguaugaaccucaggucucaggaaaaacaguaauugcagcuuuuuuuuuuccuuuacuuuuucuuuuuucuuuucuuuuuuaccuagagacagggucucauucuguugcccaggcuggaguacagugacgcaauuuuaggucacugcaacuuugaaugccuggacucaagcgaucuucccaccuccaccuccugaguagcugggacuacaggcgcauaccaccacaugcagcuaauuuuucuauuuuuguggaaauggggucccauuguguugcccaagguggucuugaagucuuggguucaagcagucuucccaccucagccucccaaagugcugggauuacagguuuuuucuuucucguuagagcacccauagaacuaacuuauguuccaauuauaauuuucaucuaaggcauauauucauuugauuucaauuuguaugaauuugauauuaggaauaauucauuacuuuugauuuuaaugguaauguuugcugcaagaauaugagauuauuuugagggauuuuuuuuuaacaagggaucaauguuuuuggcuaugagggcaaagagguaaaaucaagguuauuauguauguacuuacauaaucauuuaaaauguaaccauuuaaaaauguaaaaacuauucuaagcucaugaguaguaaaacaaaucaaaaaaccaguuggcaggauuuggcucgugagcuauaguuugccaagcccugcuuuaaacuaaccaucuuaagagauaauaacuaauaacuaggacaugaaguagcuauuugaaacaaaucuauauuuggauauauugaguauuucuacagaugauauaaucauuuccuuuagaauuuugccuagagaugugggaagggguaccuuauauucaugaaggauaaaagaaaauauuucaacuuguguuaguaaggguuacuaaccuuuauacauuuuaaaucucaguggauuuuuuauuuguuagagauuuucuguuugaauuucaguuuuuaaaaauugauaagcugcugcccucuugugggaagccuaugucauugugcuucuuuguuaccuuuauuucuuugcuuuaugauagauuucagucuguaaaaugccacaucauacuccuugaugaucuuuacuuggaaaagucacucuggcacuuaacccguuaaucacagcaguuacuucuuaaugauggaguuuacuuauugaauguauuucugaaagaaacagaacaguacauuuugaaacuuccuucucuuugaugcagcugagccaaugguuaaguaguaaagcauagaaccuuuuaaauguauaugcuccaagcuaguacuuuuaaacagcuuugagauauaauucacaugccguccauuuugcucauuuauauuauacagucagugguuuauuauauucacagauauaugcaaucucugccacagucaauuuuagaaaauuuuuauaccucaaaaagaaacccuguaccccuuagcuaauauccuucuaugccuuucuuguccugccccacuuccccacccccaaacccuaaguuaaccauuaguuuccuuucugucuuuauagauuugccuauuuuggacaguucauauaagugguauauaauauuuggucuuuugugauuggcuucuuaccauaauguuuucaggcuuccuccauguuauaucauguaucagaacuucauuccuuuuaugucugaacgauauuccauuguauggauauaccacauuuuguuuacucauucauuaguugguagacauuugaguuguuuccacuuuuuaacuauaaugaguaacauuuacagaaacauuuauguacacauuuuauguggacauauguuuugauuucuuuauacucccagggaguggauuuuguuuuaggugguaacucuguuuaauuauuugaggaacugccagauaguuuuccaaaguggcugcaucuguuugcauuuccgccagcaguguaugaagguuccaauuucuccacauccuugccaacacuuguuauuaucugacuuacugauuauagccagccuaguagaugugaagugaaaucucauuugcauuucccugaugauuaguggugucuagcauguuuuugugugcuuauuggccauuuguauaucuucuguggagaaaugucuguugaaacccuuugcccauugauaaauuggguuguuucuuuauaauugaauuguaauuucucuuuugauuaauguuugcaugauaugucucuuucuacccuuuuacuuuccacugccuauauaauuauauuuaaagugaguuucuuguagacaguguguaguugguuccuguuuuaauucacuuugccaauuucugucuuuauuugguauguugaaacuauuuucauuuauuauaauuauuaauauaugaggguuuaagucuauuuuauuauuuguuuucauuuucucauuuuccugccuuccuaugaguuacauaaacauuuuaaaaaaguguuucuuuugauuuauuuauaguguuuuugaauguaucucccuauagcuucuuuagugcuuucucucuuuacacaaaaaguuugcagacucaaguucuagacuugaggugagggagaaaauauuacacagauuaaauugaaaaauauguccuaucuauaucuauuauaugguggauagcaccaaaaauguaggaaguagucuuccaauauuuaaaacuuauuaucugauucagucaucauugacaggcaaguggaauuugaacaugaaucuccauuauuuguuuuucuuuauuuuaucuuauuaacauagauccaacguuuguuagaacugagcucauucaucaauugcaaccauaguucagcugcagaugugaauuguuugaaaaaucaacuaaaauacucugugagaaucgacugagauuuauaauaaaguacaucguagauuuuauuuaugaaauugugugcuauacaucuuuuaguaguuuauaauaaauuguguaccuauguguauauauaauucugucuauauaaggacaagugugugcacguguagucacauaugugcauauugccucucucuccuaaacacagagcaguuguuaaauaguuaacagcacaccacugggaguauuacuauuaccuugaaguuuugaguuaaaagaacucacaauuuuaguuuaauaauucuaauuugagcaauugaacaaacugaacugauaaccagcaaauuugucacugguaccuuccauuuuacagugucauugucuuuauauaguggucugugagcugcccauggaagucgauuauuucagguagucaccacguaagugacugucauucaaugcagugauuucaugagugcaauauuucuuaguguagacgaacuuuacagugauaaucacuaggagaauguucacaauuagguaaaacauucaugaaagagugcucccccacucuguuugcuuuuagauuuaaaugauggggguaguaucucgcuucuguuucaugucacgcugguauugaagagagcagaaaagagauuaucuuuuguuugauaccuuaagaaugaugcagaacauaugcuuaauguccauguuuuaagaauaaucugaagcaguguagcacaaaaauggucuauuauuucaggccuaauauuuuuuaauauguauuucuauuugugaaauauuauuuaaggacauugcuuuaaaauuauucaguauuagacugucuucucugacuuaguagagaucuuuuuaauuuccuccgcagcacugaacaauugaaaauauguauaauauuccuaacuuuuuuugcaagacuuuauuuuucugauauguuauuguacaauauuuaauucuaaauuuauuucaauuucucccccuucaguuuaaugagugguguuaagaauaauguuggaagagggaucaauguugccuuggcaaaugguaagaacaauuauuuuagcuuauggauguaaucauuggguauuuuucugucccaaaguaaaaugcacuaucagaggaucagguuagaaaguacugcucuugaugauaaagcccucugucccaucccugcccugcaaaaaaucuauggguggagacuuggugucuaagaauuuauagcguguuucuugaaaguauccuaacuugcuaugcaagagcuuccaugagauugucagaaaccaagcagucuaacaucacauugauaaaaucuugcuucaaauuuuggaauccuaacauaauaggaagauagguugacaggauuaaaggcguaugaaaugacaaaggaugguguagggggaggaacaaagaauaagaauguauuguaauuuuucauuaucagccacauucuucugauagcuuaauuaguaugaauaaguugauugaauccugaacaucucaaauuuuccuucaaaaucaaaucugaaaacauaaaaccauaaagugaggccuaacugcauauugauccucucuguucugguacaauaaguauuccauaaagcuauguaggaugguuauaagauauauaggaugguuagaaaccacuguaguuucauaguguagaaaaauauauuuuacuacuuucacagcaagagguaaauuuuuguucuucugcuuucuucauuuccuuagguaaaagguucaacaucugucuauuucauuaauagcaaaaaauacauuuuauagggcaaguuaauguaaguuuuauuguaaaaacugauuuaauguagaaaauggcaucugauucaaggagauacuucuuuuuuguaaaagguuuacuuuugaguaauuuuaaaauaagagaauauggaaacaacgaugaaauauaucuaaccgaauuggaauggucuacagucaguaaugaacuucuauuuauccuucggcuuaaaagauuaaugagaaaguucuauuaagaaauuacccuuuaaaaauauauuucaggugcauaugauucagauuuuaaguucucaaaguaauucuuugagaugaauucacaucucucuaaugcuaaugaauucacaucuucucugcuaaugaauucacaucaaucauuggaugagauuauuggucuuacaguguaugauauauuucagaugcauaauuugauaugaauuuaaucucuuuuaggaaaaacaggagaaguauuagacacuaaauauuuugacauguggggaggagguaagcauaaauaacaugacuguguucuuuugcuggcacugacuuaaucaccucaauacaauguagcccauuaaugagagaaugaugaugcuauuugcguuaguucauuuuguuucccuuacuuucuguucacuaaauguccagcuguauuuaaguuaucauucauguuuuauauacuuucuucuucuuagaaaaaaauuuuugugguguauaauugaagauaguaauaucaaaauugagauuuuuuuaaaaaaagucaucuuguuuucuacaggacaaccaauucaaaaguuuugggcuccuuuaagugugucuaaaauuuaaaaaaaaaaaguaauuugaagaccagaauaaccaauguaagcauuccuaagugauaggaauugauuuuuuuuuaaaugugauuuuuuagucucaaaaauaaaucauuaggagcauuaggagcauuagaaagacaagauaaacuaucaguuuuagaacagcaguccuauuauucaucacaguucuacccucugacuugcagcuaauuuuuuagguagaugaauauuugagggaagaaauagaauuuucuuucuuguaaagcaauccacagauauuuuccccuuccauauuuggaagucccacaaggagugggaagaaguuaccagcacgcagaggcaagggacuggcaccccaaagaagaacgcugcccggaagaauggguuuuuuuccuccaguuugaagggaggccaacacugguuuaucuuuugauucuuuaauuugggagauugaucaguaugaggaucuccccugcaccuccccauuccauuuauauauucccuagaagccaacagcuauuaggcuuccugaaauucauguuaagaguucucagauaauuuagcuuuuccaacauaucuucagcuuguaauaagaugguauguagccggacgugguggcucacgccuguaaucccagcacuucgggaggccgaggcaggcagaucacgacgucaggagauggagaccauccuggcuaacacagcgaaaccccgucucuacuaaaaauacaaaaauuagccgggcaugguggcaugcaccuuuaguuccagcuacuccuugggaggccgaagcaggagaaucccuugaaccggggaggcagaaguugcggugagccgagaucuugccacugcacuccagccugggcgacagagccagacuccgucucaaaaaaacaaaagaugccguguauuauuuuguuauuaaauaauguuaggacaacauugcauagcugucaaagcuguauaaacuuaaaaugggaccaucaauuuuagauucuaaaggcauaaauugguccugccaaaauuuauugauagaaagagucuuacaaagcuguuguugaaaucagucaugugaccaggagcucugguauuccuuacuucucuugucacagguagauuaauuaccgcuagcagcauucuucuaguuaggaaauuguugcaguuuauugccacuuuugcauuuaaauggaaguaguuuguuagcugccuuguuauaucuuuuugaauugaaaaugcuauuauuaugaaauauaaucaguuaucgaaaaucuuuggcaucuuugcuguggaaagaaacugaguacauuugaaguaacccaguuuuggaguagaauuagacuucagagcuauaaggaacccagacauuguaaagaguucaagaugucaagugguuuuuagaaucugaccuauguaucuggcaucaacaguuuauagucauugaagugguuuauuuugaaguccuuguggauuuugauuugguagaucaaaugaguaaugacuguaauauuugcuacaauuaguuuggcuuuuagugaucaccuaacauauuccuucucccaguuuauagcaaaugauauaccuaaaauagccuuuaaaucuguguguauauguauuuuuagauuuucuaaaaauuacagauaucuuugagaaucggagaaaagcuguguauccucuuucuaguaaaguacccauacaaacauuguuaugcuuuuuuucguuucguuuuuguuuuuuuguuuuguuuuugagacagggucuugcugugucaaccaggcuagagugcaguggugugaucucagcucaccgcaaccuccaccuccuggccucaaagcaguucuccugccucaacuuccugaguagcuaggacuacaggcaugugccaccaagcucggcuaauuuuuaaauuuuuuuguugagaugaggucucacuauauugcccaggcugguuucaagcuccugggcucaagccaucccccagcccugaccucccaaggugcugggauuacagaugugagucacugugcucagcccauacaauuuuacauacacuuaaggaguccacacaccucccaugccuccuuaagcuuaugcauggaccccagaauaagguuuucaggaucccaauuauucaaaucugagagaucucugaauuucuuacuucguaagucaugcuuuacuuugcuaugauuuuuuucacuuagccccaggaauaucaauacgaaagacacaggauaaaucaggaaugggaaauuguaaguugauagugggauuauguuaagggacaaauuuaacaguuuuuaaacucuuuaugagauuugucugucuuuuggauuacuuuacauuggaaauuauugcuuuacagauacuucauguuuuauaauacuacuuucagagauuaucgugaugcuuauucagucauuuuuuaaaacccuaaacccuuucuuuuucuucagauguggcaccauuuauugaguuucugaaggccauacaagauggaacaauaguuuuaaugggaacauacgaugauggagcaaccaaguauguaaacuuuacagaacuuuuuggaacuauaauuuguaauuauaaaagcaauacauuuucauuaaaaaaaaaucuguaacauagagcaaaguaaucaaacuaccagguaaacacaacuaacaauuuuuguuuuuacuuugccuccuuccugguuuuauauguaaauguuuaucacacauauauugucaugaaauuagaaucacaucauauguaacauuuuuuauacuuuuauguuuuguuuuuuaacauucugaaauuguuuuuccuagcauuaauauucuucaauagcauuuuuaugguucaucagcaguuaugggcucaccuuuaaaguuucccuauuauuaugucauuaggguaaauuucaagaaauggaguuaauugucaaagauacaggugugcuauauuuuaaauaauuuuaauauauaguaguuuuauaacuuuuucuuaaaauaguauauguuguaaaaauuuggaaaauuauagaaaagcgcaaagagaccaaguuccaguccaucucacuacccaguguaaacauugaugauauuuuaguuucuauuccagaugacuuaagacacauuuuuuggcauuaaauauuuagaaugcuaguauuuauagcauaucucuucacuuacguggugaauauuuccccuuauuauuaaauauucuuuauaaaaaauuguuuaugccugccuagucugguuuuuaaaaugucaugauuuauaaccuguuuaauggguugccuauugcuggacccagacuaguuccaauuugcauacuuagcacaauagacuaucuuagaaauguuugaacaguccaugucuaugucuuuaagauagacuucuuuuuuuuaaaguggaaaugauuaauuaaaggaugugcauguuuuuaaaaauggauuuuaaaaauuuuuuuaccaauuuuauauuuuucucagaaguuccauggcaccaauuguuaauuuuuuuaaguuucaauuuuaagaguuugaaaagguaucuuauuuuaauaugccuuuauuauugagauuggauuuuuuucacaagugguuuuuuuuucuuuugccuuuuuauguaaauugucuuuugaccauucgaguuggccuaucuugacuuguaagaccccuucacguuuuaaggauauuaaccauuucuaauguaaaaagaaauguauuuauuguacauuauuugcuuuuaauuuuguuaguguagggugcuuuuugaauuuuagaauuuuagacuaaugccuauauagucuauguauuuuucuaucacucuccuuguauacuugagaaguauuuuuccaccuccagguuagauauuuaguagauuuucucuuccagugauuucacuguugucauguauuuuuaaaaacccauuuguaauuuccccaugacacacaaugccuauguucuuauguagauuuggcuuuaucucuggaauuucuguucuguuccauucacuugaccuguuuaucucuguuccaaaaagacacuauuucaauuauuuuaaaauuguuuuauaaaaguaauuguacuucaugccucucugguugagauuaaauccccuuuaauguucuucuuucuagaaaaaaauaauuuuuucucugacuuuucuucagaugacuuaucaaggauaaaaaacauccuuuauagauuuuaauugacagagcuuuaauacuacaagauuuauagauuuuauagauuuuaauugacagagccuuaauacuacaagauuuauacagaaauuuguauuuuuauguauugauuuuuauaaauguauuauuuuauagcuacauuaucacagauuuacaugaaaacagugauacuuuauaaaugguuguaagcugaaguaauuucauugacauugugcguuuuaucugguucaacuaagaauauauuaaauccauaaauugaagguuaacauaaaacucgccuauucaagcauuuucaucuaccuaaauagaaugaaacaggauguaauuaggcucucaucaaaaaacagguaacuugcuauuugcuuuugcugagagaauaggcuauuacguguaaaauuugaaguuuuaacauuaaaaagaaaaggccccacuuuucugacuugacaaacaugaccuccguuuuucaccagauuauuuuguuauaccugaugggaaucaaaauugcuccccuuaaccugcuaauaugcuaauaauaaauuauagccacaacuaagaacuaggggaggaaugauguuuacucuucaacugcuauuuuuuggugcccauuaaaugcaccaaaagcagcuuuggaagagaguucaaccucuagggcaaaaggaaaaaucuaaacuuuaauuucuuuacguuuggucacuuggucaauauaugauucaucugugaauuuaaaugaauugaguuguauuaguuuggggcacacgaauuuauauuucaaauauuuccuuuuccuaaauaccaguaaaagaaauuguaagcaucauaucuuuuauacugaaauggacaacauccuuaagaaaggcaaucuacaucuaauauauauauaacccuuuuaucuuggcaggugucuaauuguggcacauuugcagugauuuaccaguuguguuauauacccucucuuauauaugaauagaaauucugcuuacugcugcugauguauuauggcuuuuccuuauuuaaggccauugaauuuuaccucguuuucuuccacuuauacucaagaaaguuaagugcguacacugaaugucccugcucuuuccaagagagaaaguuggguggcauguuaaccagagaaagcaggacccagcugacucacucacucucucucucucgucgucucugauccuaguuucucuuaaucaugaugagccugcuuugcagugcuaugaacuucagcagauugacuaggacugaucuccaucacauuauuucccagaguguguuugguagaaccccuguccuuuacaaguacauauaauggucaaagaaguuugaggaugguaccuuauauuuugccccuuuucgggauucacaaugaaaggcucugaaguucugcccuaaagaaacaucuuuuccuuuguuaaucaugguguuucuugauucugugaagcccauuuaaaaaacaagauagagaaaaacuuacaucuaagaaaacuuaacacuucagggaguacaguuaucuaaugauaccuacuuuccaccccgacccucacuaaaauaaguuguucuuugguuauaaaggagauaaugguuugaaugagcaagcuaaacuugccaauuguauucuuccuuuuggagagaauacucuaugacauguuaugccuacgugaagggcuucaauaugaaugucuuggaguaagaagggaucuuaaaggucaccuaaagcagcauuggagccugggcaagauucucuuguucucuaugaauaccucuacuuaacacccuaccuacuuaaugugccaguacccuuucauuucuccauuugaaauagauugaaacaaaauauucacaguacaguguuacauucucagaguggucucccucuaaauucugccugauguucuuuaauuuggauagauggaacaacaaaacaguaaguguauuccccaaaucauuugauacuucagguauuugaagcuaauugguauuuuucuuuuaguuuucucuuuuuccggcuuaauacacaggcucuuuuaacuuuuugucauguauagcuucuaauuuguuucaucuuccuggcuauauuucuuaggcauucucuaguugauuauugucucucuuaaaaugaaugcaucaaaucaaacacaggguuccagauguggucuggccaguacaagguacaaugcagaugcuagcuaccauguuucagagauuacauuucuuugaauauucaugcagacuagaauuguauuaguuuucuuuaaacagucacauuacauuuuuggcucgugaguuuuuggucaaguuaaauucucagaucuuuuuauuugaucucaggccuuuuuuuuuuuuucuaaaccacugucaaaucaggucuuucucuucauucagaacuugauuuuguuuaaccuaaaugaaggccuuuauuuucauuuauccuuguuaaauuuaauuuugcugauguaggcccacuuggucuugauucugacauucguccuaugaaguuuccaugauccaggcuuuguacucucuucaaagucaugcuuaugucuaaauauaagucauugauaaaaauguuuaccaagggcggugugccacccugcuagaggcuuccuccaagggaugcaucuguuaaucagcugcagaaacuacuuuucaaacaguugccaguguacccuaccaggaauaccauccagcugcuauuucauuauuuuauucauagagguuauuuucugagacuaucauaugcucacuugaaauucauggacugugcuaauugcaguacccugaucuacugccugaaaaccucuucaaaagcugaaauaguugugaugacguuaacuuggcuuuacuuauuucccucuccuucccacuaguuccccuuuauuucccuuucuuuccuuauugcuuuuuaaugcucacaggaucuucuugucaucccuucaaggauuuugguaggaauucacauuaguuuuauuggaccauuauuucuaaaauuuuguugccuuuuuugaaaacagggauaaugucuuagcaucucccauuuuccaugaggcuucuaaaauaacugacacuaccuugaugauuauuucaacaaguuccuuuacaaucuaaaagugugaagugggggaggggguuuacaggacuggaggcuuaaauuuacuuuagagcacuuacauggacuucuugagcuacuauucccuuuuuauguugaucaaagaauguuugccucccuguaaaagauagucaugcuuugguuggaugauauaucauucucaugaaacagugagucccuuuguuauucacacuuaguagcaaaagcuguuucuguggcuuuuaauaauuuuaugaguuucaucucauucugagcacuacaggucuuccugguuaguaguauuaaaaauuuugucauuaguaaugugguuugcuuuguauuuuugcacacuuccuuucuuaaguuugaguccaucauaaaacaucccuaugauagcacuaauuuagaaacuaugcuccauuuuuuucuggaaguguuagcaauuauauagugaaaauuauagaguuuuucuguuuguuuguaaagagucguauucccucauaaaaauuucuaauccgaacuuuguauaauauguucucuuuaaagucuaggcugggucgucauuuaugccuuauauaguuagcauuucuuacucuucaacgcccugagguaauauggcgauuuucuuccagacuuucuccuucccagcuuguucuucccuauuaaucagaauugagccauuaauauuguccgucuugcuuucugugcuuccagaaaggcagcauuggcuugguuugauggugcaacuguaggacuauccgaugugccuccuuucccagcaaggauugaggcagaacccacagauuccuguguccaguucccacuuccucccuuucuaguuuagauugccucugggcagcauuagauugucuucuagcaaaaccugauaccguucucugucuauccugguuuaucacaggauaauuuucuguucauuuugaagaaaauuauucacuaaaauaauauauuugacauaaauuuuuaacucagcuaguuaagaccauuaguaaggauuaaaauauauguaacaaacucagagugcccuauguggaauaaaaagcuuguaucuccaaccuuuaugcuauauaaaaauauauuugcugcccuggcuuuuuuaaaaaaggggcauuuugacauuuccuguauauucaauuaaauacuggcuauguuacaugauuuuaaacuuuugaaauauaaagauuuuuuuuacuuaguuacacagaagauaucuaaaaauaauaauaaaauaaucaaccaaauucuacauaggcagaucagaaaguguuagaagucauugacaaagucaucuuguuauaaaacuguaguuagauauacacagggcuauguguuagacgucccccaaaccacucccaguuuugacaguucuccaguaggucucaugguugugauuuguuaaagcaaaaauacacaaagcaaaaugagcaaagggaaaagguucaugggacaaagucuggagggacaaaggagucuucucccaaguggagucaaacaggacaugcuuaauucuuccagcaaccaguuaggacaacacaugggaaauguugucugcaaggaagcuuauuagggacucaaugcccagagauuuuauuaggggcuggucauguaggcacccucugccuaaccuguugcaaaauaccagacucccagagagaaaacaaguguucagcauaaauugcauuguuuuugcccacaguuuagacacaaugaaccauucuuaucaguuuugaaaaugauaggagcccuccgcaaauccaaguggccagauagccaagggucagucuugcuaguaggccuuucuaagcucaggccugcuauguuaaugcauaucugcacaggaucucaguaucuucuaauggaaaagcaaggaauaagauuaauggaguuaaaacauaaagcucaaucuuuaaguuucuccuugaucucuggcuugauuguaaaucagcuugguuuauucauacagaucauaauggucacuucugaaauucaggaguacaaaaauaagaaugccugacugcccuucaacauauuucuuaguuggugcaaaauucuuggauaagauuuuacuuuuggcagggagcuggaccugcguuuggauaaccuucuauuuugcagggaauuuuuccuguguaaagcaaucucuuaacauuugugaacuucacauucaucauuucagcuguuuaugagccacccuaaaggccugugagguaucaauucauaauuuuuuugagauguaaaugugaauggaaccccaaagccucucugcaggaggcaguccauuuagcugaccacugagccuacugccugugcucuagacauuucaauacuauuuauucuuguuacagcagcaaaacucaucgcuagugcugaugaugcaaguguagacuuccauaagguaguuagaaaauagaacauuuggauaaacuacgcaaguggaauuugacagccuuuuagauccauggcaucccaauaacauuuggaaacaagaaaacaagguucaggugauaauuuuggggcauuucccucuagcaccaaaguugguuaucaagugagcaaacaaguggaaagugauggauaauucauguaaggaugggcacaggaaacgaagcugcagaggaacuguggagggaaagccagugcauaugcacagauuucaugugaaggccucacaaucuucacagaggcugagauugguucuucugcacagucauuucacuucuuuuuaguucacuuggcuauaaauguaccacuuaauauaggaggcgaaucugaaaggcuaaaugcuccacaggcuauggcuuauuuucuugcugauucuagugaacuuccuccagguggacagcagugcccaggcuguggccaaaacagcuccacagcccccacggauguggugggcaucaaucaugaaaguuuaaugauauauguaguucuuuccuguuuuaugaagcuuuuuuaaaaaaaccauaagaguaucccuuuuucuuuaguuaaaugagaacuguucuauguaguguuucuuucacuaagauauuaaaggagcuacuugauacuagcaugagagguuugaaagaacacuguagaaugaauaaguaccuuccucacugacuuuccugcuguuuggaaauauaaacuugccuugccucagguuuuagcagaacaaaccucucuaagugaccuguuagagcugucuuuugcgcaguauauaggacucaaugccaaauauguguacaaguagcccuuaauuuuuucuucuucuucuuuuuuuaagcucuauagcuaccauuuauguucugaguuucuuuucuccuuagagauaaaggagagaaaaucauugaccauuaggaugaucacuuacacaaaauuuuuuagggacaucuuucaauuaguaguuucccuggugguugacuucugucacugcuccaccuccugcuaguaggcauuuagcugcugugugguuaauauuuucauuuuuauuaaguaaccacuuggcaguuaucacugaaguacaauuuauauaucuguucucaaaauucauuuucuuuuaaauaaaacauaguguuagaaacauacagauuuuugucagcauuuaccuuuauucuggucaaauguaauuuacagaggguuuaguggagauucaaaaagauuaauuuuauaaaaauauugauugcuuaagaccuuggauagccuggauaggcaucuacuaacugugguaucccuuauuuauuugaugaguguaauuuaaaaaguuaaaugaaggugaauuguugugaaauaaaaaccuaacagguccuuuuaauagaauaaacuuaaaauuaauuguuggaguucaugucuuuugucacuaaagaauucaaccaguagaaauguaacucugaaaaaaaauuauuuuccaaaauguucuguuauuuaaagucucauuuugucucauguuuuguguuaauaucccagugaaccaguauuagcauacaguucccucuguuuauuguuguauucuuucucucccucuucaagacucaaugaugaggcacggcggcucauugcugauuuggggagcacaucuauuacuaaucuugguuuuagagacaacugggucuucuguggugggaagggcauuaagacaaaaagcccuuuugaacagguuagugucauagacucucagaauuaacaaaaacaaauucugugaaaccuuacgguacauuuucccaucccagcuauuugaaaauuagauaaagcggauaguaaauaugaucauauauuugucauaaauucuugguaaucaguuauuugaaauaacuaucguacuuuuaaauuucaaaacuugaaaauucugcaugggaauauuuuuuccuacaggacaaugcauuggaauaggauuaccuaucuuaagccuuuucggaagcuuuaguuauuaaggauuuuaauugagcuuuggauuuuagaaucagugaaguuuggaaauauuuuagaacuuaguagaauguaaauguuaguuuuugaguagcaaauaauccuuuaaaagcacgugcaauguauucuuucagcuguuauuugaaggucugccauguaugugauacagccugagggucacucauuuaauaucuugaccaguaauuuaaaugaacuuauuguugacaugaguauuacugaaaugagaaguguguaaaauguuacggcaaaucagcaguuuacaacgguuuuuuaaacuguauauuauuacuguguuccaauagcacauaaagaacaauaaggauacaaacaaauaugaaggauggccugaaguuguagaaauggaaggaugcaucccccagaagcaagacuaauggaaauguggagagaauugaagaaagcgcacuuucacucuuaaugggagagcuauaaauggcagagcuauguguaaauauuuuaagagcaugcagccaucuuggugugugcaugaguauugucucuuuugauaucaggauuauuuauugcuaacguaaauagauagcauuguaaauaaucaucacaaugaucaaaucacugaaccaugucuccgcacauuucccuaaaaguacaauguuuagacugcuaugguaauacauauuuuaaauucuaaaagcauacacaauguguaacugaaugguuugugaaaaauauauugauauauauacuaguugcuaugaaaauaucauggaauaauagggauuuuaggguggauacuuuauuuucuuuuauguuucuauauguugcguugugaugacauuaucuuuuaaauuaaaaagagauuuggcuaguuguguguguaauguuacuuuacaguccgacucuccugauguaccucuuuucaugaucuuuuucuuuccuucccaagaaacugaggaauguuuaauaugaaaacauacaucggauaugugaaaagcacaacaaaauucuuaauguacacaguaaaaaaguaaauauauaaauguagauggcauuuaggaccacagcuugcuggauuuguguuagcuaugggaauaacuugauuuuguauaagcuauuuagagugaggcuggagguggcagcuucacagaacuggagaaccaggccaaguccccuccccaaccuaauuaggucauucaggacagcuaagucaguauauuuagagcaauacuagcauacguuuuucuuaauuguuaucagcauugaccaagugguuuggaaggaggcaugcuuuaauaucacaauaauuuugauuuguaaaccaagaaauuaauccuguguuuaucuaacuucauaauagcaauuauugcccgaagcuauaguggcauauuuacaaaaguucuuauuacugggcggacugauaacauuuaaaaaauaauuguguuugaccccaaaugacuuuauacccaauucuacauaaaaauauagaagaucuaucuuuuuuuguuaccuucagauguucacuaaauaacucaguuuuuaagcagaaguuuucagggcauuaaauauauguuguguaugaaguaucucaaacuggaacauaaauuuagugaucaaacugccauucacaguguaaggcagcacuuaaauuucgaaccuaaaguuuagaugcauuguauaaaaaaaccuaaaagcaguaucuguuauuuagcuguaaaccaaguuggaagcuauucggauaauuucuuaaauauugaugaacuuuggaguacuguuucuuccuucaaacugaauguaauuaauucaugaauaaaugcaccuuauauguuuaaacaaucuuuguauacuuuugggauuuuuggugcuuauaugcuaaaucacauucagcauguguauuuugacauuuaaaauacuucccucaauucuguaaauuaaaagaauaguuauuuuacaguuccagggauugugaaauaaauguugcaguuuuuuaaaauaaugaaaauaaauacucuugguuuugcuuugugaauuuuuuuuuuuuuuuguauuaucuggcaaaguaauauaccuacagaacuucacaaaaacucacacaagguuuuucaagcauuuauuauacugccuaacuuggaaaaaaaauuguugcugugguuaaaaauaguaauauccuagaugugucuuaacauguaagaagcuaaguaucuagauggcggaaaaagcccuuuuauuaagacuguaaaaggauagcuuuuccagauauauaaaauguuaaaagaagacaaagauugguuauguuaacuggugugguuuccuuuugucucaguucaaucuuguauagauugugccaacuuaacuuugaaagcaauaacuuuauacuacauuuucagauaccucuuuaaaaucgguuuuagacaugaaacagugcucauuuaauauuaagaauguucuuuauuaaaaucaaauuaacauugac

SEQ ID NO: 14548 - RNA, 2630 nt, Homo sapiens
uaagauggcgucuccucaggggggccagauugcgaucgcgaugaggcuucggaaccagcuccagucaguguacaagauggacccgcuacggaacgaggugcaagggcggcaggguuacugcuguggucggccagcggugcgaauuggggcgggcuaaaggacgggcgguggcuggccgggcgcccagugcgccugcgcagagacagagugcccagugcgccugcgugguugcgaucggguugccaaacuccgguuaggacgccugcgcguugugucgccgacguuguguagucuccccugggaaaggagggucaggcgaguccacgugagggaagcccccgcugugcgcggagcccucugcugggcggagggggagugccagcccccaggagcuaauccccggcugauggcgcagggcgcggggcuuggccgucuagugugaugaaggaggcgacccccaaggugggaaggcgcacggguugggguuugaggguggaugauuggugacggaggguguaucuucaggaggagguucgagugaagaucaaagacuugaaugaacacauuguuugcugccuaugcgccggcuacuucguggaugccaccaccaucacagagugucuucauacuugugagugccuuggagacugccuaguucuuccagucccuagucuucaccaagcugacugccagcuucugugcggccugccucacgcauccaggcaccccacccagcccaugaauccaguuuccagagggccugagaaucugcuuuucuuuuccugcagucugcaagaguuguauugugaaguaccuccaaacuagcaaguacugccccaugugcaacauuaagauccacgagacacagccacugcucaaccucaaacuggaccgggucaugcaggacaucguguauaagcuggugccuggcuugcaagacagugagucaccaaccugacuuugaggggccucuugaggacuaauugcugaguggcagcuugaggugacggguuugguaggacucacguaggcagaaggccaaagaugagggaaggacaaaaagugaggaagggcuaauacuuuauucuuuuuuuucuuuuuuugagacggagucuugcccaggcuggagugcaguggcgcaaucucagcucacugcaagcuccaccuccuggauucaugccauucuccugccucagccuccugaguagcugggacuacaggcgcccaccaccaugcccagcuaauuuuuuauauuuuuuaguagagacgggguuucaccauguuagccaggauggccucaaucuccugacuucaugaucugcccaccucugccucccaaagugcugggauuacaggcgugagccaccgcgcccggccccgaagggcuaauacuuuauucucauacuucaccuucuucuaggugaagagaaacggauucgggaauucuaccagucccgagguuuggaccgggucacccagcccacuggggaagguauguccuuggccgcgggacaguaaagaccccagagcauucuucuugcccaguuuugcucucuggggaaagaggaguauggaaugugugccaccagccaccucacuacccuaucuuucucagagccagcacugagcaaccucggccuccccuucagcagcuuugaccacucuaaagcccacuacuaucgcuaugaugagcaguugaaccugugccuggagcggcugaggugaggagaaggucagggguugcaggaggugacagugccaaugacccagagccagggagggucuaggggagaggcugagcagugagugagugccuauccccuugaagagaguauaucauggcucuggguggggaagaggaggaaagauaggauucccuaaccugugucuauuuccccccaguucuggcaaagacaagaauaaaagcguccugcaggugagaagggcugaggggagggccucucuaaggagacucaccucccaugguccuucccucacacaccuugcccucuucccuccccucccugcucccagaacaaguauguccgauguucuguuagagcugagguacgccaucuccggaggguccugugucaccgcuugaugcuaaacccucagcaugugaguagucccacaguagguuucuugagggggagaaggggcuaagaaaggagggacagagucuaggguggaccaggguaguuuuugaccugccagaaaguuccuaaaauuaugcccccaucucccuccuaggugcagcuccuuuuugacaaugaaguucucccugaucacaugacaaugaagcagauauggcucucccgcugguucggcaagguaagccaggccacccucccugggaucacacccccuucagacuccccccaaccauccuacaguccucaggggaagggugggcugaggggcccuuugaauaauauaagaacauuccccacugacuacuacuuccucauucucuccuuagccauccccuuugcuuuuacaauacagugugaaagagaagaggagguaggggccaagcccccaccccaucccacuccccuucccuccccagauauuuaugugaaaugaacugcagcuuuauuuuuugaaauaaaaacuuuuaaaaagca

SEQ ID NO: 14549 - RNA, 14459 nt, Homo sapiens
cuuucuuaaaaggugaaaaacaaagccccggcugagguacagauaacugcugaacaacucuuaagagaggcuaaagaaagagaacuugagcuucuuccaccuccaccucaacagaagaucacagaugaagaagaauuaaaugauuauaaacuaaggaaaaggaaggucagucagugugguaucuuucaguccacuaauuguuaagacuguaucggucaguuugaaaagcuccucauugguuggauucuguagggcaagaugagguuaaguguuuccagacgcaugaauaauguacuucugguuaccagauaacagcauuuuucugaacuauauaaaauaugccaugaguugucugguuaaaguguaaagaaauugaaucugcauaauuuuugaugcugaaucaaagugagcggaaguuuagcagauggaacaacugacaacaagaaggaggguaugcuuaguaaggcugcacuguguacuucugucuauaccaccuucuguguuaagaauugagaucuggcugggcacaguggcucgcgccuguaaucccaacacuuugggaggccgaggcgggcagaucaccugaggucaggaguuugagaccagccuagccaacauggugaaaccccaucucuacuaaaauacaaaaauuagccaggcgugguggcaggugccuguaaucccagcuauucgggaggcugagacaugagaaucacagcaacucgggaggcagaggcugcagugagccgagaucgugccacugcacuccagccugggcgacagagcaagacuuugucucaaaaaaaaaaaaagaaagaaagaaagaaaggaaaaggaauugaggucugcaaaaggaccaugagaagacuuugggaucugauuugaccucuucacucuagaaugugggacuguuuuaaagcacuaaugcuguuauauaugaaauucugagaauuaccagaggacuuaaagguaauagucaaaaacauuuuuuauuagggacaagcauagaccauuuuaaaguaucaguuaguugacuguaaccuucuguaguggguuucuuauuccucaaggauuccaggauguaauuucucuuaaauaugaacaaaaugaauaaccauuuuaguacaagacuuaaaauagaccaagggugcugucauuuuuagucauuugucuuuugacuugacccuuuuugccuucuuccagacuuuugaagauaauauaagaaaaaacaggacugugauuaguaacuggauaaaauacgcacaaugggaagaaagccuaaaggagauucaaagguaaaauuacugagaguguaguuuuguauauaaugauucauagauuaacagauaccaaaaagaaaagaagaaaaaguuaaagcacagguaaaagauugugccucggguagaaauuuucaacuuugguuccauggaacccuaggguucccuugagggccucaggaguacugggguagaauaguccuggggaggguggcagaagaggcuuuagagauagaucuugucaguuguagcuaaagaagcacaauuucauuugcuuuguauauauugagauuuuuacaaauuucagcuaaacaauggccaaaaaaaauaaaaccaauggccaaaaaaaauaaaaauugcaaucuggcccuuccuguggucuagcuuucugcauucuccccgcauaccuccuucccccacugugccuguguaugugccacucccugaauauaucaugucuccuuaucgugaggcuugacuguucuccuugccuggaaugagcacccccuccucaccaaacuuaguuuccugguaaaucggaacguuccucaaguucucauuucuacaauuaccuacuacuuagccuuuuccaccaaacauuuucauuucuuccucucuguuucccgugcagaucuugacuauaacauaaaucacauugcauuauaauugcaugcaugucuuuuuauaagacuuuguaagguacuugagagcauuauaucuuuucauuuuuuuaugcccagaacuuggcucaugguagacaccuaauaaaacaucagugcauuccagauaguuugaaauaacugcuacauguguugaaugcucuauuuuugaugcccugcaaaucuugcuucuuaagggcucgauccauauacgagcgugcuuuagauguagacuaccgaaauauuacacucuggcugaaauacgcagaaauggaaaugaagaaucgccaagucaaccaugcucgaaauaucugggaccgggccauaacaacgcugccucgaguuaaucaguucugguaaguuucugaucuaacaaaacagccuuuuauagacuagcaaaguuccacaucuucuguauuuauuuuauuuacaugaugauaguuuaauuugauauccuacuuuuucuucagacauaaaugcuguuaugucccauagucuauuaagucauaaucguaauguucuauagcuauguaaucaaaacuaaaauuuugauugcaaucuuuuauucauaagcuucuuguugaacuaggcaacuuuuaagaaaaaaaaaucuuuuuuuccaaugguucauccuuuuucagauuuacauacaaaugacaaaacauguuugauuuaaccuuuaagaaagguaaaaucuucaaucuucuucccauucaacaauggaagaacuaaaccacagcagauauuuucgggugauuuuguuacagguacaaguacacguacauggaggaaauguugggaaacguugccggugcccggcagguguuugagcgcuggauggaguggcagccugaggagcaagccuggcacuccuacaucaacuuugagcugagauacaaagagguggaucgggcccgcaccauuuaugagcgauauauccuuuggacgagaucuguauggugccaugauuguccuggaugcugcugcugcuccuguagagaugucucaugaucaggacacacagucauuaaugucaggcucaaagucaagaaugccaguuuaucagcuucccuauguuuuguagggaaagagauuggucagaaugaaaauuuguauucuggguaacuagucuuuucuagugagaguuuggguuuauuuuauuguaaugcuaaaagcuaauguuuccuuguggaaaaugauauuccugggggauuguuuccaggaacucaaggggauaccaaaaucggugaugcuuaagucccucauauaaaaugauguaguauuugcauguaaccuaugcauagccucccauauaauucaaauaaucucuagauuacuuauaccuaaugcaauguaaauguuauauaaauaauuguuauucuguauauuuuaaggaauaauaagcaaaaaaacgacauguucaauacagaagcacuuuuuucucacgaauacuuuaucucagguugguugaauccacagauauggaacccauggcuggaggacuaacuguacuaagguccuggcugccauugccaguccuguuuuucuaagguuuguguuggucauuacuaccuuacuggaguucauccaagguuuacuguuuacuagcuguguggcuccagagagucauuuaacuccuuugagaguugguguccucuucuuaaaaacaagaauaaaaacaccuuuguugggcuguugcgaagauuaaaugauacacaugaaagcacuuuuagaaacugaaguacagucauuccucacuauuugcagauuccauguuugcaaaaucacguauuugcuaaaauuuauuuguaacccccaaaaucaguaauuguggcacuuucacagucauuuguggacaugcacagagcaugaaguccaacaaggugaggcuugccuucuggucuuaaccucauauaaccaugccuagagcuuggagacaggaagggccagugccauguagugcaaggagcuguggcucuggggccagucggggaguuugaaucccugucaguggggcagccucaguccagucacuuaacauuucugaaccacuuuucuuacaaaauaaugaagauagaaucugccaggaugaguucuuuuuaggauuuaagaugaugaugaaugugagauuguauauauacacguuucuccuaggagcagugguucaguacucaauaauuaaguguucgcauugacuaaauagaacauaacuaccagaaauaaugagagucaacuuuauuaugcaguauuaagaucuuuuuauuuuuuuacucuucucuguugaggugacaauguuaagaucuuaauuaugucuacuaauuuuaauauuauuaguuugacgaaagcuuuuauagcacuugcuacgugccaggcaguauucuaaguacuuuacagauauuguuguuuaauccucauaacauccuugcaguguaggaacuucucuguccuacagaugagggagcugaggcaugagagauuaaguagcuugacuggguucucacaggugcugauggaaauagaaugugaaccuaguagagcagcuucagaacugaugcucuucuuugccauauuggaauauauuacuacuuuggaaauuaaugauuuauucaaggaagauagauuaaaaugacaauucaaaacuuucugcuuugacucuaguuaacaguuuucuuuuuauagcauguuuuuuucuuaauuauuaguucaaguauucauauuuuaauauaauuggugcuauuuaaugaccagaccauuauugaccgcuuacggugccauguucuuuuggcuagaaacugugcuaagggcuuuacauacauuuucucauuuaaagcuggcaguaauccagugaggcuggcauuauuuuucccuguuuacaaaugaaacagcugagacuuagacgucuaaguucagugacuuauccaagaucacaugguugguaaccuggguugagauuuuucuuugcuuccaacucgaguuuauacccaccacuaaaaucuuaacuaagcacuggaggaaaauagagaugaacaggcguggcccugcucucacagaagccacuguuuaauucuacacuuuuguauguguuuuguuccccuagaguuguaguuugaauuuuuggaguuuccaggcuuugguaugguuuugguguuuacuuacuuacuauuuuuuuaagccaugcuguuuugccugggauuuccuuaauucccuugcacuuguccucgugcacccugauguuaagaacuggaucaaguaugcccgcuuugaagaaaaacaugcuuauuuugcccaugcacggaaaguguaugagagagcuguggaauucuuuggagaugaacauauggaugagcaccuuuauguugccuuugccaaguuugaagaaaaucagaaagagguaaguauaccuaacuucauuauacuguaaaacagcuuagcaaagauuacauuuugugcauggugaguucauuuccauuuuuucuuacugacauaucccuggaaagauguuuucaaaauacaaaaacacagcuucucacagagaacagcauauauaugugacuaagcuacagaugggagcugauuauagauuguauuauaacugucuuaauuuuauugugcuuuguuugaaaauuaagccuuuuagucugaaugcccguaaacugagaacuagucuuuuggcauccuaaguaaaggacuuaaccgauaauaaauaugggaaacaaaaagcuuaaagcccuagaacagaaaacauuuagaauggaaacagagauugcccuacaaauaagagaguucuuuuuuucccuuguaccuaugaaaauagcucaaauauugagaagaugaggcagaaggaucacuugaggccaggaguuugagaccagccugggcaacauagugagacccugucucuaaaaaaaaaaauugagugggcauaguggugcacaccuacagucccagcuacuugggaagcugaggcaggaguaucacuugagccuaggaguuugagacuacaaugagcuauguucgugccauugcacucuagccugggugacagagcaggaccccauuucuuaaaaaaaaagggaguucaaauaauacagaauugagauccauccaaauacagguuugagcauucccagucugaaaauccaaaacucaaaaugugaaacuuguugagugcugacaugacacucgaaggaaauguucauuggaacauuucagacuucggguuuuuggauuagggaugcugaaccaguaaguauaaugcaaauauucccaaacuggggaaacaucccaaauccaaaacacuucugauaccaaaugcuucagacaagagauacucaaccuauauaaggucuugcacggaccaugcuagggaguucagauucuguucgggccagugggaagcauugaaagguuuuaagcgggacagugauuggauaugauuuauauuuuaaggagagccucuggcuaauucauggagaauguaugaggguagauggcaaaaguggaaccaggggagaccaguggggagacuuuugaagugggccaggugaacaguggaguuugauggcugggggcuggggagaagcaaauggcuguguggaagagauugaaaugguagggcauguugcaagagugaauauggaguaugaggaaaaaagaggaauugaggaucaccugaagguuuuggcuugagcaagugacuguagguuaggccuugccuacuaaaauugggaagauggggagagucccaguuugaguggggaggaaacagaagcucaguuuuggaccuguuugagaugugcaguagacauccaguuggcaguguuagguagacaguauuaaauauggagcucaaagcagaguaccgguccauccugacagagauaaccuucaacaagagggagaaaagcaucuuacucuggauauuaugaggccucaaaaucuaacuuauaaguaauauuuuguuauauuuacucuccuaguugugacuggcaugagaauauuguguuauagaagguaaucauccugucugcauuuaguuugaaaggguacgagugauuuacaaguaugcccuggacagaauuucaaaacaagaugcccaagaacucuuuaaaaauuauaccaucuuugagaagaaguuuggugauaggcgggguauugaagauaucauugugagcaaacggagauuccaguacgaagaagaagugaaggugagcacugguguggauggucaacucugcagauaacccaagaugugcucaucaauacuagcaacacuaaaaugaauaauagcaaguagcacuacuagugauuacucucgugaugaugugcccgugauccaauuggcagcuauuucagacaaguaggaauaaacaaggcugauagaaaaggcaagcaaacaacacuuggauuugcucugccacuuacauguuguaagucguuuuguugauuguugacuguauguagaacuggagcaaaagaaauguggaauccauucgagcucauuguuggaagaagguggaagagucagagauugguccaaaaaccuguuuugcacaucaccuuugagcuuaacugccugaacaaaagauguaugcuagacaggguuccaucggcaucucuuuuucuguaauguacuauuuugauuucaauucaaagagagugucauuuuccuucaguauucuguuguguauuuaaaaauacucuuccuuagucaaguuaauuaagauaccuccaagcaaaggacuaagucuguuauuaaauguggugguagguuagcaagauauguuaaagaugaauugcuauuaauuggaaaggcaaguuuaacaauugugagcaugauacgauucuguuguuacagacauaaugauacauagucacauauuuaagcaaaugcauuggcaagaauaggcaucuaauuauugacugucgugagagugauggcuauagaugaaggaguccuugcugugggacaccuggccaguaaucuauccucuguauuccuguuucuuuucuauuuaugcagucucagggaugguguuuuuaaaaugaaagaacauguaacauuuagaagaaaaggugcuaaaauauagaaagucagccugaugccuuuuuucagcuugcuuaaccuggcaagugcagcucuugguuuuguuuuuuauuuauuaaacugguugucuuucuaggcgaauccacacaauuaugaugcaugguuugauuacuugcgcuugguagaaagugacgcagaagcugaagccgugagagaagucuaugaaagggccauugccaaugucccacccauucaggagaagaggcacuggaagcgcuacauuuaucuuuggaucaacuaugcacucuaugaagaauuggaggcaaaggugaaaaaacagaauuaugugucagcugauaaugguuuccugucuucuguauucacagcucaccuauuguggauguuuguaauucuugaaagaaggaaauuuaguuuuaaauuuuuauaggcuucuguucauccauacaguuauauauucgcucugcaacauuuuaaacccucugugcuuguuguggccacacgugaggggcuuuuuuaacuuugguuugauuuuuacuugaggcacaacaagauaucacuuggagcuugaaagagaacagugaaccagcccuuaauuuagugaaauauaguuuccuggauuugcucauuaauaggaguaauucuggcuagauuaugcauuuuugcuuuuagcaaaaaucaaguggcauuuucagaaaucauuuguauuaaccuucuggguuugaucugagacuaugaaacaucuuuguuucuuucugccaucaggcaaaacggcuuucuacaaagaagggcuuagaaguuugguggcuaucuuguuggugauucuuaaacugaaguuucauggccguucauacuuuagaucauaaaucaggguuugcaaguaacaacuugugaaacaugcuguuuuggggguguacauuuuuaccaauaucaguaaaauuaguaacuaguaaaaugaguguuagcagcagacuucaauauuuugugaaaauuucuuauccuaauacaggauccugagaggacaagacagguguaucaagccucuuuggaacuaauuccucacaaaaagguauguuugcucuaaaguguuccauuucaaacaggucagaauccucuucuguuacuugugaaguaauucagugaaauaauauugauugauaaaaugcuucccugucccaccauggacaacauaaauaagacugagauaugcuccuugccucugaaaacagcucacagacuagguuggaggacaaccugcauugacaaacaaauaauauaaauucagagaaggcuagguaaugugaauagucugaguggaaggagaaagacauccaugcagagagcacacaacgugugcgggggacacacaggcggguuuguugguaacagugagugugugcaugcacagaugaaugugccccuuguguagaugguugagauguuaccuccgccuuguuucccagcacgagaaacaaaacguguuuccuucuguagaaguguugacugaguuacuuuucagaauagagguaggacauucugcccauauacaagcaugccuacaaaacaaagucuguucugagcagaggcuaccgugccauacaguacaguacaguaucuggaucaugguucucaggagagguuaccaugccaugcaguacaauauaguaucuggaucaugguauguggguuucuaacuuuugugaaaugaauguggucuuugcuuguaaauaagcagaguacauuccucuuacucugaaguuuuagagaaaucgaauuaccaauggcuuugguuaauuuaaauuaauuuuaauucaauuuaauuuggaugaggcuuuuaagcuagauauuuuugugcuuuuguuuucuaguucacauuugccaaaauguggauacuguaugcacaguuugaaauacgacagaagaaucugucauuagccagaagagcauugguaaguaaagaaaggaucaagaugucucaucaaguucuaugagaaagaaauuaaaaucuuggugcuuggaaguuguacaguuccuacuuuaaagagugacagaaguauuauaccuuuauagccugggacauguuagaaaacaugcguccucuguaaaaacacugacuaauaaugcguaaauuauucuuauuaccuggggcaaauuaacauucuguuucaauauuggaaacuucuauagcuaccaguuacuaaaucuuuccacagacuggaauuaguaaucugauccugugcaaacuuuuugguguguuaaaugcacuuuuaauuguuccacuuuuuuuuucuuuuuuuuuuuuuuguuuguuugguuuuuuuuugagacagggucucgcucuguuccccaagcuggaaugcaguagcgcgaucuuggcucacugcaaccucugccuccugggcggaaaugauccucccauguuggccucucagaaugcugggauuacaggcaugagccaccaugccuuguccuuuuuauuuauaggagguuuuaugcauuugacaucccuauucccuaggagauccugagaaacuuucaaaucuuauuuuauuuaguugcccaaacaauucuggaacacugccucuugcugagugaauuagaggaguuuccuucagccuuuugucaagaaccaguaaacauugugauaccacagagggaaagaaugguaggccauguugacuuugcaagauucuuccucagcagagaacagccucuagggcagugcaauaacugcacagauuaaauccacuacaguaucacaguggucugguuauuuuauuuuccagggaacuuccauaggcaaauguccaaagaacaaauuauuuaaaguuuacauagaauuggagcuacagcuucgagaauuugacagaugccggaagcuuuaugaaaaguuccuggaauuuggaccugaaaauuguaccucauggauuaaauucgcugaauuagagacaauccuuggugauauugacagagcacgggcaaucuaugaauuagccaucagucagccacguuuagacaugccagaggugagcaucucaagucaaauauaauuuuguuugagauacguguuuagucuuacuuuagaugaccaucuaaauguggguguauuuuagaguauaacgaugaucuaacuaacuuagucucuucuacucagauuaggcuuguacguggaaagguggcugugggggacaggggaaguagcccucucauuagauaccagagcaguagacauccaggaugaugcccaggaugaacugggauaucaugggggugggugacgccccuucugcagcaggaaagccuaaaggggcuggggaagaggccaggcaaggaagaagccagcaggcuggcccacccggagaacgagggggauggagguaggaacugcacaucccuguauucucuaaaccaggauguccuugcaacuucuguugucacuguccugaaaguccucgccugccuucaguaguuaagcuugacccacaagguagcaccaaaccacagcuaggaaagauuugaaucucacaugagucguagaacucacccagccguuuuguuaaucucaugcacuaacaugacccugcauuuaaugguuuggcccccugauugcauuaauuaaggcagggcuuuggguaucacugaguucaucaguuguccucggcuccuccaccagacugccagcuuucagguguccaugccacgguuuauucauccuuauucccugccaggcugcaccgagccagugcgcaccuguucagugaaugcuuguugcacugaacucucauaauaacaaggaauguacaguagagguaagaacaugcauacuggcuaaccugggccuguuuucucucuggacgcucaauugcguguggcuagaauauggaguaccugggagaugcuuggcaaguuucucagcucuugauaagucaagcauuugaaaaacuuccaaagagaaucucuaagacugaauccaaggcccuuuuucuguaaucuggaauucuagccaaguuuuggccagcuuauagauaccaauguuauuuaucuuauccacauguguucuuuaguuguucaguaaaaauccuauguuccuagauguagguuagagugauacuucagcugugcuuuggaugggggcaugcugcuuuguaaaugucaagacugacccauuuacuuuucuuccuuaggugcuuuggaaaucauauauugauuuugaaauugagcaggaagaaacagaaagaacacgaaaccuuuaccggcgguugcuucaacggacgcagcaugucaagguauccuugcuuuguagaugaucuuucauuuugcuugaaucagcaguccagaagaaaaugauauauuucuguauuuuaaguguuuggguuuuuguuuuuuuuuuuuuuuuaaugacuuccuugcuuuucaagagaaacgugagucucagaggacuuuggaauguuuggaauguuaaguuuauaccaggucauuguuuaugcugcaugugaguagcuuggguaucacaagauugaaaaaaaguuaaacuauuuuuuuuuuuuuugagacggagucuugcugugucucuaggcuggagugcaguggcguuaucucggcucacugcaaccuccgccucccagguucaagcaauucuccugccucagccuccagaguagcugggacuagagacgcgcaccauaaugcccaggcuaauuuuucuauuuuuaauagagacaggguuucaccuguuggccaggauggucucgaucucuugaccucgugaucugcccaccucagccucccgaagugcugggauuacaggcgugagccacugcacccagccaaguuaaacucuuuucaagaguuuaagacuaugucagacauuuaauuguagaauguagaaucaaauauuuucaguguuuauauugaagcauauauucauuguuuucaucugugaaacauuagugaugcacacauuacuuuccgaugucauuaacugggaauucgcuuuauuauuacuacauuauuaucuucugagugauaugguuaauuugguucaauaauaacuuuuuuuaaagguauggaucagcuuugcucaguuugaguugucuucaggaaaagaaggaaguuugacuaaaugcagacaaauuuaugaagaagcuaacaaaaccaugcgaaacugugaagaaaaggaagagagacuuaugcugcuggaaucuuggcgaaguuuugaagaagaauuuggaacagcuucagauaaggagagaguagacaaacucaugccagagaaagucaagaagagaagaaagguccagacugaugaugggguaagaacucugcccugggacuguucaucucacgucacaugaguagaaacacuucugacgucgaaauguggacuuuuaaguggcauauguacaaucuuagaauggaagcagaccaccuggaguaggagaugguugcaaucuggcuguuauggaaacacgggguagaacauaugguccagucagagguggagaacgggaagggguuggcaaagguguuuuggugaugguugagucugggaacuucaugaagugugauauuuuuagagcauuuaauaggaaguaaguguggaggaagauggaacugaacuuucagauaggagccuauccagagaaggcuuguaggcgguaagaaggaguuuggugggagucagugaaggcuguuuugcauaaaaugacgugaccagauugcuagccucucauccuggcagacucaaggggcuuagauuggagaaagaagacccaucaggaagcaguuuuuauaagcugagcaagacauggaagcuggaacuagaacagggccacagggccuguuagaacaauauuugggaagugaaaucagugacugauaggaggugaggaugggaagguagggaguuggaauaauaaugcacagauguauggcuuuugcuacugggugaauauuauguaaagaucguuaaacguuuucuuaaguguaagacugcacaauguaguuggagacacugaacaucuugguuggcuauagaggagcugugcuuagauuuuuagaauguuuuucuaccaguuuaguucucacugagcuacaguugcugcuuacucacucccagucuuucagacccagcccuuguucuuucuguaguagacuuugauguuauuuuguaaaauggagguaaucauccggauuuccaguaaaaauucuucacucugauaugugaguauaucacccacguuugcuuaucuuuucauuuuuuauuucuguagucugaugcaggcugggaagaauacuuugauuacaucuuuccagaagaugcugccaaccaaccuaaccucaaacuccuggccauggccaaacuguggaagaaacagcagcaggaaaaggaggaugcugagcaccauccagaugaggacgucgaugagagugaauccugaucuuuuuuucauagacaaa

SEQ ID NO: 14550 - RNA, 16182 nt, Homo sapiens
gagagaucaauucagaggaugcucaagcuccguuaucacuuucauuuuacuaaacugagaaaggaagguugaggaaugcaucaacgguuaagcacagugcagguuccuacagcgacuggaguuuuuugguaguugggaguguuucccucaaucuuugggcaagccgucagcaguggcaggaacaggaacagacagcugggaaacccuuucuuuccccaaucgucuucuagcuuagcuuuaggcuuguaugcccaucgcgcaugcgucaauuuuucucuuuuaagaugggcggggcagagucuuugcuccuuuggcgauccugaagggguggagcuaagcuguuuccagggugacagaguggcgaccucgguggucgauugagcaggucugagaauuguucccaaaggguugugcgucaccgagucguuggcgcugucauggcgggugugcugaagaaggugagacgaauggaggucacuguuggaauuuagacuguggggguagacucaguccgauagcccuacuucccgcggguguugaccccuacugucgcgggcucggcggugcuuuucggggacucguucugcaugccuuaccggguagggcagguuagugguuccgcuccgagagucaggaaaaaagcuccaaacaagcgagacugagagaccaguagcuggcuuuagaccaguuuuagccgggggauucgugguuuuguauuuccuuagcgugcuggauguauggaaaccguaguaaacagcaugaaucguguuuuguuuuugaacagaccacuggccuugugggauuggcugugugcaauacuccucacgagguauguaccuuuguucuuucuucguucuugaauucccaaggaagacuaaauuccugucacuuugcuuauugcaggguuaacgggauacagauguuucaagcccuuaauuacaagccgcgugagcucuugagacacgggcgcuguccaccuacuucguugauccgaugucacauuuuuauuuauuuuugccaugaccucuuuauuaagccaguuuucuuguugacuuuuuccuugacauuuucauggcuucacuugugcuugcuucugucagcgccaucucaaauuuauaucuccguuuuccaucuuuucuccuugccuuaccguuucugcuuaggugcguuggauuacauauauuuaggcuuacuaaagguacugcccccuuuuccuucuguuaggucuuuuccaucuguauucacgaauguuuucaucaaaaaaacccacaaaauuuuuuuauucuucuugucccuucuauaaucacaccauuucuuugcuucacuuuacagauaacucaaaagaguuaucucuauuuucuccaauuucuuucuuauucacccuugaaugcacucagucacccuuggcguuuuucaaguucaccaauuaucuccaugcugccaaauccaauggucagcucauauuucucaccuucauugaccuaauagcagcguuuuuugacacauuugacacuuuuuccaucacgcucuuuucaaguucaccaguuaucuccauguugccaaauccaauggucagcuuauguuucucaccuucauugaccuaauagcagcguuuuuuuuuuuuugacacauuugacacuuuuuccaucaugcgcuuucuuuacugggcuucaggacucccccagucuccugauuuuuucccccuacucuuuggcuuucucuuuuucugguuauuucucuuaugcccacuuuuaaaauuugaguuagucaggauuuaguucuuggaccuuuucuuuuggaccuguacucugucaccaagagagagcaaauccaaauagagaacgguuuuaaauaccaccuauacacugacaacagauuuccauguaaagcacugaccucuuccuuuauaaaaguccugaauauuuaauugcuuagugggcaucucuauuuguaugugucagacaggcaacccaaacuuaacauguccaaaaugggguuccugaucuucugccuaaaaccugcucuucucucagucuugcucaucucaauuaauggcagcucaauuauuuugacucaggucagaaacuugaaaucaucuuugauuccuuccuuucucuuacacuccacauuuguuauuucaguaaacccucuagguuccaccuucaaaauauaucuugauuuugacaacaucucacuaccuccucugcuacuacccucuuccucagucaccaucaucacugauguggauaauugcauucacuucuuaacugccucucaaugcuugucacagccuccauuuggucuuuuuuuccagccaggcuacuagaguuagucuguuaaaauaugagguaggucagaucucuccuuuccuuaaaacuaauggcuuuccauuucacucuaaauaaagacaaguuucuuacugugacccucugguucacuauucuacugauuuauuuuguuaugucucuacuagaauguagguuucaugaaggcagggauuuguaauuguuucacugcuagaacucugucacauaguaugugcucaguaaauaguguuaguugaaugagugucuugcacuuccuaugauuucauaauaacuuuauugucauugauguaaagaacugaacucaugguuuuucccuucuaaauauauuucuuccucugugggcuguauuuuucuugauaguuucagaucuuucuacucccuaggcugggaauuuggacaucauaguugguauuucucuuauacuuguacucucauauucauuccaaugaugauuuuuauuuuuauuuuuuuugcugauccuuuucuauaacagcucuccagucugacuucuguuuacuauuucuauuguuacuaccauaguucagguccuuguucuuguuuagagaauugcaacaaccuccuuacuggccuuucugccuuguuucuccuucaguccuuuuaacucacuacaaugaagcuaauuuuccuaaucuaaucauaugauuuuccuaaaucuuuuaauuguccacagaauaaagcccgaaugcuuuaacuuggaaugcagaaccacuuauaaugugacauuuucucuaacuuuaucuccuaugcauuuccuuauguguccuguacagcaguauauuccaaaauccccaguggaugucugaaaaccacauauaguaccaaacuguauauaugcuauguuuuguuucauacauaccuauaauaaaguuuaauuuaugaauuaggcacaauaagagauaagcaggcuggacgugcuggcucacgccuguaaucccagcacuuugggaggcugaggcggguggauugcuuuagcccaggaguuuaagaccagccuggccaacauggcaaaaccccgucucuacaaaaaauguggaaauuaaucaggugugguggugugcaccuagucccagcuacucgggaggcagaggcagcaggauugcuugagccccagagguugaggcugcagugagcugugaugaugccauuacacucuagccugggugauggagugagacccugucucaaaaaagaaaaaaaaaaaaaagagauaacaacuaauaaaauagaacaauuauaacaauauacuguaauaaaaguuaugugaauguggucucuuugucucaaaauaucuuacuguacuguaccacccucuugugaugaagaaaggauagagugggauagugugagauuucaccacacuacuuugaacggcacauaguuuaaaacuuauaaauuguuuauuucuggaauuuuucauuuaauauuuucugacugagguugacuauuaguaacugaaaccuuggaaaaugaaaccacggauggguaaaggggagcuacuguauucuaaccaagugcuggccauuaaaaacauaaugcgagccuuaaauguaagccauauuuguauguaauuuaaaauuuucuaggacuaauuuuuuaaugaagaaaaagguaaaauuuaauuauuuuauuuacccuaacaaaucuaaaauauugccauuucaguauauaauaaaaaaauuaaugguauuuuauaguguuuuucuucauacuaaauuuuccaacucugguauguauuuauacuuauaacacaucucaguuuggacuagccacauaucaaaugcucaguagccauauuuagcuagcaucuacuguuuuagacagcacaguucaagaaaauagaacuauauaccacuuccuuauguuugcuguauuuucugccauucaguucuauguauucuguauguaauugccuuuuccaauaucauuuaaguuucuaugaucuaccaucccucugggucuaucuuagaugccaccuuuuugaaauaugaaugcuucucuggucucagcugaagugaauucuucuucugcuauagaaaaauaaugcuaauacuuagugaaacuuaauguguaccagguacuguucuaaguuguauauacccuaugaggcaguauuauucccaucuuacagaugagggaugaaggcacagagauggaaauaacuuguccagugcaccuaaggaguggagccaguguaaacucaagcaguuauguucugguuagcacacccuuaaccguugcuaaguauuauaauaucucuuugcucuauguauuuccccaucccugccaaacacacacuuauuuuuucuuuuuaucauuuuuauuauuuuuccucuucuguagcuuacccugugauaugguuuagcucuguccccauccaaaucucaucuugaauuguagcucccauaauccccaugugucgugggagaggaaccuggugggagguaauugaaucaugggguggguuuuucccaugcuguucuugugauagugaagaagucucgugagaucugaugguuuuauaaagggcagguccccugcacaugcucucuugcuuccugccauguaagacaagccuuugccccucuuucaucuucugccaugauugugaggccucuccagccauguggaacuguaaguucauuaaacuucuuuuccuuuauaaaucacccagucucagguaugucucuauuagcagcaugagaacagauaaguacacucgauaguaccuuaaacauauuggagugugauccauguccagucuaucuuuauacgcaaacagugugguauuguacauggaaguacugaguauauuuuuucgcggguagcgacugucuggggcugguguugcguggugguaaaaauaauuuaccaagacauuugagguaaagaaaggcagauuuauuagagaaaguaugaaaauacauugcaagaaagcuauuggcaagucagcaaaagaggagcugaaugcaaguagcaaaggcuugcuggggaucuuaaaggauggugcuugugcugugggcugaagagagcuuugugcaguacugauaacaccuagguugcaaugagcuaucaggcgagggucugaugauagcugggcacaggaagauugugaguuauuuguggaggaggacuguguguccuggaccaugaagaaagguggacuucuagcuuaucugcuuuuuuauuuuugcuuuacccuguucccuuauuaggacugcacacaauuuuuuuuuuuuuuuuuuuuuuuuaguuauacuuuaaguucugggguacaugugcagaacgugcagguuuguuacauagguauacacgugccauggugguuugccgcacccaucaacccgucaucuacauuagguauuucuccuaaugcuaucccuccccuggccccccacccacugacaggccccagugugugauguuccccucccuguguccauguguucucauuguucaacucucacuuaugagugagaacaugugauguuugguuuucuguucuuguguuaguuugcugagaaugaugguuuccagcuucauccauuucccugcaaaggauaugagcucauccuuuuuuauggcugcauaguauuccauguuguauaugugucauauuuucuuuauccagucuaucacugggcauuuggguugguuccaagucuuugcuauuaugaauagugaggacugcacacauuuuuuuuuuuuaauugaaaaaaaagguugcucuuuaggagaaggguuuguauacuuguaauuauugagacuuacuccuggagugaucaugucuuguuuguuucaacuguucugguucauaccuguguuuuggcguaaugauuaauagguaucuuuucacuguuauaaguguccaaguuuggaugauaaacuaaguguccacccuauugauaacauuuuuucuuuuauucuauauuaauaguccccuguucucaucuguauuucucuagacacugauacauuuuugucaggaaagaugaaaauuuaaaaccugaauuuuagaucauauuaaaacuuaauuaaaaugcuauauuaaaaacuaauauaugcauuauauauuuaaauuggagaggaucaacuucuuacugauuucuauacugaaguuuaaguucagugugcuucaguacaugcuaugcauugacucaauucucuugcuacuuuuucgguugagccuuuuaugcagacuuuaugucguaacucauucauaaucagaagcaagaacacugaaguauuaugaccguauuuaguuaaauuugaucauacagauguaaugauuauauguguuuauuucuacagaaauucaaauaagaaaaauuaaaaaaaaaaauuugcagugcuucggaccucacuuugaaaaauacugauucaggcugggugggcucacgccuguaaucccagcacuuugggaggcugaggugggcggaucaccugaagucaggaguuugagaccauccuggccaacauggcaaaacccugucucuacuaaaaauagaaaaaauagccagguaugguggcggguaccuguaaucccagcuacuugggaggcugaggcaggagaaucacuugaccccaggagguggagguuguagugagccaaguucacgccauuguacuccagccugggcuauaagagcgaaacuccguuucaaaaaaaaaaaaaagaaagaaagaaaaauacugauuuaguaaaugacuugauuuccaaaaaggucauuagcaauaaguuguuuuguuucugaccagucuggccaacauggcaaaaccccgucucuaccaaaaauuagccaggcgugguggcggccaccuguaauccuagcuacuguggaggcagaggcaggagaaucgcuugaaccugggagguggagguugcaaugagccaagaucaugccauuguacuccagccugggcaacaagugaaacuucgucucaaaagaaagaaagaaagaaaaauacugauuugguaaaugauucgauuucccaaaagguccuuagcaauaaguuaguuuuguuucuacuuguuaucauaccuuugacuuaucuagaacuuguuauacacagaaaauacagaauguucccauguuuauauacagguuuuuccuaaguuauaaaggguguagauagggcacagacauaaagaagucagagcaaagaagaguuaaauuaaaaaaaaaaagcaaaaaaaaaaaacagaugugaguuuuguuuguuuugucuuugagacaaguguuccauuaagucuuugguaauauuuuaaccuauggaaauuuguaugguuugucuuuucagaggcuaagaauauuguacacaaagauucuugauguucuugaggaaaucccuaaaaaugcagcauauagaaaguauacagaacagauuacaaaugagaagcuggcuaugguuaaagcgguaaguagcuaagucaguuuuguugucuuguguaacauuuaaccaaaaaaguuuaguuccuuauuuuuuauauauucgacacacuuuucuucuauucuccuuccuugaaugcucuuuucccaucauuccucccuuuuauucagcaaacucuuguuuauugaguguuuucuauaugcaggccucuguuacauacuggaguuugagacuaggaucagauccuuccuugaaguaacauuguagcuguuccuuuuaccucucuucacuauuuaguccuuuauugaucuuuugcuuuuuaucuuggauauaucaaucuugaucuccuuuuucuaaucuuagagaacaauaaaagcaaaacaaaaaagggcauuuuuuuuucaaagaaaccugucaaaaagacuagacuguuauuaaguagcaguuaauaaaagucuagacugcugauucauaccaaacuauauuguacuauuguuaaauuuucacacuagcaaucauuaaauggacuuuauguaauuaucuaaaauagugcuuagaaacucugaagguaauuuauauacaugcauaagugauccuagucacauauauuucuucuuauuagauuaccagacuauauaguucaaagagaauuccuaucuuucguuagguaugcaacaaaacaaugcaguuuguauuauaucguauuuuguauuguauuauaugaugggucucacucuguuacccagucuagagugcaguggcacgaucacagcucacugcagccuugaccugccagucucaagcaauccuccuaccucagccucccaaguagcugagaccacaggcacucaccaucaugcccagcuaauuuuuaaaauuuuuuguagaggcggaguuucacuguguugcccuagcugaucucaagcuccuggcuucaagugaccuuccugccuuagccuuccaaagugcugggaucacaggcaugagcuaccugcacccggugccucaccuauuuuaucaucaucuuucaaauagccucaaauguuuuuagcuuguuccuaucuuaaaaauaaaaaaaacuguaugcuuguauuuuccuuuacuuauuguccuauuuuuguuuucucccauagccaguuucaaccaaagaagaguuuacucucauacuucuuuacuuacugguuccaaaauccuuuucucugcuauuuaaacugccuuauaacuaauugaucuguuuguacuuccauuauacuucauuacaugcuccaccauacagccaauaauagacugauuuuuuuuucaauauguaaaucuugugaugguacaguugucccuugguauccaugagggauugguuccaggauucccauggaugccaaaauacaaggaugcucaagucccuuauauaaaauggcauaguauuugcauauaaccuaugcacauccucuuguauacuuuaaaucaucucuagguuacuuauaauacuacaauguaaugcuguguaaguaguuauacuguauuuuaaaaauugcuguauuguuauuuuuauuguguuuuuuugaauauuuuccaucugugguugguugaauccauucuuaguugaauccacagaugcagauccugagggccaacugugcugucuugcuuaaaaucuuacugugguuuucuguucaguguuucucaaaggcugaguuuaaggauuuauguugagcugguuguaugaagcuugcuuagcuaccuuuaucugcaugauuuugauguguggccauguuugggaaccacuggccuaacaggguaaaaacaugguauagaaggccuucuaaguucuggcucuugguuauuuucucaaucugauccuguugcuuccuguuuuauacucuauacuuaagcaguaccaaacugcuggcaguucuguggauuccuugcauuuuuauuuuuguguucauuuguauuuucucauuuccuggaaugccuuuacguuguuugguaguucuuacuuuuucuucauaaaucaucacuucuucugugaaaccuuuucuuacuuucuuaaguagaguuugacaacuuuguuaccuccuuuccauuguaccuucaugcuguauuaugucuccaccagccauaagcuacuuguuaaugauauuggauucaacuuuguauccuuagacucuagcaugguaccuggaacauaagguuccuuagaaaugugucuuuaucccaaaggcuagauauaaccccaaacacuuaacaguuguaucucugauuccuguuuuugguaaaauuaucacagauuuuuaacccugcauacagccacacacaaaaucuuuagugaauauugccauuauuauaaaauaucuauuuacuaagccuaagguggaaauaaaaguaacuuuuuuuuucagauuauuacuagggagauaguacuauuuuggugaaaagcguuguuugugucccuguccaagauuuucaucuuaguucuaauacuuauuuguggagugacuuggcauauugcuaguuuucucggucucaauuucaucaucuauaacguggguauaauaauacccaccucgaacacuuuuuguuagaaccgaaugagguaaugcacguaaaagcuuaacauagucccaaguauauagugagcauucaguacaugguaccuuaucaaguuuaauagcauuaugccauuggugacuaaaaaucacauuauucacuaucgguaagacaaauuuugaacuguucaccuaacacaggcuuuuucugaaaugaaagugucguugaacuuuccuugccuucuuuaccuucacucuccugagucucuuauaacagugaccagcuucccuguuuuguuuuugauuuuuggucucucauaugaguuaauucccuguuaaauaaucugucuuaaacaugcuuauuacuuuuuccccuuuucucccccuuucagcuguuuuuuauguauucacuucuuuaaccaagaaacauuuauugaaugccauguaugguucuaggcauggaaacuugugccuaguuggcacaaaacagauaaaaauccuuuccuucuuggagauuacauguuagugaugggagaccaaaagaaaaaaaaaaaguaaaaacugaguaaagacguacauaguguguuagaaaauaguaagugcagugaaggaaaauaaaacaaggaaaaugugugccaugguggggauaggggauguuacacuauguauuaauuucguauggcugcuguaauauucccacaaacuugguggcuuaaaacaauguaaguuuauuuuauuagacuucuggaggccagaaguuggaaaucaacaucagggacccaaaucaagaugguguugucagggcugugcuuccuuuggaggauauuggguagaaucuguucuugccucuuucagcuucugguggcuuuuggcauuuauuggcuuguggucucaucacugcaauuucugccuuugugguuacauuaccuuuuccuuuucuguguguaauaucccucugccucucucuuauaaggacacuuauaauugcaguuagggacuauauggauaauucaggaaaaucuccccaugucagcauccuuaacuugaucauauaugugaagucuuugcuguauaaaguaacacucacaguuucuagaaauuaauacauguauaucuuuugugguauuuuucagccuaucauaaugcaaauuaucaguaguuaaucaauaagaagguguuauuugagcaaagauuugaaaaguggugaagaaacaagugaugcagauacccugggccauccagcaagauacccugaggcaguaacauaucacgucuuguguugaaaagcaaaauguauuauuuucucccucuuuauuccauuuauuggccagaaaaacacccugaaaagacaaagccuuauuuacauauguggguauauuuacagagcaugauuucuggcucaaaaagcucaguuuacuagaaaauaacuaaaugucauugaauguucuagguacuauauuuauuaacauuuuguucuuaaaaacuucuauuaaauaauuauauacauuacaaauguguagaaaaaaaggacuuuuccagaacaacaaaacccuugccucuuccccuucaauuuacuacuuguaaaguuaaucucuauuuggacuucuuuuugccuguuuuugaauuuuauauaaaugaaaucauuaguauguacugucuuauacauacuguacucuggcuugugcuuaauacugugguuaagagaaucaccuauauuguugcauacaguuuauucauuuucauugcugugaaguauuauauccaaauauuauaauuaauugauccauucuauuacagaugaucauuuggguuauuucuaguuuggggcuauaauuugugcugcugugaauauucucaaacauguuuuuuaaaaaauauauuaugcauuucuguuuggcauuaugccuagaaguguaauuucugggucauagaguagcauuuauuucuaauucuaaugcucucagaggaaauacaggaaauauuaagaaagcaaagucauauuuuaaaaucuguuuuaggaagacugaauuugacauuguauuucugucccuugaucagcaugucaauaaacauuuagcacuuuucaauauuaagacagaaaagcaaugaaauagcagaggugaaaugaauuuucaccaaauauuuaguaaaaagaguaugaugaaagaaaaguuguauuuuuaaguguuuuuauauaggaauuuuaaaauauauaggauauugaaacauucaguuaguaugcuucuuuaauuuuuuuucucccugaaauuauaggaaccagauguuaaaaaauuagaagaccaacuucaaggcggucaauuagaagaggugauucuucagguaaagaaaaaguugacuauuuagguguuugguuucauagagacacacaacugacguucuagaaugaaaggaaaacuaaauuuccuuguuuauaucaacucgucaaauauguaagacuaaucacauauagaaaauguggugcuucucauguguauguugauuauaguauuuauuguugauuauagcaugaauuuaugagacuucuguuagaagccuggaguuugacacucuuuuaauuuaauuagcauguucuccuuggccuaaccuuaguuuaaauugguagcacaauauuacuguuguuuuaauaguuguaucuuauuuuaagaguguggcauauuuuuaguagggaaaaauacagacauuuugaauuauaaaauuaaaauguacuuuuauuuuuauuuuugguucuugagcauuugagcaaguuaaaaaacaauugcauaguauauuugagagcuuaauucuacauuauuucccaaauacuaacccugacaaauaauauugaguaguaaaauguaagcaugauuaugaagagacugagauuagaaaaauuauuaacauuauuaauuacauuuagaauauuuaaaucuuaaauuauucuauugggaaauuuucuucuccucucacuauaccugcugcuuauacaagagaacaaacaccgcaguuuaguuuuauuuaaucugaauuuuaauucuuuuccuuuggucauaguuagguuauagaaauagauagguuacugauguaaauaggcuggaaauauacuauuuugaguauuccguaguugguuuuuuaaagcaucuaugggaaaauaaugauaacucuuuuuuuuuuuuuuuuuuuuuuuuuaagauuugcaucuuuuuucuccaauugcuaguaagguuaaacuuuaaaaauauguucuuauauuuuauaaauuaugucauuaauauuuuuacugggucauuuagucuggguuauuuauacaugagugucuuuuuauaauaaaagauauuaaccuuaaacuuuucugacauugucugcacauacuuuuucuagccugcuuuugccucucaaaugggguuuuucccccauauguagagguuuucaauuuuuuuuuuuuuuuuuuuuuugagauggaguuuugcucuuguugcccaggcuggagugcaguggcaugaucucggcucaccacaaccuccgccucccggguucaagcaauucuccugccucagccuccuaaguagcuaggauuacaggcaugugccaccacauccagcuaauuuuguauuuuuaguagagacaggguuucuccauuuuggucaggcuggucucgaacuccugaccucaggugaucugccugccucggccucccaaagugcugggauuacaggcgugagccacccugcccagcucaaauuuuuuuuauuuggugaaauuuuguuguuccacaccccuacaacccucauauuauagguuuagaaugucuucaucuuauaagugucugauaaauauucaauuguuucauuuaauuuuauuuuguugcaucuuuuuucaaauguaacccuuucuaauguuuucuuacuguugauugaaggacagauaaaaggaaauauuggauaauauuggagauuagggagguauaucaccaacagacaugauauaccaaaucaaaagaauuguuagauggcucuggaaaaagaggaauauagcauucagacagcuuucuaugaauguagacuguuucaguuauucaaaggccuguuuaccuggccuuuauauucgucagguuggcugugguacuagauacaguguuaugggaacuugccgcaaaccuuauacuguugcccuauaccuauuucucuuuucuguaccaccugauuucacuuugaucaugacuuuauuuaguugauacaucaauuuuucauggaauuaaguuuuaaggcauauuaaguauuuuuaagucagcugugcaguuccccauguuuucauggucaguauuaaggguaaauuaauuuuaguauuuuuuuaacucaguauauguaguauauuauuuaaauauaaucauaaaaauauugagauauuuuacauucuuuuuuauaugaagucaucaaaaucugguauguauuuuacacuuugcagcacaucugaauuuggacuagcugcauuucaaguccccaguagccauguauggguaguggcuaacauauuagacagucccauuucuagauggaugguaugauggugugucagaaaggaggaaauaggcaucaggggccaggugcagcuggguccagguuccugagauagggcugauucucaaggaugaaugaggccuaggugaccuccucaugcccuauaauggcugggggagauugagaaagcauuggauguucgugagacccagggcaaccuuaggaaauauuuuaucaguauuuaaauuauuuucuccuuuuggcauuaguaauaccucuaccccugauuuccauucaucugcucuuuaacucauuguuuuuuauaguugcuuguaaacauagauugacuuuugggaccgcugucauagaugggguauuaucuuuuaacuguguaauaauaauuaccuugaauauaaucugagcgcuuauucuguguuugaauuucuuuucuaacauccugacagguguuuaauaguauucaucuuauaaguuggcuagaguugucauaaauauuguuuguuguagaaaaaauaugaaauaaaaagcuaccuaaaauguguguguuaaauauaaguuguguuugaaaggaaaaauuaaaugaaacauaauuugauuaaggaauuuacucaguuaguaaauauuaauuauacauguauuguguucuacauuccauagaucacuguuuuauaaacucugggucucaagugacugugggucauggaaucaguuaguuggauagugauuagcuuaaaaaaacacaauagaaaaaagaauauaucacugccaguaaagauaauaauuuaaaaaguuuuaguuauauguuuguauuguggaacucaaaauaaaacauauuuucuuacugugggccaugguaaaauaaaguuugaaagccacugacauagaugaaaagacauacuucugaugcucaaaaaacuugugaaauauuauuaagauaaaaaaccucaccagcuaaacuuuuaaacacuauagccuauuucaaucaaauagaagauaacaaaagauauccuuucuuacuccugauuauguagaugugagaauuaagguaauuuaauuacuuaauauucaacauuugaugguggaauagauuaugagauauuaaaugaaaguaguaacuaauaguuaaauuucaguuguucugauaaauaucuguugaagaguaaaauccaaugaucuuuuaaaaaauuuguauuaacaggcugaacaugaacuaaaucuggcaagaaaaaugagggaauggaaacuaugggagccauuaguggaagagccuccugccgaucaguggaaauggccaauauaauuauuaagugacuuugguguguucaugggaaacugauguaauuaaauauucuguuauauuaagagcgu

SEQ ID NO: 14551 - RNA, 43526 nt, Homo sapiens
ccacucugccuucucuuuuuuucuagcuuuuuuuccuccugccccaguagucauucuuaagcaggcuaugauauucccuagcauaagccaguuaugaagcuaaaagcuuguacaaacaagaggucuccccugcuugaucccuuaaaaaaaaguacugcaagugucaccuuaaaucauuuccacaagaucagucgcucagucuuuuuucuuucuuuuucaaggcauccugcaguuaauauacuccuauggucuguaaauguuuaaaauugaagagaaaggaaaacauagaauacuagauuuguugucgugaaauuguuucacugaaacuuuaaaaauuaaaaguuucuuaggcauuuuaaucagcaaguaguucugaaagucuaaaagugaguuuaguuuggguuuuaaaaguuuguugaacucauugggagaaucagguuuugcuaagcgcaaccuuuaaaaaaauaucuugggcagaacauauuauauugcgaaauaaaagagaaaucucuuuuuuuauuuagguagaauacauaauuauuuccaggguauuuuauggaaugaaacuugcuuuaguugaauuuaucauaugaaaaaguuuuucggagucucaugaagaauacuagcaaacuuuaauuugauaaacuugauauacuguugacaguucuacuuagaacuuugauaugcuuugugacaaucauuaaaagguauaacuuaaaagggaaucauugaaugcauaccaucacuaaaucaaauaaaggcuaggcuauucuaguuuaaaggcggauguuuaucauuauuuuugaccuaaaaguuauuagauuuuuaauacauuugcuugcuuuuuguuggaguauuuuaacugcacuuauguacuuggauuuuaucacaguagaguucauuuuagguaauuuucugauuaauggaaaaaaauguuaucaguagaagggaagagcuuccauuuuaagaaaacuuugcuacagaugaggauaaaauucguacuacaacccuaucucuacuguacuuugcugagaucaguaauaacuuaccuguacuaauaaaacaggcaauccuuggaugggauccaguuucuauugaacugcucuugaccuguuuaacuuucaggauccuuucacacugcauauuuuguguauuugaacugcagauauaucacuuauguuuuacugauguugaauggaguuugcuaguuuugaacuauacagaugugagugccauuuaaacucauguuccacugaccuuuuagucuaguuuuuuuuuucugagaacacuuuuaaucauugaaguugaauuaguuaaugaaaccaucuuauuuaggaagaaauuuauugaucauucauuucuuuaacaaauuguuauugaacaucuauugagagcacuguugaaggcaauggggauauaaguggugaacaagacagauaaaguucuuucuuuauaaaauguuugagugggaagagauaaacauaaagaaguaaacaaauaagcuaauuugugauuauaccuuauuuaguauguucugguaaugaguuuucugaagacuuuaaugucuuuaaagauguuuucuagacuugagcuuuuuaacguguauugaaauguuuuugcuuguuuuuuuuucuccccaacuagcaggaacucagacaaaauuguauuaguuuaaaauuuucaacaucuuuuacuagaaacuuuuuccaugcagguuaauuuucagacuuaucacgucaacaguaguuacuguuuucuugccuuguuagcuugaaucaaacuuucuuagaauuuuguugaauggauaaauagaacuuuguuaacuuauagaguaguucauugucauuauuucagaggaagguauaugcugaguggguaggauauuuccaggacugaaagaaauauguuguagugugauagcuuuuaaaagaucauguccacagauggagggaagaugacauaauguuugauaaaaaucuguccacauuuggauuaugaauacugggugagucuccagaggagaucaguauauuccugaugaggccauucugccuugaagagauaggucaauuuauagugaaggguggcacuauaacucuggcaguguauguauuuucuuaguuauguuuuaagauuuuauuaauagaaauuuccaaaccuucaaaacuagauaauaugaggaacuugauguaaccaucacacaacuccaucaguuguuacauggacaaucucuuuuccucuauauucucuccuccccuccucccccaauuccccucucuaccuuccacuuacucucucucccuaauauuuguaagcaagucccauacgucauaaauagagugaucuuuuaagggccuuguuuuaagggaggagagacucuuacaaaagucaauguuauauucugggaaguguguuuuuggaaggguguaaggaaagauguucugaggauuuggguuuuuugguuggagaaagauuuuuuuuuucuaaauggucauguaaccugggugggucugaucuugggaggaugauaggcuauguaagaagcaauuuuauaaaguauuaauauaauaaaguuuucuagaguugagaguauguuuucaagugaaggaagaauuguuucuuuagagugggagcuacacagauguguauaccaagugguuguguccaggcacagcuaagcuaauccugggcuuauuuugaauguuaucucaggauguguauguguucuggugguagcaguguucugagggugguggguaagaauauuuagccuuagcuuuaaaaugaggugcugucauguggaaguggaaguugguguauuuuauacagaaggagcacauuuauacaaauggaacacauuuguaaaugcaggagcucuaaggagaagagucuguuuuucccaauauccuucccuuauuuauuucuguuuuuucauucuccaauucuagaauucuuguaacugauagaggcagacuuugaagcauuuaguuuuuuacaguaguguggguuuucacccucuuuuauguaguuaccauuuuuuuuguaaguaguuaccuguugcuauaaugugcaaauaggagaaaucaguuuauucaaguagacgauacuggucuguuuacaaacuucuguuuucguaagagguuuaauucucuuucucuaagauuuugaaaaaagauuuuuugguuuuuggugucaggaaagcaauugauggguacauguugaugauagugaugguagaauguuuauugagcacuuacuaugucccaggcuguuuuaagcaguugauuugcauuagcuuauuuaaccccuauacaacccuauaauuuaaguacugugaaaaucuccauuuuagaccugagaaaagagaaaucagagaguuuaauuugcccuaauuguaucuaguaaauggcagaaaaagaauuuaaacacagagaguccaggucuggauucuuauguucuuaaucacugcaguuagugccaaugucagauauucucaaaaugaguguguguguguguguguguguguguguguguguucuuaauuaaucuaaaauacaccuaaauuaauuaauuaauuaauuuguuuauuuauuuugagucaguuuugcuguguugcccaggcuggagugcaguggcgugaucacagcucacugcaaccucugccucccgggcucaaacgauccucccagcucagccucccacguaacuaggacuagaggcaugagccaccacgccuggcuaauuuuuguauuuuuuguagagauggggucuugccauuuugcccaggcuggucuugaacuucuaggcucaaguaauccuccugccuuggccucccaaagugcugggauuacaggccugagccacugcaccaggccaagugucucuuaaaauuggggaaauuuugcuuaaugaaaugaguuggucccaaaacaucauuccucuuguuuguguacacugagcacuagacuugaagcauaaaggagaaucuaagccuguaucuauauacauagcacaguaggcuaguuuagccccgcuaucagaaagcuaaguacuguccaagccuaaacccugaagcaagaguagcacacauuguugaaaucacccuucauuucuccucacacuaagugggugguccuguguuacgauggucauaguugaguagaacauuauggcauauuuaaaaaagagauaauuaaaauggucaguuuuucuccaccacaaccaucucuauuugauaacugaugaagaaacccaguuuuccuuuucuguugucuuuauucauauuacuguaauuuauuauguaucuauacuacuagucugagaaucuugggaauuagggauaauauaaaccucuuuauguaaaaaugaaauuuuuaauuuuuaaaauggaaagauuauuuuuacuuauuguaaaaauguguccuuucuaaaagccagacucugaagcagcauuaaagugugaggcagaaagcaaacaucccugaaaauccacccuaacagcauuuauacauauauaaaauauauauuaaauuuauauauuucugcaucuaccaauguauuaauguaaaugggaucauauucuauaaccuauguuuguugcuuaacaauuauugccauccuuuguugugaauacacauagaacuaguucaugcuuucuaacagccaugaaaaagucuguccuauggacauuucacaguuuauuuaaucuggucacuauuaagagacuuuuaaguuguuugaaauuucucucaauuauauacagugcugcagagcacuacagugaacauucuucugcauccaucauugugcacuuguucaguuauuucuuuaggcagugauuuuugacauuuugcucauaaauauccagaguuauaccagauuauccagaggauuuuggaaugguuuaugaagcguggcuaggccaccauugccuuagaauuuugauuaaauauagugguuccucuucaaggggaauaaaaaggcaaacaugaagaauguauacuaaauaauaccaaaauaguaaggucuuuguauugaaaccuaauaucuagccuuaaguagccuuaaguuagccuuugagaauaguuuuaguuuuuuucuccauuguuucauuuugccuuacaaagaugaugguuaauuauauauauaucuacauauuauauaugcgugugugugugcgggcacaagugugauuauccuuaauguaauuguagaaagccauuguuuuacuuuaauaguaaaugauuuaaauaacccuuuuuuuguggggauugggguggguguuugucuuccauguaguuuauauccuggaaccuggagauccuccuuuguuacagcaaccacuacagacauccaaaucugguauucaacaaauaauugagugcuuucgaucagguaugaauguuuuaggauauauuuuucaaucuucacauaguaguuaaaaacuaccuagaaguccuuagaaauaauuuuuaaaaaacauuaaaauguauauguuggcuuucuuuauagaauauuuaaaauuuucauauuuuaaaaaaguggauguauaaauacugacuuggucuagagauuauucuucaguacuauauaugguauauuaauuuuaaaauaaauuuguuuaguaugauuuaaauaaauauauuaugugguguauuuucugguaaagcacuucuuaaagauccauugauaucuuuuggcauguuuuguguaaacucucaaaaggcaguaaauuauucugggucuucaugagcuuugguacaguagauuacucagaaugucugagaugucauuuguucuagguuaauuaccuuauuuauguuugugugaucaccuccuucauccuaacccuugaguuuguggaguuuugguaucuuuaauagagcgcaagauagaagaaagacaauauuccagcccugauaucuucagguagauuugcuuagauuuuauuuucauuagcugauaauaagaauuagcuuuauaauaaauauaauuguguaauuguaauccaguguuuuaaaauagguauuacuuacaacaugugaaaugauugggaacuguuagcgccccuauguuaucaguaagauguuagguugcugugauuccuauaauccacuuguccaccccuuguguauuuggcuucucugacauuacagaguauucacucagaugugaacaagcaaauaaauaugacugauggacacuuagaggauuagaauaccuugucauuauuuaaaucuuaacuaacugaaugaaaaauuucugagguucaaaggaaaaauaauucauauguaacuacuuguuuuguauugaugagauuuuuugaguugcuuguuucuaaauuguuauaaacggggaaaucauauauuugcuuuacuuuaggauucuaagaaauagaaucugaauuaaaacauuuauuuuuucucugacucuccaaaagauccauuucuuagacuuuucaucuguaguacucauggcauugcuuuuaucuguauuuaauuuaggaagcauugcuuguauaccaagugccuauccuuauauuggauggugguauaaacuauuuuagggauuuuuuguuguuugauuuuuacuuuugauaauugcccucgacuaacagauaauuuauaggucaaauuuucuugugauaaguucaauuaaaauagaauuuuacuuauuagggacaguauuuauauuucuggcauaacagaaaaaauagugucuguuuguuuuagcuucuuuuagaauagagauuaaaggguuuuuuugguucuuucucauaccauggaaaugacagcaauagcuuuucauauuuaguaauauuacuuguuauagguuucuuuuuuaaaauucuuaauuuggaauuaaugaaguuauacuaugucaguuuacuauagcauuuuuuuauugagaaguuagaauuaggcugggcgcgguggcucacgucuguaaucccagcacuuugggaggccgaggcgggcagaucacgaggucaggagaucgagaccauccuggcuaacacggugaaacuccgucucuacuaaaaauacaaaaaauuagcuggggggcggcggcgggcgccuguagucucagcuacucgagaggcugaggcaggagaauggcgugaacccgggagggggagcuugcagugagccaagauagcgccacugcaguccggccuggaggaaagagugagacucugucuaaaaaaaaaaaaaaaaaaaaaaaaagaaguuagaauuaguuaagucauaagugcuuugacuuguuaaaaaacagccuuaucaacaagaaccuguacccaaaaucuguguggguacagaauuaaaaaagauuccaaaaaucuuuuuuaauuuuagaaggcaaauauuuaaagauuaaauuaauuauuuucuuauuauguugugaucauaucuguucucuguguuugucguauuuuuacucucugagcuaaagaagugaggcagugaaacggguaauuugaaaugguaaaauuccaaagccauuuuauguugauguuuugaacugcgaucuuuuuaaaaugauaucagcaaauuugccuuuugaguuauuuuuuauuuaggcaaauucugaaaauacuauuauuuuaauuuucugaguacccaacaguuuaaguuagaggugauuuagaaauaugcugagugguacaaagaaacuaaucuuggauuaaaaaaagaauuauuuuacuucauuacuguauccuguaacuaagaaauuuuaguuucuucaagauaguaaucucuugcauuucugguuaaucuaaugucuacugugguagcccuucuuuagcacuaaggcauuuaaguugagacugacuaaaaccuugggagaaugguauggaagucuggacuguauaacuuggggacaaagaucccuucuagcucugaggcucuguucuuccuauuccacucuacuccuaagcacacccucaaugacucaucuauuucuaggcucuuuccauuacaauuaggucacacacguugcauuuaaagaacuauccugguggugcuauauaucuuugacagauauuugaagauagaacccugaaguccaugcuuuugcucuuguuaaccuguaggguauaaaucagguugaaugguaguaauauguuagguuaucuaccuuuaucuucaagcucagauaguuaucuucaacugcuguaucaucuccuuuugugucucaccuucugccuacacugggcugucuaugaccagguauuaauuccuaugcaagcuggaaguucauaaaaaguucugucuuaugaaggaguugacucauuuuuaauguccaccacuugaugugugcuauacugacugcuugaccaguuuuaacccauccuguuugccugacauuucagcuuuuccuuugaacuguuuucuuggauuuaaauuacaaauucuuauugacuucugguauaucuuuauuagucugcuuaacuugcaaauuaaguuaaauggguuuuucuuuuuauaauaaguaauaugugucugugguuuuaaauaguaaaguacaaaaggguauagaggaaaaaauaaguuucuauacuauucuguccuucaguuccccuuugcucaggcaacgcugcuacaugguuuaugugucuucuuccagagaccuuuuauacauauacaaacauauaucccucauuuucuucuuacacaaaugguagcugacucuacguacucuuguguaccuuugcuuuauuaacuguagauucaacuauuuauuguugacaucaguccauagauagaugccucauuuuuuaagaagccugcagguuuugcagcugcagguuuuccacuuggaaauuccugaugauuggcugacuugagaccugcuguuugcucugaaccccugguuucuucuacuaccuugacugugccuuacccuuuguguaguuuggcuuuggcugugucauucugauaggaucauguuucuaauauggugucuucaaauuucccuccucucuauaacacuuucaguuuaucuuccuuccucuuugaccucucuccccaaaccaaaacaaaauuuuaaauagcagauaaaaaguguacuaccuuuacauauuuauuaaauaucuuuuauguguuuauuaaauugguuuaguugaguucaauauucuuucagaauuucuuaguugugugcuagaggcaaaggaacuauggaaugccccuaugguuagaaagagaaaaaugaggggaaaagagaaggauaauuuugucugguauucaagacuggucuuuaauaugaagcugacaucuucuuuuuaaguucuugaaauauauaauauuguaagaagagaaauauauaauuuguagaaaaaagauucuacauguagaauaugcuagagcaguacaugcagggaacucuuuuuuugacucuuagggaggaauaaauuguaacuuuaauuguaugguaaugaaaaaugagaauuagcuucaugugauguuugcugucauuaucuuucuaaauuuggguuuggucauuuaacuuaggcuuuuuuuuuucuccuuaaaacaacuuuaauugcaauuaguuuaagcucugacugaauggugaugcuucaguccugauucugaaggcaaagcguaggguggacgugauuuuucugagguacauaggagagugccauaccuaugauggcuuuuucuuuuuuuguuguuauauagcaguuauaggaaauuuaaaaugggacuuuuuuuuauaagaaaaaaguagauuuguuuuccuuacauucauauucaaagcaugucaucugguguuacguucccaagacaacagccauuuauauuggucugaguuucucagugggggaaagaccguaucuuucauauuuccaaugaguaacaguguaccugguauuuaaugugugcucaauaaguguuuguuagauuaaacuaaaagauuccccaaguaggcacuguccuaagauaauuguauucuacuuaaguuuauugugguauguggcagugcucuauaauuaacauauauauauauuuaaccagcccuuacaggugauaguuuuaggauagaacuuucaauuucuuaaguuuucuuuguaucuuugaauccuuacguuaaggaugaucaguaagaaauuuccuucaggaguugugaugaggaacguacauuuauuuacuugcaguguuuugaugauauuguaguuaaguggucauccuaaagaagauugaguuuauauuugagccaauaguaagcaagcaguauaccauuuaagaagcauucuugucaucacuuaaaaugggcauugaccaaaaugucagugcauuaaguaagaaaaugaaaccuugucuuugucuagcauagaagaguuagaauuaauauugucauauuguaaugugacugccauccaaccuaauguaaaauugaauacugauuccuuuugaaaaaauauuuuaaacauuuucaccaguacaugcaaugcacuugccauuaaagaauaacacaagauaaacccuugaugaaguuuaaguaauuuuuauugagcaccuauuaggggugaaaaucuggaauauacagucauuaaucuuuagcuaucaaaagccuuuccuuuggagggcuggauguuugaaagguacugaucuauguaagcaguaaguggugauuucuaagauaauuuaaaacccuaaggcaagaaagagagcaauauaggaaaagaagaaggaagucagcauggcucucuguuucucagcaucaagagcuguggaggaacuuuauguugcugucuggaugaccaugucuguugucucaggugacaggaaguuuuagcuauugacagaggcacuuagaguuggcuguguccaauuguaagugagcagagcaaucagaaaaugguagcugacuuugaagaaagccauucugucuccaugggaaaaaauaaaaaaaucuuaaguggugucugaaacuaagggaaaaacuuuuauuaucucuguuuguggacugagacacaccuuauuuuucucauuuguuaacuauguaaguggaauuaaaaaaguuuuaaagucucauuuuugacuccucaguuaacuucacauagauuuaaaaaaucuaauuuuuagagaagguuuuuuuaauacauagagcucuguaguauuucauuuagcaaauaucagucaugcauuauccugagagcugggguagcggugagcaucaagaauaucuucucuguucuaaucuuccaguuuaauggcgauauggaaaagaaauuaauuacaaaacaguggauaagcuaguauagauaucuagggugcuaugagaguguaggugaaggauuuuuaacaaacaacaacaaaaaacaagagguugauuauugaaggcuucuuggaggaagugacaucuauacugggaucugaaggauuauuagaagugagucagaucaggaaagugggagaauguuauagucagagaggaaaaaacauaggugaaggccugaaaagugagggaaagaauacauuugguguaucuguggaccugaaagaaaucuggacugcuuggaucaacgauacacacacuugcgcucucucucccucucucucucucucucucucugugugugugugggggggguggggggguggggggguggcaaggguaaggggaagcauuugugauugauaauuaagauugauuaguuaagguuagaggcaaauacuuuuuuuuggauguuuauugagaauaaauaugcagucccuacugaauauaacuuaacuguauaauuaggacuaauuaagaaauugauagugucuuuauuuuucugugauugagaagcugguaggcaaagugaugugucugauuuagggaugcagucuuauauuuuacacuugacuauuuuuuauguauaaccucauguuuacagacugauuauuuuaugcuuuaaaucugcagccauguacauguauccuauuuaaaucuuaaguugaauucuuaaguuaaaccgaguucacauuauuuugguguuccucuucaaucuuuuuugacuauccuuaaaggcagaauugaaucuguauuaugggucuagcagguuuuguaguuuagaaucagugugcaaaaguuuccuguuuucuucccacugcuacuaugcucaccuacauuuccugagaaauauauauaggucaauuaggcuuagccaaagcauuuuuuaaaaucagucuaccucucauaguuugucacucacuuaugaaguuaacugugaacuaaauauauuagcaguccguugccaagauauuuuguaaugugaaauggacuucaaaaauauauauaugagaauuuacuuuuauguaaagaauaacacucaggcuauucucugaaucuuuuuaaauuuauguuuucugauuuugugguaauaaggacuaguggaguaaacauagauuuggauuugggaaaugguagaaauuauuuuauucuauacauuuuuuccaguagaaacucaaguauauaauuucccugggauuuagguucauauuuucuuuaauaauucuucaacuuagguuugguuagguuuguucuauuuuacaacaugaguaaaccaaaguauaaagauuauaaagcuuuuuaaggucacacaaguagauaauaucagauuuggaaucucucaagacuuaguaaaguugugauaaccugguaacuuuuuugcaguagaguuuugaaugcuuggaucaacaauaauuaucucccucucucucucucucuguguguguguguauguugugggggugggggaaaugauuuuaucaucguuuucaaaaugauaaaauacacuucaaagauuaaauguaaacagauugcaaaauauugaaucugagcuauuuaacuuuuauagacccuacuauauuaauuauacuucuaagauaguuuauacucuuuaguagucccagagccuaauaggugguuaaaugcuucuuaaaugacacaacacuuugcaccuagacagucuuaaggauauuuuucaggguacuugggucuuuuccuguucaagucaauauauugucauuuuaaaaaaguuuuaauuugaggaaaguaaagguacauuaauuaguaaauuacugcagaucaguuuugccaccuuaccuguggcaaagagcuguaggaaaguagugacuaaagaccuuccguuuguauuuuauuucugguggcuguuuuuauuuuuaaagaucaggugcuuuuuaccauuuauuuuuucucugccuaaagauauucuuucauaguacuuagguucccuagauuaguagcguuucuucaacaaauuguuuuugagcauuguaagagcugaauacguuacacuuguaaauaagauaggcuuauucuuggcugcuuuggaguguauaaucuaguagagaagauaggcauuaaacuaguaauuauaucaauacuuaauuguaauugggguguuuuaagggagaaaggcuuugaauaaauuuauagugcugucaagaggcguaagcauaguucaaaauuaugucucaguauagacaaagauucucuacuucguagagaaucacgcuaaauagccauaaucccauguuggcccagaaccugaaguaauuugagcugaauuuaaagagaaaaaucacaggcaauccuguaauacaguuuugaccuucuuuaaggaauaaggggaaaauguauugaaaaacuccuugcuuacuuccuaauacagaaaagagcuucaaagaaccagccaaaaaguuugccagggaauaaugggggaacauuuaauuuuucuguccuacuccaaaucuauuaaaucugaaccucuaggggagggcuguguacaucuuuauucccagcucauuguaaugauuaaccucaugucggaaccacugccuugggauauaucaagaauugauuggcugcugaagugggaacacagcaucaauuuuaguucuccugauuuccaaaugauaguaggguuuugcuuagaauuuagucuauaacuuaguucuaaauauacugugguggaaauuggcaaugccuauauuuuguuuucaaagaguaacugcacuuuuggucugucaacagugguuguccaguuuaaaagugcauguuaaaguuaccuuuuguguuaaguuuuucuuuucuuuuuucucucaggaacuaaacaacuuaagcauauuuuauuaaaagauguggacacuauuuuugaauguaaguuaugccgcagucucuucagaggauuaccaaauuuaauuacccauaaaaaauucuacugcccaccaagucuccagauggaugacaguaaguuuuauucauauacucaguuaugcauuuuacagcuaaguauucuuauacugcaaguauacauuugcauuaaaauuguaucuaguuacugauaauuugauaaugaugucuaguuacagauaauuuuuagauggagauggagaauaaaauuaaauacuugacucaauguuacauucaguuucuuagguacuuucauaucaaugcuuuccacuuggguuuuccuaaagaugacauauaagagguuagauuuaagaggauauuuauuuauauuaaaauauuggauauuguuuuagaauguuuauaugggccauaaauggauuuucuaguuuauauuacuuuuuacuucuuuauucuuuaacaacuugcaaccagaugugauugaucacuuauuuagauuccccuuaaguaaaugagaagguugggaauaaagagcaaagaaugagguaaauuuguucauuucuugggaaugguggagagcauuaaaaagucuuuauuaaucuuucuaguauuuucuaggucuugauuugaagaucaguuuuguuuucagaaaaauuuagauaagucauuuucucagaaauuacauuauguuacaggcuaacuugagauccaguauaacuuuaugugauaaaggcagauagcagacuaauauaaagucuuucuggaacagaauguuuguuuugaaugcagcauauugucucugugugaugaggcuggcaguguaucuaaugguauuuucuuucuuuaaagaauuaauguaaauuuaaaaaaauucaauauugggcuaccuuauucuuucuuguuuauggauuuaacucuuuguugacuuacaaaauauagaacuuacuuugucagucugaaagcguagaugcauuguggauucugugcauuuuucaacuuaaccuuuuugggauugguaugaaaugcaaucuccaaauaaguauggcuuuaauuauaaugaagcuggcuuaaaguuauauuauacagcauugauuaaauacaaauuuuauauuuaccuggaaauauuuccuacuacuauuuugaucuuacuauucucucauugagauauaaauuaaaaagcagucuagagauucauuucaaaucuaaacuuuuaauuaaaauacuaguagaaaauuaguuugucuuuugguaguuauuuauuuuuuaguuguagaguuaacuuauagagugaaaugguaaauggauuugcuagauuacuguguacuugucuucgcaauacucauucuagaaauacuuuugugaaaguauuuuucuuauagacacuacuuuauucaucuuaaaagacagaugacuagacuagaagagcuauaaugaaucacuuccugauugguauagauaccagauuugguacuaaauuuguagcuagauuuuagaguaguaauacauggaaaccuaaccaguguuagacaacucuguuacaauaggauaguugauugccuguaaaggguguaauuauuguacaaggaaauaaaacuaccuaugguuuuuaaauaaaucuguauaguuuuuaauuauuuguuuuaguaaaauugugucauguuaagaagacauguaauaggacugaguuuagcaaauacuucuacacaucaucccauuuauguuuacauauuugcuuacaaaucuuucauuuucauaagaugcucaaauagacuagauuagauuagacuauuauggauuaaguuaaugggaaugcuguuauguuuucuaaaaaaugccauuuuuauuuauguaguaacauuuuucaugcuguuuuaucaauugaguuacgagaauuugaguugccuuugcuagucuaaaacauucagacuaaaaauaugaaauaucauuuuuauuauuuaggacaccuaagugcuuauauauuuuauauuaagggcauuugaagcaaaaguagcccuucagauuauauauguuccuuaacauuuuuguguaucaugaugagaauuuaaaggaaauuuuaguuuaauaguagucuuuaucuuuguagaauacugaaaaguagauaaugcucuuauaaaaauaaacugguaauaugauauauucugagauagagguucauaauauaucuuaaaauauuagagggcuacagcaggcuaauuacuucagauuaaaauguuguuuuuuccuuaacagaccuuccugauguaaaugauaaacaaagccaagccauaaaugaucuccuagaagccauauauccaaguguggacaaacgagaauauauuauuaagcuagaacccauagaaacuaaucaaaaugcaguauuucaauauauuucgaggacugauaauccuauugaagucacagagucaagcaguacuccugaacaaaccgaaguucagauacaggaaacuagcacugaacagucaaaaacaguaccgguuacagauacagagguggaaacuguagagcccccuccuguugagauuguuacagaugaaguugcaccuacaucugaugaacaaccucaggagucgcaggcugacuuggaaacuucugacaauucugauuuuggucaccaguugauauguugucuuuguagaaaagaauucaauucuagacgagguguucgccgucacauucgaaaaguacacaagaaaaagauggaagaacuaaaaaaguacauugaaacacgaaagaauccaaaccaauccucuaaaggacgcaguaagaauguucuaguuccauuaaguaggaguuguccaguauguuguaaaucauuugcuacaaaagcgaauguaaggaggcauuuugaugaaguucauagaggacuaaggagggauucaauuacuccugauauagcaacaaagccugggcaaccuuuguuccuggauucuauuucuccuaaaaaaucuuuuaagacucgaaaacaaaagucuucuucaaaggcugaauacaauuuaacugcaugcaaaugccuccuuugcaagaggaaauauaguucacaaauaaugcuuaaaagacauaugcaaauuguccacaagauaacucuuucuggaacaaacucuaaaagagaaaaaggcccuaauaauacugccaacaguucagaaauaaaaguuaaaguugaaccagcagauucuguagaaucuucacccccuuccauuacccauucuccacagaaugaauuaaagggaacaaaucauucaaaugaaaaaaagaacacaccggcagcacagaaaaauaaaguuaaacaagacucugaaagcccuaaaucaacuaguccgucggcugcagguggccagcaaaaaaccagaaaaccaaaacuuucagcuggcuuugacuuuaagcaacuuuacuguaaacuuuguaaacgucaguuuacuuccaaacagaacuugacuaaacacaucgaguugcacacagauggaaauaacauuuauguuaaauucuacaaguguccucuuugcacuuaugaaacucgucggaaacgugaugugauacgacauauaacugugguucauaaaaagucaucucguuaucuugggaaaauaacagccaguuuagagaucagagcuauaaaaaagccuauugauuuuguucuaaauaaaguggcaaaaagaggcccuucgagggaugaagcaaaacauagugauucaaaacaugauggcacuucuaacucuccuaguaaaaaguaugaaguagcugacgucgguauugaaguaaaagucacaaaaaacuuuucucuucacagaugcaauaaauguggaaaggcauuugccaaaaagacuuaccuugaacaucauaagaaaacucauaaggcaaaugcuuccaauucaccugaaggaaacaaaaccaaaggccgaaguacaagaucuaaggcucuugucuggugaggaacaguuaacagaguuuugcuuuuuuccccccaucgaacuaaaaaaaaaaucauuugaccauaauuuauagcugguuccauuuuaacacguuugcuuccauauaucucauggcaaugggaacugcaagaguaaugugcauauugcauuuaccucuucagugaccuuuauuccaguggcuugggaacaaaaguuaacuucagaacuuaucuuccacaggacaaugcaauguaguuguagguagauggcacagggucagugcuuuccuuuuaauguuguaaaauauauacauuuauauuggcuuauguuuacaauagaagucuucuguuuaacuaacuuugcacagguuuaauuugauucagugacuuagucuacuaauuaaugaauuguaggaaaguuaaauauauuagaaugaacuugugaaggcgauaacuauaggaaaaaaucuuuugaggcacuguaauuauuguaaaaauuaaucugugacggcuaaauaaaaugcugcacucagaaaaaaaaauccccgaauugaauuaaaaaugauuagcauuuaucauuuacuuuuaacauagugcuuccaggcaaagggggaaaguuggugguaaauagaaguuuggauuuuuuuuccuucuccuugggaguguguguuaguuacuguuuuuuaguuuugaucuauggaaacaaugcuuauuuaggucccaaaugcuuccccucucuuuuuaauaaacuuuuuggugaucauuuuaacauaguuaauauuauuaacuagggauuuguuuuuugugguugugugucguaagaaaaguaaaauucauauuuggaagaaagaaaaauacuacuuuuuuuuuuuuuuuuuugagacggaguuucgcucuuguugcccaggcuggagugcaguggugcaaucucggcucacuacaccuuccgccuccuggguucaagcaauucuccugccucagccucccaaguagcugggauuacaggcauaagccaccacacccggcuaauuuuguauuuuuaguagagaugggguuucaucauguuggucaggcuggucucaaaacuccuggaccucaggugauccgcccaccucggccucccaaagugcugggguuacaggcaugagccaccgugccuggccaaaaaauacuacuuguuaaagaagguuuuggaacaaauguagauuuuuaaaaaaugcaacauaaaaugaguagacucccuauacuuuucgcaagucuauauauauuuuaaaaguucaccuucuauaccuguguccccuguauuaaggcauuuaauguauuuaaugaguauuaaauuaguuucagauucagguucuaaagcaaaauauuaguuugagugcugugaggguuaaauguugugguuugauuaucacacguuuuuuuauuuguguggaaaacuugagaugaaaccaucuuuuagaaguaauuuacuguugcauaguuuuaaaaacuagguuuuauuaguaaacucaaaaguguucauuuauucccauuucuccucagauaacuucaagugauguacgaaaagguuuggaguucauuuuuguggaaagacuuuaaauugguguuagaaccacuaaacaucuucaaaugguacuaugaggaaaaaaagaaaaacauuuuucuaaauauucaacuauaacugcuguuuucugacuaaaauaaccaucuaaccacuuguuucuaaggcacugccuauuccagcacuuucaaguagcugugauauuacauguugucaucacaguccaucagcuauccacccuugaccuugugcauuuggucgacaguuucuacaaaaauguuacaaauuuuguuuucuaaacaauuuguugauuaagugaucaacaaccugaagaaaauaucaauuuuuaauugacaaagacuuuauaucuuagugauuuuaguuuuguuucucuuuauuuggcaacauuuucaucugaauuguauagauauaugauuuucuagugaguguauguuaggaacaaaagacaaaauaguaucaacacauuauaaauauuuagcuuacuaaauauuuguaauuauuuuuacauccauuuauuucuagcuuguucuccagcacuucaguguuugaaaguuucauccuaaaauauauacuacaggaaagcugcaguucauuuucaugcauggaucauuacauuuuucacuuguaaauguagguuuuuaugaaaauuaaacauuccccuauuuuucuuuaaauuuuauacaaagcacuuuaaugauagaugcaaccuuauuuuucaguuccuauuuuuuuaaagaccacacauuuacuaauguuaauaugaagguaauaaauagcuuacugauauuuuauggaugcagacaauccaugcacaaccacuucuuaugauacuaguuuauuuccuuaaauauugcuacaaaaggaagaugcggguguaagcccugauuuuuuuuucucccaagaaaaaucuuaaaggaccacuuuagauaauauuugauuccuacuguaaaauuuagaaaaugaugaauucuuguccauuuuuguaaucaagauuuuaggaaaaacagaaguacaucuaucuuuaugaaauuuugggcagguuuuuguguaucaauauuuuguacuuuuagggaauauuuuauuuuuuaguuauuugugucaaauuauaauuauaaaagguacagcagaaaauauaccauguuuuuauauagguucacaccuguacuuaggagggacccuguccaucuauauacuuuuuguauaaaauuuuaaaauguuaaagauccacaaggucuuaauaaaaugauucuauagcuagaaaaacauuuaccuucccagugcuuugcacuaaaauauacugugaaaggaaacuagaaagacuguaacuauugcuggaaauguucuauauugaauguacaugcucuuguuggaaaaauguacuauaugugauggaaauaaaccagaaucgaaguuauuucagcuaaaugugcuucagcaaaggugcauugguugaaacuuaaauguuuuauuaucaaauuuaaacuuauucagugacuaugagcagcuacacuugaauuauauucugauaguuuuauuucuaagaaauagaguaauaauuucucuuuaauuuaaaaacagauuuacuuucccacauauugaaaauuuguacuuauagaucuaacuuuaauaacuaauaguauaauauauuuagggaacuaaauguguaggugguauuucauuuauaagccaucuucauuaguugcacauuauuaaaccuauauguuugacuuuugcaagguguuaucuuuuaugcauuccuacacacaagacauauuccaaagauauuuuccagauaaaugcugauaaccccugaaaagauaugaggauuccuaaaaagcuagggguugcucuuugcagcauccucucauuuguaugccagccuuucccucucugcuugcuuguuaaauacuauagagaagaaagaaaaauugauauuggaggaggggagcccauugcuggaauucucuuacucuacccaccuauuucuacaggaccauucacagugugucuccuccauaguaauucuggggccacagaauaggaaucuagaggaggaaauaaaugagaguuccagggcugucaaaagauuucaucugggucauguaggaaaaauagcacugugucaguacuugccuacauuagacagacuggaaacauuuuaucauaauagcugaauuaauggauaauggcauauauaagagaaccugaacuaggaccaguuuagaaagguagaacaaacaagugaccacaaaguauuguucuucuuauuccuuucuggucuucauccuuccugauuugacuugagcucugucacuucaggggcucaggcuuaaggcucuugagaagaggccuaagaaguuugugccagaagcuuuucugcauguaggcuacauaaacacauauuuaggugauuuuguauuguuauagugaggauuacagcacacaaagagccaucagaaacugcuuauuuuauauaagaccuaucuggcuauaaauuauaucuaccuuugcugcuauuugaucaauuaagaguuuuccuauggaauucaacuuaccuuccuuccuaaagaugccuuccauuccuaaguguggugggagaggagaaacaacaggcguagguugcucuucaacuuuauaaguuugaauagugcaaaugagagcugaaguauagcugacauugggcagguguucauuagacaugccuugaauacacaacaaccauuucuuuuuuuuuuugguuuaugucuccauucccucccccuccccuuuacucuuuaagaagaaaaccuuugaagaguguacacauuacccauucuuagguuuuaguuuuuugucuaguuuuguauauaugaauuaaguuuuugguugacacagguugcuuuaguuguugaaauguaccuucagauuuuuuaggaauauauuuauuauauuacuuuauggucaauaaauagucuguucugcucaguuugcauuaaagagccuauggaugcaguaguggggaguuaaugauuuugcuauggcaugaggcuguggguauagaaagaggaguuucccuguagguguuaugguaaauacauguggagauagguagaagugauuaucauucccuguugugaaguugcaaaagaucucuucaaauagcaugacuucugaaaaugagguagagaugcuucaaaaauuuuggaaauuauguuuccagguuuccugcagugacccauugaaguauucuagauccuuaguuuggaguuggagaaguuauuuuucuaauggaauccauagauuaucaggauuaugauuuagccauggcuuucaguugaucugaagccaagcucuaagauaugugcagcaggauauuggcugugcuguuagacaaauccuucuguacucugugcuauccugucgucucucuuuaagagcuaaagggauccuugguauugaaaaggaauaaggaucagcaauuucaggaauagcuguucugugguuuuugaggcauuaaacacaugguagaaugcagauuaaaaacaugucucacuuaaaaccuacaauuauuuuggcuuuucuaacuuuccaaauucauuucucuucuccuaaauuguuucuauacccuauuccucugagcuuccagcuucuaccuugccuuuucuucuucuaguuuaauagaaaucauuaguaccaagauagcuaaaguguuuuuuggaaggguaagaguauggaaaaugcagcucauuuccuccuaaaucuucauugcuccacaccaaauuugggaggcuuauuauuuucaagccucuuccucuacauauuuucaccacuacaacaccacaaacaaaaagggaccuagcauaccauaggugcaucuguuugagaaaaugcccaaaguuggagguuuugguguuugcguccacucagcagaauuaauuugcuugauuguguauuuuugaugucagggacucucuugauaauuuuguacggugccuagcacauuuucauguauaccaagacacuucaaauaaauauuugauaaugguauuaaggcaaguaagccuuuuccaucucuaaauuguacaccauguauuuugagacuucaagucuuaacauuuuaucuucucaauauugauggauuucacuuguuuuuaggaaauuucaccaguguuguguuuauaaaaaagaaagauaauucuuaguaauagcuaauaauaaugaacauuuauggcaugcuuguuauaugccaagcacucugcuaaaucuuuucaugcauaaugucccuaauccuaccaacaacucuaugaaguaaaaccuauucuuucauuaucccuguuuuauggaacagaaaauagaaacuuagagaaguucagugauuuacuuagguucacauagcugguaagaaacuuacacuagucaucuaauuggcguguaaaugcauauguacccauagauacaaauguuauguuaugcucuuuuuuugaguugcaagcacagaauuuuacuugguagcuucuaaggagaguuuuauuagaagacuuuauuuggggaaauaugggagauauaagugaucaggccuuauaggauuccaagaguaauuguacaacucagcuucaccauucagauuucaacuagguagguguuacaaaaugagaaaaaaaaaucagugcaacucuagugucuggauguugcccucugagcagcagaaguauugcuucucugcugcuauuagcccuuuucagacucugcuuuauuuuguuuuaaacaaauuaccucacucuguaucuucucaauauggucuuaacugccucguuccacccucugcucuguguccuuccgcuacuuuccccuucuguacagcuugaguucaaucuucuguaagaggaaaucuaauuaguccaguuagauucauugccuguugggcuaaucucucaugucaguccccuucauagguugcuggccagucuguagauuggcugcucuugggacaguugcucucucuugguccugucauuugugaucauaguggcagagucaguggcauaaaacauggcccugggccccauagaaggaaucuuuuggugggaaucucuuaaaagaccauaguccuaaaaugugaugagcuuuccaguauacauguuuuucuuucuuuugaaaggugacagaaugaaaggcaaguugugaucuugacuguuaggucaaugcagcaucagcaauccuuucccuacugagaaaauguggaaaauaguguuuugaucaguaucugcauuuccuuuucuaaacugccugaugacauuuccuucuuuggguuuguagauucauagacagccugaaguuuucccucagaaagagccauuacauuuuuuguagcagcauauuaggccaccgcaucaguugcugcuguuuuccagacauccacaauuaugcugcauaguuugaguuggugauuuagugaauccucaaaguauuguuucugcuuuucuguuugugcuuuccacauuugggcuuacugugcaauggcugcuuuauauccugucauucauuccuucaaugacagacacuaucgagcauccaucaugugccuagcaucauuccauucuuuuggggaaacagucauacagugguuaaagcacggauuuuuuaagagucaagaagaccugaauucaaguccuggcuucuuugcuuacuagcucuguagugugggcaaguuaccaaaucuuucuaagcuucaauuuuccugucuguaaaaugauuauauuagaaacuaccuuauagguagguuuauugugggaauuuauaaaagcuuaaugauguguauaguguacuuagcacaauaccuggcucagggaagagcucaguaaauauuauuacugucguagugaucacugaacuuguaucgguuucuuucugaaauacuuucuagcacuuagcuuuugguuaucuugcuuugccauuugauguuuguugccuucuuguuggcaauaauccaaccguuaaaugaaaagucaaauguaacaucugugauaaagccaagauacacagaaguuuauuaaguuagagcacuucguuauuuuaugggccuuuaugcuggaguuuggugccauuuuugguggcaccuuuugcuaauuguucacgaauuugcugaccuuuuaugauauuauuuuguuucuucaugauuaaugucuuauugaacaauguguaguuuugaauagcaaaacucaggacaguuuuguuuuguuuuguuuugguaaacauuaggcuguggguacaggaauguauuuugagauuacaagcaagaauugucuuuucuuuguaucaccaaugccucauaguguaccuagcacacaacaguugcuaagagaaugaugaagaaagaaggaaggcaggaacaacacuucaguuaucuucaggcuuaucuuaucauuagucaacagucugucuuggguuuuacuucuuuucccauuacaugaucuaaucuguauagcuucucuacaugugagauuccucuucauuucugguuacuuaugguuucuguugccugccuucauugugugaaccuucuagcuucugccauugcuacuaaguaauagugacagguucagacucaugguagugcuacauugacuguauuaguauuagcccauauauaauugcaugcuauaugggugugcauuuagugauuuuucuugauaauucuuaauacuuaccuuuuuaaauucauacuuaaucuaauuccaugaaaugcagcuugccuuccacuucauguuccacuuccagauccaaacaaagcaugcccacaauuguugauugauugugcuuucucucauuuacauaaucuuaagaaguggaguugauugguuaucauuucauuuauccuugcuugcuucaaacuuuucacacuguucuuaagccuucaaccccaucuuugcuuccuuuauaaaagucagaucuugcuuauaucaugacaaaaaguagaagauguuuguuuaugcucuuuucacaucaggacuauuuuuuaucuucugucucuucuuuggaggaagagcuguuuuucuguuccaaguccagcacuuccacccuugccugucuacuucacuggacuuucuuccaacaacuccuccucuuuaccccuccccagcuucugucucccuguccacuagcuccucuuccucaaccuacaaacaugcucaaauuccuuucagucaaaaaauaaacuucucuucuauacuaccuugaaccuaguuacugccaucuagucugucaaacuuccaugugcucucauacuacccuguuuuaguacugauucugucacauuguaauuguuuauuuccuuguuuuccuucuauaucagacuguaagcuucugagaaaucugucucuugauccugguugauucaccgaagcccaagcuaguuccuagugcaucguacgcauucaguaaauauuuuuugaaugaaugaacaauguuagagccaugccucugccauucacuuugugaacuaccuguaauuuuuuucuaccccuacauuucgguugaaaguucacuugaaggucaccacauaaaugugaaaucuaguggcuucucucuuuacaucaugcuugaccucugcaaccauuagugcuuacaaauuuaccuuuuccacacauucauggucacguauaccugggucauuuugggccagucucaguauugcauucaaaagaagcagacaagccccgaaccuuuggaaaguaaugaacuucuguaauauauuagugaaaucuucuaaugagauagaaauauacaauuacauaaagcucagcaaacuucaaauaaguucuuuuuacccaccuucccauauccuuacacagcuuggcaccuucaaucucucuuuuguaacaguucacccaaaacuuguacacuuuuggccaaaaaccccuuguccuuuguccccuuuuuucaucuucuauguuuauuuucuuccaagaauagauuauucuuuccaguuuaaaucacuuuagccucuuuuggcuccuuccaaccaaguucuuuccuaaaccaguuaucuuacucaguauuuuagaaguccaggagcauugucuugauuucauuugguuugcccuuaccaacuuucuuugcaucauuuuauuuaaucuuaaugccucacaucagugaguauucccugaccuccugggugucucccuucugugucucuguggugccccguuuauaacucucuggaaauaaucuauuucuaucucuucucuaggcuauacauuucuuaaggguaggaguccugucuuuuuuuuguacccccauaucuagcauaguaccuggaacaugguggguguugauaaauguuuauuggacugaugcuucugugaaauuuaauacuuucucuuuugccacuggcuuuuguuuuguuacuaggucuucaaauauggauuaagguuuccuuaaugucuuuuuuucuuuuuauauacucuuagugauuccucuauucccgagguaucacuuaucacuuccauaaagaugacuccagguccguuuucuagucuggcuguucuccuuauuauaagaccauuuguuuucaaaguugaaugucagacaucuccacaugaaugugucaccaguaucuuaaaugcaacaaaaaacucaguaauccaaacuuaucuuccuuuuaaaauuucuuccuaugugcuccaugucucaguuguucuaaccccuacccuuccgguuaccuaugcuaguuggaauccuggcaaaugccuuaacuucuuucuuuuauacucucccuaaucugugaucaaugccuauccauccugccucugaauguuuuucacguuugcuuccccuucccaucuccacuuuuaguaguuuuguuaucacuuaccuucacuauugcaguagucucuuaacugaccucuuuucuaaucugucuuccgugcuguuguuagaaauaucuuccuaaaacacagaucuguuguuacuguauguucaucgcuugacuaauuuacuuaucuuucaggucucugccaaaugucacuucuaaauaaaguaugucugucuucuuuguuguuuguuucauguuccuuuccuacugucaucuaauacuguuuguaauuguguuuauauuugugcauugauuuguuuaaugucuuucuucccacuggagagauuuauguaagggacuggggagaguuauguagacccugggccuagcacaaugcucgggacauaguaacacuuaaaacauaucuguugaaugaguggauggauaauagcaaaguacaggcagugcaggcaaacagauaccaaguagcaaaggcagggaaauuacaggguccuagacucuuaguacauucucacagaccuuaaucuguaguuuaaaauaguaaugggcuucucucuuuugcuuuuugcauuuauuucccuaaggaugagagugaacaacuuacuaccccacacugacacuucagugagggcacuguggaaccuuucuaaucagaagaugggaccaggcuugacaaugauucaaucaaagcaguuuuagugucacacuugucucauggaggcuauuuguauuucugaagaaauuccaaucaaauaacagcuuacuagauuuuuuuccuggucuaaauauuauuuuugggcauuuuccacaaaaagcuuuuugggaaaggugguucuuacacuggggcuuggaauaauuguaucucuaugcuuggccuuggaauaauucugucucuguuggaauugugcacacguugaggccugaggccuuaucuuuuauagggccuucacuauguagcuucucauauauucagcaucuuaggagagaaucauauucaacauaguuuugcuuuaagcuuuuuacuugguaucagcaguuuugccuuaaguucuaaagcuuaauaaugaaacucuguugaaugagaaccuuuccaaaagauauacuuuucuacauaagcugaguuuauucauccagagucaucaagaauagauuauauuuagaacauauggaaugaauaaauauuagugaauucaucuuuauuggacuuuuaaauuucuuuacauauaauuccauucacucauuuauucagccaucuacacuugagcaacuacuuuaugccaaggacuguaguaaacauuuaggaucugaagaaaaauaugacuugauuacucuuaagaauuuuauaagucuaggcuuuuuuucaugucugaggccagauugauuuuucuuuuccuuuuuuucacucaggaugaaguacauagugguauaauccuaguugacugcagccucgaacuccugggcucaggugauucuccuuccucagcuuccugaguagcugggauacaagccuguaccaccacaccuugcuaauuuuuauuauuuauuuucuguagagaugaggucucucuauguugcucaggcuggugucgaauccuggccucaagcaauccuccugacuuggcuucacaaagcgaugggauuacaggcaugcaccaccacaccuggccuuagagugauuuuucuuaagugcaaauucgugcucuuuuuucuaaggccucagcuuggaauguccucuuguauuacccaccucucuucuuucaggacucaucucuuaggaaccuucccuguccaaggcagcugaguacccuucaguauacucauccuacccucucccucuccuguuguggcaguuaguaccauguuuuguaacuaccuguuuauuugggucuccccaacuagacugaaaaaggcgcuugaaggcagggcuguuuccguccuuguguccugagugcugagcacaauacugaguacaguuugugaccuauagaauuuguggagggaaggcauuuuggauggaggcuguugguuaagugaccugcaaaacugcuccaguaucaugccaggaucagucuucuuugcucauuauugaugagaagcaacacuaacuuaugucuuuauuccuaacuuaauuauacuccaaguacacauuugcaugcuucauuacaugccuguagugauaucagugacacugauaaaguauuuuuucauauuuuaguucucauguuuuugacucuuuauuuuaacuuuguuguugauugaauugaguauuugaguugcuguuaguauaaauaaaguuuccaucuuggaugacuuaccauguuaacaaaaaaaaaaucacaagcaguauuaugugcuagugauaccuugugauuuaaaauguauuuuguuccagcaaagaaccaguuugggucucuuuggagaaugggcauacaucugaguugaccucaacuuuucuguaggagagauuauugaaucuccuauaaaggauuauauguaaauauauaaauuaacauuugucuguuuuacaaaauagagugucugaaacaagaauacauaaaauguuauuuucaauguacuagaguagaggaguuugguauuuaaaggaguucuguacuuugguaaagccaaaauuccuuugauuacacuagugguugguuauuuaaucaggaugugaauucaaauugccuacaaaauuuugaaaaaaugcagauguuuggcugacuccacaucuaucagauugcaauuucuagugguaguguccaagcuccuauauauuuuguaccaacuaccuggguaauuugauggguuuucagaacuacucaacuauauaaaccaaagaaccucaaaccuuaacauauauaugaucaugugggaccuuguuaaaaugcagauucugagucaggagcucugggugugaccugagauuuuccaguuccagcgagcuccaugugauguccgugcugauggugugugauccacacuuugaacaauaaggcuauaaauaauaaccaucuacauuuuaaaagauuuccuuuuuuuuuuucauuuaagugugguguaucuguuuccuacucuugcuuauucuauaagagaaguguaaugggcuuuagauccagucuaaaauaguuuugguuuggauauugucuuccauuaaaguuucaguacgcagaggaugaaacuuuguccuucguuuuuuccaaugaccaucagauaaaugauaaacaugaaucuaaaaguaauuucucauuuccgauccuccugucagcuaugguccucugaggucaaauaaaagacaaguagaggaaguaagucaucuguucagagacucuauugccucuuaaaaauaacacucaacucugaagauuacacaugcuuaauuuucauuaugauauuguuaggacuagguguguuuauuguuuuuaaggcauugacugacaauuuuguuuuugaauaaguucuauuuuaaaaauaacuuuaauuucuuuacuuaaaaauauuuugcuuucagguccucuuugcuagaauuuuaauuugguauguugcauacagagguggaaauaguguuauagcuuuuaaauaacuaaauuaacuuuguugguaagaauuaaaaauaaccuaaaccuuacuggguugaucauaggaagcugaagggaugcuggggcuaugauacaugacaggagauuuacugacgugacuguaguugauuugggggcugugggguggugacagcuagauuuguuuacaugcugcugauguguagaugguguccuagguaugcaggcaaacagguauuugcuagguugaauuaacccaaauuccuuuuagucucuugaguaaugcaagccuuuguauuacauguuaauuaaagaguuuauuacuuguaagacuaguuguguuugaaaugagguguuugccuuuuaaagguugaagauuucaacuuagcacacuuuauugaauagaagaugaaagaaauuauuuaaaaauacgauuggggacagauuaguaauaauaagcaaauuaaacaauuuuuuuggcagagcuuguucaguaucaaaaguuaaagcauuccaugaguauucuucagauuucacugucuuacauugacuuauuucauucagucaguaaacaaguaagcuccugcuucgugcgaggcacugagucagguacagagacaagcaaugcaguuccucuucaaguaugauggaagaggaauacauuauaaggacacagaaguggaauauuaaggcacacugaggaguuaggaaagacuuauaauuccuaaauuuauucuugaguuuugaaagagauaggcagaaaaaguuuccauguagguacagagacaugaaaucacauguagauuaagggaaggaguaugagacagggaaauggccaaaucaagaaggcuuuuauguaccaaguaaauaguuugaacuauauuucaaaauuaggaguaccguugaaagauuauaaacagggacauauaauagcaccaaggggacugaauuggaguggagguggggaugugggauugugugagggaaaucaauuaagagacuauuucagaagucuaaguaagagugauaggacguaaauucggguuuuggcaaugagacuacagaaaaggauacaggugaaauaauuauuucagaaaugaaauuuuccaggcaguggagacgaagaaagaaucuaguaugauucaguuucaggcauucuaguugagcagguggguggcaccauucuucaaggcaaagaauacgggaggaagaagaacacuuuuccagggggaaaugcugaauuaaguuuuagguauguugaguuugaggugguagagggauaucuaauuggagaugcuuaauaggaguagaauauacagguuagaggucaggagagaaauugcccaggggcuagagauuuagaagucauuaguauucauguaguuguugaagccauagacuuugaagggauuaccaggaagaauaaauagaaucaauguauuauacuacuacauggauucuuuucauuuauuauguaauuuaggauaauaccuaccuauuucaguuuuucauuugggagcagguauuuggcuagcucugaugcugucucucucucucucucuguuacccccacccccauauaaaauauguaauauaacauguauuugauuuuacucugagaaguacugaauaauuaaauuguaauaguauuaggcaauaugaauuaauuuauguguuguauucagagagguuuuaagauaaaaucuguaagaccuauuuuaaaagauuauuucuugaaaaaggaaaaaucuuauuuuaaaaaauaaagcaauugauuaguguucuuggaccaaauaagauuuauuuguugagucccauagcuuugaucuguccaggaauuuucaugauuuacuccccaugccucugaucuaggcaaguacuaugucugugugccuaaucuagucaaggaaacuaggagaaagccaucuggcugauaagauccugauagaauuugacauaauccguaugagaaacuuaaguaauuuaguauccauagccagagucuaagggaauaaagguacuauuaaagguugaacagaugacuuaaauauauuaauuauacuuuguaaagcugcacuuuuuggacuggugaauauuuaaugaaauguagauccugcguugucauccuguggcccucauugguuuuucccuuuuccaccuccuuucuggaggaagaaccuaacgauaaaacuguuucugaucuugccaucuagaaaacacuaguaugaaguggaaauuugugucuccuuaaaagugaaaugaagcagccuauuuaccaccacguaccuccaggccaguggguacuuaugaggguaugcaagaugacuuuucagaaaucagcccugcuugggauagaaaccauugauuuaauaaagaaagcauaggucuguauaccacucaagaugccauuggucuguauccaacuuuuuuggcauuaacuuuuaaaauaugccuuuaaaggaaagaauucccaggagacuuugucaaguuucaauauaguaaauuuuauggcugaguuauaacuccuaaaaacugaagucaauaguagaaaugacagaccugaauuagaagaggauagcuauaauaaaacaauuuuuuuauucccuuaugaucuagaguaaaaaaaacacacacacacacauuuuuaaguuuuuuguuuuaaugcuuugaaaaugguuucucuuucuuguuauuuauacuuuaaucagugauggguauuagcauuaaagccuaauauccacaucaaauaauacaaggcacacugcuguaacacacaauuauauuaaccauaaacuuuuaccuguuuccagucucuuuuuguuuaaacaucauuuuuuuuuuccuggcaagccucuauauucucauucacaccccaguaaaucacuaagagauuauugaugaagauauguguauuuggguguuugaaggauuguaacaaaaaucaaaaguagaauagaauuuuagaauauaugcuuucugcauugaggacuucauuugcuuuauagccuucuuuauauuuguugauauucuuucuugcccugugccaacauuuuagaaauacauuuuuagaaauuucuuacaagauuuaucaguaugcuaccaauaacaacacacacucucucucucucacacacacauacacacacacacacagacacaacuuuuuauccauguaauaacaaauaucuugaauuuauaauguguauuuugccagaaguuaagugguuauacaucauugcuuuagcuuuacaaaaucacuagaucacugacagauuguucuuuugguuuuuuuuguuuugacauuuuuucauauaguuaaaacccacagcacucaauuucaucacccaggcccaauucacaaacuuaaucaauggcaaaguaaaacuggcaccucuugauuuccugguuuauguuuuuuggguggagcugauuccugaguaugaaaauuguguuaggaaauaauauuagguaccugcaagaaaauacuggaagaugguuaccaaacauccuguguaagugugauuuucucauaccucagggcccugccuauuaaaaaguuggaucuagauguguguugaucuugccuagucagccaguuuugauauauuacuagcaugucaucauuccuauguaguaaucuauaaagaaaauuuggcaacccaacauuugaaaaauaauuuuuaauauuuuuagccaaguuacuauuuagaauaaaacuaugucuaaaacuaaauucaucagccuguuaucuacgauuacugcucccauccuacuagaacugacucuccuugcuugaauucuucauuuuauccaugcuaccaccaccacuuugcuuauuacguagacuucaaagucuuauuucuucuaugaaucuguucuugacaguuccaacucauagagaccucuucugauaaacucacauuuaccuuaccauuuauuuuucacuucuauccuuuguguuauuauugcguuauuaauuacauugccccccaugauuagacuaagcccuuugagacccaaggcuagcaguuuuacccugcagcauguagaauuaugaaagaauggaucaccaggccuguccccauucuuccuguccuguaagcuaucaauaaguuuugauuucuuuuuuguagugucuucuucauguccuauuuuuccuggucuaagcuuucuauugcucuacucuuggccuucucugguucuuuuaguaucuucuguuuauaaagauuauggaugauuuuuagaagauucuugggauaauuuuuuggagauauaugggugauuuucagcuuuuuccuaucucaguuucaauuuugaaacucuaccacaaaauucuaccucuuuauacuuacauuuaauauuuacucaauaacugaaauguuuugagaguguguaucucagaagcaauaguuuggauaugucaaaaagguggguuaaucacacuuuuacuuucaauacagaauaaaaagacagaagaguaagucauugcaaauuaaggcuaauaguuauuuuauuucaccaccugauauuuuguauauaccuucgauugagccauaauucuguugaguuguacauggagaaucuagagauuuaguauuuuaaaauggagaaaauugagguaagugauugcacaaggucaaauguguagcugaugaagaagucaggaauagaagccagcuaucucuuaaagauuauuuuaauauguaauaacauguuuuuaaaaaguacaaaaagguauacugugaaagguaaguuuuuucccuaccccaucucucaguucuuccauuaccuuccccagaggcaagaaguuaccaauuucuuggacuuucaagagcuauuucauguaugugcaaucaaggagauguauacauuguccuucacacagaugguagcauauuaugcauaccuuucugcaccuugcuuuuuuuuacuuaacaaugucugaaaauuguagagcccgggauuuuuuuguuccuugguccaugaacuuuccauuuugcuauacugccuauuauuauuaaacaacuguuuuuuguuaauaugaauggacagaguauuaaauuauuauuuauuucuagcauauugaguaccucacgugcaacaugauguaguauuucacauuucuuucaggaagagagggucacugauuuaugauaaauaauguugaaaguuaaaaaauaauaagggaaauuuauaaauagcuguuauugcugguuaccaaaaauagcuaauuguauauuuacuuuuccauuugagaaagaauuggcagaugaaguuuucagggaaaucauuuaccuucagacuuguguaaaaauuuguacuguguguacaaacaguuuaucucaaggccagugagaagcaaugauguuaaaaugucaaaccacaaauguuuguuucauuuucuaaauuuuaaaaucuccaaccucaaaugcauaucacagaaauagucuuucauuuguuucucaaaacagcuuguaacuauauauuuuuaucuugauaugauucaugaucaucuauauaaaaauacaccauuaauuuugaucauucuggguuuuuuuuuuuggccagcuuaucuaucagugcaauuauugcuuuaacuuucagagaaaaauagagccugucagaaccguuugauuuuagaucuuauggaccaaauugugucacaaaagacaaauccauuuaaaaaugugucccaugccaaauguccaugauaauauucauagagguugaguacuuauauuugaacuucauguuagauaauuagucaguaauucugcuuucuuccuaaagauggcaggccuucucaauguauuauuuacuugguaauucugucugaaaauacuauuagacuccaaccauuguugauuggaaaaaaaguuaaucagacuaaaaauauauuuucauaacaccaucaucauaguuaaaauucaguuguugaacaaguaagaucauauucuugauguucauagcuuuagcacagcuuuuacguguguuauccucaacccugaacacaggguccuaaggguucuuacugcauucugacuuuggaauucuugauguaagauaaugaacaaaaagucuugucaagaacugugauuaagucauguuaggauccugccauauuuauaaguuucucuccuauggagaugaugucagaaaacaaaaacuggccaacaaaacaucccaaaaggaaacaacaccccuaaguaaugauguauugcauauauuuguggacaucugaaauauuuuuauauuuauucuuugguaaaaguuuauauguccaaguucuacuuggacuuuuucuuuuugcuuaggugacugauucuuuuaauaagcaaaauaaguacuuaucggugccauuggggggaaaaaaccacuuuggccuuaucugcuguaaaaacuaagcucacaaguuagugcucuagagcauggaaaaacacuauauuuuguuccuuuucucaucauuuccauuucuaauuaaaaugguuauuguguguguguguguguguguaaucgugggauuuugcuguuuaaagaagguggacagcaggacagagggcaggcuggccucccugccaggccucacaggaacuuugauguggccacugcuuucuaaggcugacccugauuauugguucauccagagagguaacuagguauuagaagacuguaucccuuuaaccggcuucauaguaguguauaaauuccacaauucaguucuuuaauuugagaugggaagugucaggcacaaucauuucucauguuuaugguucagugcauuuucucccaauaggcaaaucuacaugaaaaauaaauuauaaucagaagguugcuuggugagcauugaaucagcucucagcaaccagugucaguaagcucugguagugcaacacacucaucuuccccauaggaaugcaacugccacucagaccagauauuguucaauaugcagagcauccuuucuacuagaccaggcugcagaugcauggccagcuuuugcuuucuucauuucuuuucuuacagagguauuauagacuuucucuuuugauacuuuuuuucuauuagaauuuaaugcaguugaguugauuaauguauguaaaacacuuagcccaauuccugguauacaguaaguacaugauaacuauuauuaugaauaagcauaacugguuuugaguccaagucaucuuguuacuuguaauaucaaagacagucuuuugggccauguuuauagaugagugugauccaucuuuuacauuuugaguuauuuucauccuuuaauucuuuucauuuaauucuucaauuuuauuuauccuuaauguugaauccaugagcuaauuaggacaaugccuuugacuguaugugaucuugcuauuguuuuaacuuuaagauuuuuauucuuuuaaauuucaguuucuugcucugaaauaccccauucuccacauuucccccaccugucaugugaaucuguuggaagagaugaucuugaaguugcugcucaguuccagaauacauuugauuuuacaucuuauuugaguauaugaugucaguuguagccauuuccaucuaacugugcuugccuucauuuuaagcucugcuuaaauucuuucucauagagugugaaguuauuuugaaaaugguagcaacaucugaauccuuagaaggauggccauggcacugggagguugugauugaaaaguccauggguaaauguaggauuucagcagucagcagugacacuacagaccugacagauacacaacugacaaaucaaaacauuugugugaaaaugaguacagaaaggaaugauucagaugagucaguugaucaccccagcaaaaauaaucauugucagucuucucuccauccaucugggaagugaguuauucuuuuaagaguugcaaagaagauucaggaaaacaggaaaaauuaccacagcucuuucuggugcuuguaaaaauacauaauauggugcauuuuuaaaggugguggucucagaaccacauuuugagaacugucaaagauaggaaccauugucagaguucagaagagagaucauuucaggcugcaguagucagggaaagcuuaaugaaagagacuggcuuuggucuaggucuugagagauggacaggauuugaauagaugagagcagggagaaaacauuuuucgaugggugaaaugccaagaacaaaaguacagaggugggaaacaauaguguaaggggagugcagaaucaaauaguuugacucaaagguucuuaaaugugguccaugaaagaaaauuaaggcccuacuucugucaaaugacaucacucacuucagacuuggaagaaaugggcagcucugcauauuucucuucagcaugcaaaugaaugaaacuguugaugccucucagugcauccagcuucacauuuucaugugcuugcugaugucaucaaaggagaacuccauuuaagaacaccuuuuggaaacuggaaagacugucaacaucuucaaaauauucguucucaauaaauauucaaauggaagaagaaaaauugcacucugggggcagcuggugcaccugugaugucagcaacacagcaugguuuuccugcuugaugaggaaaggauugcugcacgucauugugccucggugcuuuccauaucagcagcuguuaccaccuuuccaaaagguguugccaagaaacaggagcaggguaagauguuuuucucuaaccagacagaaaucugcugacuuuccagaagucuaauugaacuugaaggcagaggaaauaaugugacuugaaucuaacuugaaagucuuggaggaauuugguguuacagugugcaggccaccuuaaccuggcaaauuccauucuaugcaauucugcuuucguucuauuaaauacguaccuuugugagucaaggauuucagcacuuguugccauagggaaaaaguuguaauggguuaucaaagaugaaguauauguugcuaugucaaaagccaaagcacaguuucaacucauuuaaacuagaucucauugagauguacuacugaacagucagaauuuucuaaauuuuuuuuccaggaaacagucauuuuucuuucaaaagagaacggaggcauaauccuuuacaaauauugcuuauguucaguaaaucaucuuccagugcagugaaacgaaguaaaugguguaugcacuucugcgcauguuucuggaggaggaaguccauaucuuuagucagaaucucuaucgauuuagcuauuguggaggcaguagguugcucuggauaaaucugagcaaaggaaugagaggaaaucagcucauuugaagaauaugggaugcgaagcuuugacacgacaauggcgaguaauuuagggauucagguuaucccccgcaucugaguaaucugaagguaauuuucuagcuagagcuucucaaagguaggaaccuuguguuaucuuuuuuguucauacugucugagcacagugcaggagacauaauagggacuccaaaaauguugaguuaaauugaaaucacuguaugaauagugaaagcuggacuguagcaccaauaauaaaugcucuucugucuuauuuguauuuaacauuguuugguuacaucauuuggggaauauuaagguuuuugagagaaaauguuuuauuaaaagcuccuauaaccuucauuuuauucaggagcaggugguuaacacaaacuuuuggccuuaagaggauuuauucucuuuggacauuuuauuuauuucugauaauuuuuaccaaaaguaugcuuccagacacaauaauuguauccaguaccuucagggugaaggaaacuuacaggauggugugauuacuuaugucaucuguuuaagcaacaaagcaacauuccaauaaacaucuaaucuuggauuugcucaucauuagauaaaaucagccugacaacucugagcucacuucagcuuaaaauauaucugaaacuuacagaggaucuucuaucaaucuaauaacaaaguccuggaaccccucuccuguguuauauuauuauaauuuuauuaucacuuuuaugcauguuccuggaacaaggcuuagcaaaacagacucccuagguauuaacuuaaaauuuuaaauuaauuuaugauugggagaccaggauguuaagcuuagauucuaguucauugccauauuuuaguuuugaucccauucaauuauuucaaacuaaagagagauucauugaauuacucuaaaacauugguaugaucuaaaacauuugucccacauuuuucuguuuuuagcaaacuguguguucccaagucuggaaauuacaaaucaaauuacauuucucaaaagcccagauuuuuuuuuuucuaaaguggaaauuauuacuagaguuaaauaagauauaaugucacaaaagacaguagcuuugauuaacugcaaaguguuuaagcaauaaacucuucuguaauacuguaauuuacgcagaacuuuugaggaagauaaacuacuuuuguggacucuucauuuuuuaaaaucuuuugauguccaccacuuugcuacacaauagaaaagaaagauuuucauaaauuugaauugagauaaauauagaauggguacauaagaauggaguaaaauuccuuguauuauauuuuuuacuguaaaacaaacuuguaugaaauuugggaaacauaaguuaaaaaagcguuaccugcagcuuuaucaccuggagauaacugcuuaacauuuugauguguuucuguccauuauuacauaugugaugugucguguguacacacauguacacguaaguauacacucacaugguacaaauggggaugaaacugauuuuuuucauugcauauaguaucaauucuuuuccauaucauuacguauuauuucacagcauuauuucaauagcaguuuaguauucgcuguaagaaaaagacuauaaccaauaccuuauuguuggguguaggacauucccauuuuuuuuuuuuuuuugccauuuuuuucuggcauuuuuuuuuucuauuauagauacugcacugaacacccuguaugaaaaguuuguagguauucauaauuauuccuuaagggaaaauucucaagcuagacuuucugggucaaagaguauucagacauuuaaggguuuugauacauuuuccuaaauugccaccaaguuguugcaugagaccugaauuggaucuguuuuccuaugaccaccgcaguuuucucucuuggcacccuguugggcgaaaguggcaccgcacugcccgugggucugcagcucuugcggggcugagaggcgucggcgcucuuuccuugguuucuaacccgcauaucuuugucuuuccucccuggggaccgcugccacccgugcgggccgaagccucgcgaagccgucgucccgcagcgccgccgcccugcgcccggccgcccccgggagccgcugccugcccgcgggcgccgucaccacgcgucaggccgcugccagcugccgcgcca

SEQ ID NO: 14552 - RNA, 6096 nt, Homo sapiens
uccuaucuuugacaguucucaaaaugugguucugagaccaccaccuuuaaaaaugcaccauauuauguauuuuuacaagcaccagaaagagcugugguaauuuuuccuguuuuccugaaucuucuuugcaacucuuaaaagaauaacucacuucccagauggauggagagaagacugacaaugauuauuuuugcuggggugaucaacugacucaucugaaucauuccuuucuguacucauuuucacacaaauguuuugauuugucaguuguguaucugucaggucuguagugucacugcugacugcugaaauccuacauuuacccauggacuuuucaaucacaaccucccagugccauggccauccuucuaaggauucagauguugcuaccauuuucaaaauaacuucacacucuaugagaaagaauuuaagcagagcuuaaaaugaaggcaagcacaguuagauggaaauggcuacaacugacaucauauacucaaauaagauguaaaaucaaauguauucuggaacugagcagcaacuucaagaucaucucuuccaacagauucacaugacaggugggggaaauguggagaaugggguauuucagagcaagaaacugaaauuuaaaagaauaaaaaucuuaaaguuaaaacaauagcaagaucacauacagucaaaggcauuguccuaauuagcucauggauucaacauuaaggauaaauaaaauugaagaauuaaaugaaaagaauuaaaggaugaaaauaacucaaaauguaaaagauggaucacacucaucuauaaacauggcccaaaagacugucuuugauauuacaaguaacaagaugacuuggacucaaaaccaguuaugcuuauucauaauaauaguuaucauguacuuacuguauaccaggaauugggcuaaguguuuuacauacauuaaucaacucaacugcauuaaauucuaauagaaaaaaaguaucaaaagagaaagucuauaauaccucuguaagaaaagaaaugaagaaagcaaaagcuggccaugcaucugcagccuggucuaguagaaaggaugcucugcauauugaacaauaucuggucugaguggcaguugcauuccuauggggaagaugaguguguugcacuaccagagcuuacugacacugguugcugagagcugauucaaugcucaccaagcaaccuucugauuauaauuuauuuuucauguagauuugccuauugggagaaaaugcacugaaccauaaacaugagaaaugauugugccugacacuucccaucucaaauuaaagaacugaauuguggaauuuauacacuacuaugaagccgguuaaagggauacagucuucuaauaccuaguuaccucucuggaugaaccaauaaucagggucagccuuagaaagcaguggccacaucaaaguuccugugaggccuggcagggaggccagccugcccucuguccugcuguccaccuucuuuaaacagcaaaaucccacgauuacacacacacacacacacacaauaaccauuuuaauuagaaauggaaaugaugagaaaaggaacaaaauauaguguuuuuccaugcucuagagcacuaacuugugagcuuaguuuuuacagcagauaaggccaaagugguuuuuuccccccaauggcaccgauaaguacuuauuuugcuuauuaaaagaaucagucaccuaagcaaaaagaaaaaguccaaguagaacuuggacauauaaacuuuuaccaaagaauaaauauaaaaauauuucagauguccacaaauauaugcaauacaucauuacuuagggguguuguuuccuuuugggauguuuuguuggccaguuuuuguuuucugacaucaucuccauaggagagaaacuuauaaauauggcaggauccuaacaugacuuaaucacaguucuugacaagacuuuuuguucauuaucuuacaucaagaauuccaaagucagaaugcaguaagaacccuuaggacccuguguucaggguugaggauaacacacguaaaagcugugcuaaagcuaugaacaucaagaauaugaucuuacuuguucaacaacugaauuuuaacuaugaugaugguguuaugaaaauauauuuuuagucugauuaacuuuuuuuccaaucaacaaugguuggagucuaauaguauuuucagacagaauuaccaaguaaauaauacauugagaaggccugccaucuuuaggaagaaagcagaauuacugacuaauuaucuaacaugaaguucaaauauaaguacucaaccucuaugaauauuaucauggacauuuggcaugggacacauuuuuaaauggauuugucuuuugugacacaauuugguccauaagaucuaaaaucaaacgguucugacaggcucuauuuuucucugaaaguuaaagcaauaauugcacugauagauaagcuggccaaaaaaaaaaacccagaaugaucaaaauuaaugguguauuuuuauauagaugaucaugaaucauaucaagauaaaaauauauaguuacaagcuguuuugagaaacaaaugaaagacuauuucugugauaugcauuugagguuggagauuuuaaaauuuagaaaaugaaacaaacauuugugguuugacauuuuaacaucauugcuucucacuggccuugagauaaacuguuuguacacacaguacaaauuuuuacacaagucugaagguaaaugauuucccugaaaacuucaucugccaauucuuucucaaauggaaaaguaaauauacaauuagcuauuuuugguaaccagcaauaacagcuauuuauaaauuucccuuauuauuuuuuaacuuucaacauuauuuaucauaaaucagugacccucucuuccugaaagaaaugugaaauacuacaucauguugcacgugagguacucaauaugcuagaaauaaauaauaauuuaauacucuguccauucauauuaacaaaaaacaguuguuuaauaauaauaggcaguauagcaaaauggaaaguucauggaccaaggaacaaaaaaaucccgggcucuacaauuuucagacauuguuaaguaaaaaaaagcaaggugcagaaagguaugcauaauaugcuaccaucugugugaaggacaauguauacaucuccuugauugcacauacaugaaauagcucuugaaaguccaagaaauugguaacuucuugccucuggggaagguaauggaagaacugagagaugggguagggaaaaaacuuaccuuucacaguauaccuuuuuguacuuuuuaaaaacauguuauuacauauuaaaauaaucuuuaagagauagcuggcuucuauuccugacuucuucaucagcuacacauuugaccuugugcaaucacuuaccucaauuuucuccauuuuaaaauacuaaaucucuagauucuccauguacaacucaacagaauuauggcucaaucgaagguauauacaaaauaucagguggugaaauaaaauaacuauuagccuuaauuugcaaugacuuacucuucugucuuuuuauucuguauugaaaguaaaagugugauuaacccaccuuuuugacauauccaaacuauugcuucugagauacacacucucaaaacauuucaguuauugaguaaauauuaaauguaaguauaaagagguagaauuuugugguagaguuucaaaauugaaacugagauaggaaaaagcugaaaaucacccauauaucuccaaaaaauuaucccaagaaucuucuaaaaaucauccauaaucuuuauaaacagaagauacuaaaagaaccagagaaggccaagaguagagcaauagaaagcuuagaccaggaaaaauaggacaugaagaagacacuacaaaaaagaaaucaaaacuuauugauagcuuacaggacaggaagaauggggacaggccuggugauccauucuuucauaauucuacaugcugcaggguaaaacugcuagccuugggucucaaagggcuuagucuaaucauggggggcaauguaauuaauaacgcaauaauaacacaaaggauagaagugaaaaauaaaugguaagguaaaugugaguuuaucagaagaggucucuaugaguuggaacugucaagaacagauucauagaagaaauaagacuuugaagucuacguaauaagcaaagugguggugguagcauggauaaaaugaagaauucaagcaaggagagucaguucuaguaggaugggagcaguaaucguagauaacaggcugaugaauuuaguuuuagacauaguuuuauucuaaauaguaacuuggcuaaaaauauuaaaaauuauuuuucaaauguuggguugccaaauuuucuuuauagauuacuacauaggaaugaugacaugcuaguaauauaucaaaacuggcugacuaggcaagaucaacacacaucuagauccaacuuuuuaauaggcagggcccugagguaugagaaaaucacacuuacacaggauguuugguaaccaucuuccaguauuuucuugcagguaccuaauauuauuuccuaacacaauuuucauacucaggaaucagcuccacccaaaaaacauaaaccaggaaaucaagaggugccaguuuuacuuugccauugauuaaguuugugaauugggccugggugaugaaauugagugcuguggguuuuaacuauaugaaaaaaugucaaaacaaaaaaaaccaaaagaacaaucugucagugaucuagugauuuuguaaagcuaaagcaaugauguauaaccacuuaacuucuggcaaaauacacauuauaaauucaagauauuuguuauuacauggauaaaaaguugugucuguguguguguguguaugugugugugagagagagagaguguguguuguuauugguagcauacugauaaaucuuguaagaaauuucuaaaaauguauuucuaaaauguuggcacagggcaagaaagaauaucaacaaauauaaagaaggcuauaaagcaaaugaaguccucaaugcagaaagcauauauucuaaaauucuauucuacuuuugauuuuuguuacaauccuucaaacacccaaauacacauaucuucaucaauaaucucuuagugauuuacuggggugugaaugagaauauagaggcuugccaggaaaaaaaaaaugauguuuaaacaaaaagagacuggaaacagguaaaaguuuaugguuaauauaauuguguguuacagcagugugccuuguauuauuugauguggauauuaggcuuuaaugcuaauacccaucacugauuaaaguauaaauaacaagaaagagaaaccauuuucaaagcauuaaaacaaaaaacuuaaaaauguguguguguguguuuuuuuuacucuagaucauaagggaauaaaaaaauuguuuuauuauagcuauccucuucuaauucaggucugucauuucuacuauugacuucaguuuuuaggaguuauaacucagccauaaaauuuacuauauugaaacuugacaaagucuccugggaauucuuuccuuuaaaggcauauuuuaaaaguuaaugccaaaaaaguuggauacagaccaauggcaucuugagugguauacagaccuaugcuuucuuuauuaaaucaaugguuucuaucccaagcagggcugauuucugaaaagucaucuugcauacccucauaaguacccacuggccuggagguacguggugguaaauaggcugcuucauuucacuuuuaaggagacacaaauuuccacuucauacuaguguuuucuagauggcaagaucagaaacaguuuuaucguuagguucuuccuccagaaaggagguggaaaagggaaaaaccaaugagggccacaggaugacaacgcaggaucuacauuucauuaaauauucaccaguccaaaaagugcagcuuuacaaaguauaauuaauauauuuaagucaucuguucaaccuuuaauaguaccuuuauucccuuagacucuggcuauggauacuaaauuacuuaaguuucucauacggauuaugucaaauucuaucaggaucuuaucag

SEQ ID NO: 14553 - RNA, 6096 nt, Homo sapiens
cugauaagauccugauagaauuugacauaauccguaugagaaacuuaaguaauuuaguauccauagccagagucuaagggaauaaagguacuauuaaagguugaacagaugacuuaaauauauuaauuauacuuuguaaagcugcacuuuuuggacuggugaauauuuaaugaaauguagauccugcguugucauccuguggcccucauugguuuuucccuuuuccaccuccuuucuggaggaagaaccuaacgauaaaacuguuucugaucuugccaucuagaaaacacuaguaugaaguggaaauuugugucuccuuaaaagugaaaugaagcagccuauuuaccaccacguaccuccaggccaguggguacuuaugaggguaugcaagaugacuuuucagaaaucagcccugcuugggauagaaaccauugauuuaauaaagaaagcauaggucuguauaccacucaagaugccauuggucuguauccaacuuuuuuggcauuaacuuuuaaaauaugccuuuaaaggaaagaauucccaggagacuuugucaaguuucaauauaguaaauuuuauggcugaguuauaacuccuaaaaacugaagucaauaguagaaaugacagaccugaauuagaagaggauagcuauaauaaaacaauuuuuuuauucccuuaugaucuagaguaaaaaaaacacacacacacacauuuuuaaguuuuuuguuuuaaugcuuugaaaaugguuucucuuucuuguuauuuauacuuuaaucagugauggguauuagcauuaaagccuaauauccacaucaaauaauacaaggcacacugcuguaacacacaauuauauuaaccauaaacuuuuaccuguuuccagucucuuuuuguuuaaacaucauuuuuuuuuuccuggcaagccucuauauucucauucacaccccaguaaaucacuaagagauuauugaugaagauauguguauuuggguguuugaaggauuguaacaaaaaucaaaaguagaauagaauuuuagaauauaugcuuucugcauugaggacuucauuugcuuuauagccuucuuuauauuuguugauauucuuucuugcccugugccaacauuuuagaaauacauuuuuagaaauuucuuacaagauuuaucaguaugcuaccaauaacaacacacacucucucucucucacacacacauacacacacacacacagacacaacuuuuuauccauguaauaacaaauaucuugaauuuauaauguguauuuugccagaaguuaagugguuauacaucauugcuuuagcuuuacaaaaucacuagaucacugacagauuguucuuuugguuuuuuuuguuuugacauuuuuucauauaguuaaaacccacagcacucaauuucaucacccaggcccaauucacaaacuuaaucaauggcaaaguaaaacuggcaccucuugauuuccugguuuauguuuuuuggguggagcugauuccugaguaugaaaauuguguuaggaaauaauauuagguaccugcaagaaaauacuggaagaugguuaccaaacauccuguguaagugugauuuucucauaccucagggcccugccuauuaaaaaguuggaucuagauguguguugaucuugccuagucagccaguuuugauauauuacuagcaugucaucauuccuauguaguaaucuauaaagaaaauuuggcaacccaacauuugaaaaauaauuuuuaauauuuuuagccaaguuacuauuuagaauaaaacuaugucuaaaacuaaauucaucagccuguuaucuacgauuacugcucccauccuacuagaacugacucuccuugcuugaauucuucauuuuauccaugcuaccaccaccacuuugcuuauuacguagacuucaaagucuuauuucuucuaugaaucuguucuugacaguuccaacucauagagaccucuucugauaaacucacauuuaccuuaccauuuauuuuucacuucuauccuuuguguuauuauugcguuauuaauuacauugccccccaugauuagacuaagcccuuugagacccaaggcuagcaguuuuacccugcagcauguagaauuaugaaagaauggaucaccaggccuguccccauucuuccuguccuguaagcuaucaauaaguuuugauuucuuuuuuguagugucuucuucauguccuauuuuuccuggucuaagcuuucuauugcucuacucuuggccuucucugguucuuuuaguaucuucuguuuauaaagauuauggaugauuuuuagaagauucuugggauaauuuuuuggagauauaugggugauuuucagcuuuuuccuaucucaguuucaauuuugaaacucuaccacaaaauucuaccucuuuauacuuacauuuaauauuuacucaauaacugaaauguuuugagaguguguaucucagaagcaauaguuuggauaugucaaaaagguggguuaaucacacuuuuacuuucaauacagaauaaaaagacagaagaguaagucauugcaaauuaaggcuaauaguuauuuuauuucaccaccugauauuuuguauauaccuucgauugagccauaauucuguugaguuguacauggagaaucuagagauuuaguauuuuaaaauggagaaaauugagguaagugauugcacaaggucaaauguguagcugaugaagaagucaggaauagaagccagcuaucucuuaaagauuauuuuaauauguaauaacauguuuuuaaaaaguacaaaaagguauacugugaaagguaaguuuuuucccuaccccaucucucaguucuuccauuaccuuccccagaggcaagaaguuaccaauuucuuggacuuucaagagcuauuucauguaugugcaaucaaggagauguauacauuguccuucacacagaugguagcauauuaugcauaccuuucugcaccuugcuuuuuuuuacuuaacaaugucugaaaauuguagagcccgggauuuuuuuguuccuugguccaugaacuuuccauuuugcuauacugccuauuauuauuaaacaacuguuuuuuguuaauaugaauggacagaguauuaaauuauuauuuauuucuagcauauugaguaccucacgugcaacaugauguaguauuucacauuucuuucaggaagagagggucacugauuuaugauaaauaauguugaaaguuaaaaaauaauaagggaaauuuauaaauagcuguuauugcugguuaccaaaaauagcuaauuguauauuuacuuuuccauuugagaaagaauuggcagaugaaguuuucagggaaaucauuuaccuucagacuuguguaaaaauuuguacuguguguacaaacaguuuaucucaaggccagugagaagcaaugauguuaaaaugucaaaccacaaauguuuguuucauuuucuaaauuuuaaaaucuccaaccucaaaugcauaucacagaaauagucuuucauuuguuucucaaaacagcuuguaacuauauauuuuuaucuugauaugauucaugaucaucuauauaaaaauacaccauuaauuuugaucauucuggguuuuuuuuuuuggccagcuuaucuaucagugcaauuauugcuuuaacuuucagagaaaaauagagccugucagaaccguuugauuuuagaucuuauggaccaaauugugucacaaaagacaaauccauuuaaaaaugugucccaugccaaauguccaugauaauauucauagagguugaguacuuauauuugaacuucauguuagauaauuagucaguaauucugcuuucuuccuaaagauggcaggccuucucaauguauuauuuacuugguaauucugucugaaaauacuauuagacuccaaccauuguugauuggaaaaaaaguuaaucagacuaaaaauauauuuucauaacaccaucaucauaguuaaaauucaguuguugaacaaguaagaucauauucuugauguucauagcuuuagcacagcuuuuacguguguuauccucaacccugaacacaggguccuaaggguucuuacugcauucugacuuuggaauucuugauguaagauaaugaacaaaaagucuugucaagaacugugauuaagucauguuaggauccugccauauuuauaaguuucucuccuauggagaugaugucagaaaacaaaaacuggccaacaaaacaucccaaaaggaaacaacaccccuaaguaaugauguauugcauauauuuguggacaucugaaauauuuuuauauuuauucuuugguaaaaguuuauauguccaaguucuacuuggacuuuuucuuuuugcuuaggugacugauucuuuuaauaagcaaaauaaguacuuaucggugccauuggggggaaaaaaccacuuuggccuuaucugcuguaaaaacuaagcucacaaguuagugcucuagagcauggaaaaacacuauauuuuguuccuuuucucaucauuuccauuucuaauuaaaaugguuauuguguguguguguguguguguaaucgugggauuuugcuguuuaaagaagguggacagcaggacagagggcaggcuggccucccugccaggccucacaggaacuuugauguggccacugcuuucuaaggcugacccugauuauugguucauccagagagguaacuagguauuagaagacuguaucccuuuaaccggcuucauaguaguguauaaauuccacaauucaguucuuuaauuugagaugggaagugucaggcacaaucauuucucauguuuaugguucagugcauuuucucccaauaggcaaaucuacaugaaaaauaaauuauaaucagaagguugcuuggugagcauugaaucagcucucagcaaccagugucaguaagcucugguagugcaacacacucaucuuccccauaggaaugcaacugccacucagaccagauauuguucaauaugcagagcauccuuucuacuagaccaggcugcagaugcauggccagcuuuugcuuucuucauuucuuuucuuacagagguauuauagacuuucucuuuugauacuuuuuuucuauuagaauuuaaugcaguugaguugauuaauguauguaaaacacuuagcccaauuccugguauacaguaaguacaugauaacuauuauuaugaauaagcauaacugguuuugaguccaagucaucuuguuacuuguaauaucaaagacagucuuuugggccauguuuauagaugagugugauccaucuuuuacauuuugaguuauuuucauccuuuaauucuuuucauuuaauucuucaauuuuauuuauccuuaauguugaauccaugagcuaauuaggacaaugccuuugacuguaugugaucuugcuauuguuuuaacuuuaagauuuuuauucuuuuaaauuucaguuucuugcucugaaauaccccauucuccacauuucccccaccugucaugugaaucuguuggaagagaugaucuugaaguugcugcucaguuccagaauacauuugauuuuacaucuuauuugaguauaugaugucaguuguagccauuuccaucuaacugugcuugccuucauuuuaagcucugcuuaaauucuuucucauagagugugaaguuauuuugaaaaugguagcaacaucugaauccuuagaaggauggccauggcacugggagguugugauugaaaaguccauggguaaauguaggauuucagcagucagcagugacacuacagaccugacagauacacaacugacaaaucaaaacauuugugugaaaaugaguacagaaaggaaugauucagaugagucaguugaucaccccagcaaaaauaaucauugucagucuucucuccauccaucugggaagugaguuauucuuuuaagaguugcaaagaagauucaggaaaacaggaaaaauuaccacagcucuuucuggugcuuguaaaaauacauaauauggugcauuuuuaaaggugguggucucagaaccacauuuugagaacugucaaagauagga

SEQ ID NO: 14554 - RNA, 14339 nt, Homo sapiens
aagcacagggauuauuaguccuaggaaagcaacugugacuauggaucuuucuacucuguccacagcuaccuagaaauaacaauuacaagacauccuacauuuagagagaacaagguaagaaaauuaagcaaguuuauuacuauuuuuuaguuuggcuugauguccugagacacuuuuucgggauacuaugaauccugauuuuaaggauaauaaagcauucauaaacagauuacuuauagagguugaaguguaauuauggaaguuuuaagccugcccacuaaacccauaagaaagcauuuuccagcauagguggccacacacaaacauauacacacacaauuccaggcuaagaaauguguuauaacuaaggugguuaaagcaccgagguauuccucccuggauucaagcucauggauuaacauaugaaaacauuauuuccauccuuuucauucaccauuuacauucacaaucuauuuuugucuagauauauagauacuauuaaggaaccacacaggucaagucacucagguuuaaugauuccaucauuuggacacauaaacuucuguuccauuuaagucugcucacuguagauaauccaggucacccagccucccauuaagauuuaaucaaaguuuucugcaccccaaacccucacaaaacagaccucuaugaugaaaucacagaaagauacauauuaguccaguuaguggccaaacauuggucuuuagaguccaaagaccucuauaaccaguaacaguaguugggagaaaagaaggaauaaagaaacugaguuuucugagaacccccuuuccagacugccugaauaaguugccuuuucuuaaaagagcaggauuaaucuacuuaugccaagacccacugggcagaaagcaccccaacccagguuuagcugaucuuuaccacuucccugugagagcuacagcaaucuuuuggaauuuucugcagcaaauuuuccccuuuugcugucccuacaaaggcagaaaagcuaggggccaaucucugagcuaauuccuugaauccaggcaggaugagcauucaccauuuggaccccucucuguaagaagcuaggacuuuauuucuuaaugaaaguucaacacugaggaaaagauagcaaagucguugacucacaaucucaggccaaccucaggcagauagguuaaggcaaggauaggcaagaaaggucuauuuuaacccuauccaggcaaaaagcagguuacuuuggaaaucccuaagaucaagcuggugcucagggcccucucuaggauggucauaagcggugugauugcauaggucauccccaggcacuaauuagacuaagcuucccaguuccuuccagaauaaacucacuauuccuuagcccuugggacuaguggaugauaugucacuauuucaaacuuccuggucccuuuccagccugguuuuauguccccagagaauugggguagcaauggaccagacucagacugugaugagagggagaaaauagcuagguuuugugcauuucagagauuaacugaacucccuuuggagucacauuuacuccuagcuuugugccaggagcauauuauuaaaacaaaacaucuuauuuuaaaacagccuuaccacuguuccaacuucugcacuucucaguccuaaccucaucuucuccucacaugcacaccaucagaagauacugccccaggacuuucaguaucucuagggccuaaggauaaagcagcauuaauggcauuuggcagaaaaucccuucccacauugaagacuccucccagcucaacacagugaagaaauaaaugacaauguaagagaagaggcagcagaaaccagagccugcccuuucccacauaaaagaggcacagaaauuccaggaauucaugaaaauggcaucaucucuugccagaaggccaccagcuggcacugguugggagucgcauuaucacuuguuucuccucuggacugaagugcaagauagucaguauggcugugagagucugcuggcggcccagggagucagguaaggucaggaagcgguagaugauguuuuugagguacuccagauuggcucccucccugcucuggucccugauguucuuuucgauguggcucugcagggcugcaaccuccucacgaugccguucgcccuccuccagcagccgauccugcagcugaugcaccucgaccuccagccugugcuucugcuuccucagugaugugaucuccaccuccuugcgggccaguugcucagcguacagaaagaaagugggcucauuggccgcugcaaguuguaaugcuugggucaggcuaucagaggaugaugugucagcuggguccccaggaccgccaccacccacaggacuucugcguccuggcagcccagaggccaaggccacagaacgcaguugcuccaguuccaaguccuucucggugagcacagcuagggcacgaucccgcugcuugugcagcuccuccuccaguuucagugugcggucccugaaguccagcuggcaccgcuccagcuccugccgguggagcugcugcagccgggccagcuccugcuuccagucaucagccuccugcugguguuggugcuccagcuccucgcaggagagccgcagggaaauauacuucuccuucagcucugcaagcuguuccugggcugccuccagcuccuuucccagguuaccaucuuugguauucuugcuuuugaggacaaccugggcucucaucuuguaccucucaaacucuuccuucagcuguuucagcuccuguugguaauagagugcaguagccuucuccccaucagcagccuccgagcugggcauuaucuccaggucacagagcuucuccacauccagggucaccuggcuuuuccuggccgcaaccugcagcagccucuucagcuucuccaucuuaucuuucaggacauugacauccagacuggacuccucuccauggcugucuaaaggggaccugcuggaggcugcuagagccagugucuuguucuccagguccagcugcagaaugcgcuccuucagcuucugaauggccagcugguccuucugcuuggcuuucucguaggugccuagcagcucagacaccucggauauuugauucuccagggcugccacccucuguucuucuaccugagauugcugacggaguugauccucugcaagagcugucugcaaaacaagggaacagacaaaaaugcauccacaaaagccccacagcaaacucugagaaagcaggagaggggagcaaaagggucacagguuugggauggccuggcaagaaugcuaacuagggauuuuucgguugauucaggagcuaacaaaaguuccuauuaccugcuuggauucugcaagacacauauuauacugaacaauaugaagcaccuugguacaucugcuauuguucugcuuuccaccuaaccacauauaauguguguuacuguuguuucucaggugcuuccucaaauccuauuaagaaaucauacagcauucuuuuccuuauccaauauuccuggaaguucaaaacugcgcuggaucucccucuccacauugaaaggaggcacccuuucaauaccuguucuggaaaauagcacuucuccagaacaggcacaucuugaguaaaggcaaugacaagagguuacuucugagaaaauccccuuugccuucggccacucuuccuagaggcacauaccaacagaagacacgcuaccuuuuacuauacagcugccacuauacugcuucauagagcacagcugguaagaugccaaugcccagaagugcagagcugucuggcuucaacccagccuacacugagaagcuccacauccuccuggaagcacauaugucaacaccgcauagaacaggacuucccagguucacuaguggaacuucucagguggcaucaaaaaugacaguauagacacuuagcucuaacuagcaaaggaggaaaaaaacccuaauauuucucacuucaggucaauggcugauguuugaaagagauauggauaauuaccuuucucauuuccugcuguaacugagccuggaaauggcucuuaaggcgggcagccucuuccugaaguucuugcagccggggaucuggcugauucuucucaucucgaauggccugcaguucacuuuucagcuccuccaccucacgggucagcugcuuggucugcaguucaaauccuuccaucuguucagcugcauaugcucguccugccaaggcuucucgggucucuucuaaccuaagcuccaaguccuggcgcuggguccucuccuccugcagcagcuucuggagcucacgcagcaucaaggcauggucacucugcucuugggcccgaucaugcugcugcgugauaagccgggcuuugguuucugcuauuugcuccugcagccccuucaauucucccuccaggcgggcccucuccuccuccgccuuguuacuggcauccucuaaguccuguuucaucuuuuucuugucagccaaguaagaagccuccaugcgggacuucuccugagugacuguagccaaagaacuggucaaaguagccaacugagucuucagcuggugcagucuuuuguccaccuccccaccugcaaauggcccauccccacugcuacugcuaacgccacucucggaccaacuggccucuucggacuuuggagguggugguccacgggccggucugucaucuucuaccccaaacucacccuuggugcuggugagacuggccgcaguauccaagcuaguggcggucccagugcuauccucgcugugaguggagcaccggucauccacagagucaggaaaggugaggccuggaagcuggacaccugcgaggcccacaucugccucgugggauaccgacagcaccuugaugcuggccucuaaugccucuuucuccuucagcaggcuuuuauaggcacggaccacauccuugagccgugccugguacuggagaagcugcuucuucugggucucuauagucuccagcaaguccuucuugcucgggccgcccccgaaauucaucccaaacuucuccauggagggucugaacggauugccccacgucagcuuuccagcagaacgggagagggccgugaagacgcaggcgggggcuuaaagaaacagcgagcgggcuguccggcggcgggccgcacaccuacuccaccuaguuaucccggaccuaaugcggaacggccggacggacuggcgaaagcggccgcccggucccaggcccggagggcuggggcggauucuaccccggaggcggggcgacacuggcaccagaggugcgcacugccagggcucguuagcgcuggcccagaagccgcuccgcacucuccgcucgucugggccacagcagcccgggccggcccccucggcccacgucggccagaggguuacgcugagcucggucccaucacgacauccuaacuaaagcugccugccgacaacggcgcuuccguguccgcuggaagugacgucagcgaggcgccgcaggcuccgcccccagugggcccaagguaggcggggccaagucggccggugggugggcgcggccuguugagaacgcaguggggccgcgagcggcaaaaaacaggcuugggaaaggcgaagccagcaaagucgaagacaccagaguggcaccgguuuugugagagcgcccaagcuugaccucgggcuacgcucagcgagcgacagagcaacgucgcacugcauucuuaccaaacacccaggugaacgacgcauccaacgauuugggagcucaggacccauggucccuaaaaggcaacaauuaagacucccauuuagaccacgaaaacugcaguccucuauagcacagugcuugguaccuaguaggcauacagccuaauaguacccuuccuuaguucugcugaguugauuccacaaauauuuacggagggcacucuauagccaugucuauccugagugccagcuauauaccaggagcucacaagaguuuugcuauuuagucuuuacaguaauucuuguaagcacuauacucauuagcacuauuuuacagauaugaaaacaugaggcagaaagguuauacguaacaugcccaaggucacacagcuaguaaguuuaggaguucuaaucagucugauucucaacguaucacgugcugugccagaugguaacaccauuaagagacacgaccuugcccucagggagcucgcaaucuagugaggaaccagacauacaaauauguccugcuaucacaccaguaugucuggguauauucaaagugguaugaaaguuaagaggaaagaggccugucuaggugaggcauggaaggcucuugggaauaauacuuugggauuugaaggaugagucgugauuguccaccuaaccagagaucagggaaacuagcauuccaggcagguggaaaaaaaugcaaagaccuguaggguaucggaguuugacucacccagaaagcauucaguagcuuaggguaugugaaggaggugacaacagaggggcuggcacaauagguagggacccaacuuauggcauuuaaauuuuaucuuggguuauaguaaggcccuaauggauuuuaaucugaaaagugggaugucaucaagacuuguaugacauguuggagggaacaaggggcaggaaaccugugaggagacuuucagucauggggaacagaagguagugacaacagagauggaagcaaagaggcugauaaaagagcuaaauguagaauugaccuaacuuggugaacacuaguucuguuauuauauuggaacucucuaaaauguacucuucagccucguaaaagccuucuuagggaugcaagucuaugacugaagagaaaaggaaagucauucacucacucauaccuguuucccaaagucuguccuuguuacagacuuugcagaucaggauggggcaggcccuggaggucuguucagaccccguuucucaguggcccaaauaacaucaagcuguauuauacauaacauucagucacauuaucaaaucauuuuaagauucaccauaaccccuuaaguuagaacaagucucauuuuauagaugaugaaauaacggaagaguuaugaggagugcugaagccaaauccucaagaaauggcagaauuaagauuugaacuaaagccugaaaucacgugcuggcaaguggugggugcucaguaaauaucugcugaaaaagcaaaugaaugagugaagguuuuuuuauucccagcucaguuuaccucgaguccauaaacaauugauccuagaagcccacugggaauccagaguagacauaacaccuacccucgcuccauugagaaucuaucaguccaguucaacugaacaagcauuuguuaggccuaauaaugccuggcaaugagccagucuccaccgcagaagaauuucauuccuauuuugcuauucuccucucagauguuaaaaugaggcagggaaaugacaugugaagcucuuugggucuacggagucaagaucuucacaaaauccugaauggaugugcaagaauaagccagguccacaagucuguggcaaagugaggaacuucggcaaagcggccagcgccuggacugagaggcggggcccgcagggcgauccaaacgaagguggacuucuccaacagcccaggagugggucugugaccccgccgcccaaggccgggaaucuuacacugguucugcggauugggaauuaggaaguaggcguuuugaggaaccauggaagcuagcuagcacucgggcaccuuccccuaccucccgcgcacucuucacacgaccaccuacuacgcgcaagucccucgguggaagaugaggcaguaaagggaggaccaagaccccuaaucgcagcuuccacuccccaaaggagaguggugcacacguucagugcuacugguucccaagggcuaaaaccggagccccuaggggccuggacgcaacaaaccaaagcccagcggccggccacugaaaaugggggcaggggccgcugcggagcgaugaauccuuuccucagccgcgcucgggcugccgguucggcggccacaggccuggcaggcgcguuagagaccuagacccguucccaaguaagggccgcacgggacccaggccagcagcggcaacucgcggagcuucagcuccccuaggagccagagccgggggaggcggggccgagagccgggggcggggcccggacgggggcgggcccgcggugacgucgggagggcagcgacgcgcggaggcggcggcggagccuccuccugcugcugcugcgccccauccccccgcggccggccaguuccagcccgcaccccgcgucggugcccgcgccccuccccgggccccgccaugggccucaccguguccgcgcucuuuucgcggaucuucgggaagaagcagaugcggauucucaugggugaggcagaucgagcgcgcggcccggaccggggcgccggccccggcgcagcccuuccgcccccgcgucccuccagccccgcucaccugggucucuggccccgagucacccaccucauaacgccccggggccucugcucucgggcgggucccggucugcaucgccgaccccggggccugacacccggagcugcgggccuggguggggugaagcucccuccgccccagcccggcugguaagaagggaggauuccgcccuuggagacgacuuuuaaaacgagcgcggccuaccucccgugccccuugccucccaguccucucccgcuccgcgcccucuuuggaguuggcucacgccacccgacugcccuccaggccucaaagguagauaacgacgcgcaccuggaggcgcucccgcucuccgccccagucaccaucagcuguuguggccucucccuuucccuggucucuagggggcucccucgcucccaucuccaucccugugccccuuuccguugcaguuggcuuggaugcggcuggcaagaccacaauccuguacaaacugaaguugggggagauugucaccaccaucccaaccauaggugagcccggggacgaagcagggagcgggagcgccgcggcgggcccucgcggggucugcucccaguucugccacuuuucuggagcugacccugacaccagauacagcuauuugagaagugggucaggguaucucuacguggauaccggaggcaggguggaugugaccuagccccgcccuguugaccgccaguucugggguucuguuccccugggccuugaucauugccuucugguuuugugucccugcugaaaucuaaguaguuuuagugaguuccuuucuuucaggaguuuucucaucuuuuuuuuccaauuaucugcaggcuucaauguagaaacaguggaauauaagaacaucuguuucacagucugggacgugggaggccaggacaagauucggccucuguggcggcacuacuuccagaacacucagguggaguguugggaggggacuuucuaaccccacgggaaaagguguuagggcugggagaacagaauuguuggccuaggcugggcccccaggccaaggaaaaaacccuuccccacuucuaccccuucuguuuggcuauccccuacucacucuucagaacucaccuuagucuuccccagcuuggacuucucuuuagaagcaggauucugggaccaggcugccugauuuagcccucauaacaugucuuuauuuccuugcacaucuuuggauaaacuacuuccucuuugcaguggggucucuaguuugugccaugacuccuguagagcuucuauagaguucuguaaacuucuguagaguuuacuagaugagaaggauugacacaauuacaaaugggaagaaaacagaaagggccacacuacgguaugucccaggcagaagugauugcuucuccuuucuuccuuccuuccugcccagggccucaucuuugugguggacaguaaugaccgggagcggguccaagaaucugcugaugaacuccagaagauggugaguacccagagcccugggaacugagcccucagcuuggggacagagugaucucuguagugguauagaagucagggagcccccaacaggcauugaagaccaggaauauaaguuuuucuuuguggacagacacauuguguaucucacccuguuuuggaugggagugacuuuuucacuuuuucugugcauugucuugucuuuuuuuuuuuuugaaaugggaguuuugcuguuguugcccaggcuggagugcaauggugcaaucucggcucacugcaaccuccgucucccggguucaagcaauucuccugccucagccucccaaguagcugggauuacaggcgcccgcugccaugcccaguuaauuuuuguauuuuuaguagagacgggguuucaccauguuggccaggcuggucuugaacccccaaccucaggugauccacccgucuuggucucccaaagugcugggauuacaggagugagccacugcgcccggccgcauucucaugucuuuacaucugagucugagaaguugugggagagaugggacuuauauguggcaaagagaaacauuuuacauuccugccuuuuccauuuggaaauguugucauuuugccuaggcaaguacucaaauuaggaaaaggucuuucuuuucuggacuuaugggcucaggucaccucaagcucauuuacaacuaugucuugucuucaacggcagacugcacaauacuuuuuuuuuccaaucaagaugcuaggagguagaaagggaauuccccaacacaguagaggagacgcagccugggucccaccuucucuucuccucucucagcugcaggaggacgagcugcgggaugcagugcugcugguauuugccaacaagcaggacaugcccaacgccaugcccgugagcgagcugacugacaagcuggggcuacagcacuuacgcagccgcacgguagggguccugcccaccuggugcugaauccugccucuugagggaagcugcaggcugggacagagauauaaaggcauuccuuuuguuccugguugcugaccucuuucuuuccuuuuccccacagugguauguccaggccaccugugccacccaaggcacaggucuguacgauggucuggacuggcugucccacgagcugucaaagcgcuaaccagccaggggcaggccccugaugcccggaagcuccugcgugcauccccgggaugaccagacucccggacuccucaggcagugcccuuuccucccacuuuuccucccccauagccacaggccucugcuccugcuccugccugcauguucucucuguuguuggagccuggagccuugcucucugggcacagagggguccacucuccugccugcugggaccuauggaaggggcuuccuggccaaggcccccucuuccagaggaggagcagggaucuggguuuccuuuuuuuuuucuguuuuggguguacucuaggggccagguugggagggggaaggugagggcuucggguggugcuauaauguggcacuggaucuugaguaauaaauuugcugugguuuguacacgguguugucuguagccugcaaaggagaggcuagguuacuggguaccaagagacaacgugggagaggaucaaagcagcuaaggcugcagggcaaccccacccacacauacccucagcucagcuucucccuccuuauucuugggcuggaaauacuguaggguuuacaguggugcaaaucucauuccuucccagcuccaaggagccuuugcugaagauuacaggaucucccuucauaguuccaugaaccacguaauuguuucccaucauucucguagcuacuuagagccguucuuaauguuugccuuacacauuaaaauuagagggggagagaaugugcguuaauaauacgaauccugagguacauuucagaaaaugugauucaucaggacuagucugaugcccaacaauaugcaucuuuaaaauuacccagaggaggccgggcgcaguggcucacgcuuguaaucccagcacucugggaggcugaggcaggcggaucacgaggucagaagaucgagaccacggugaaaccccaucucuacuagaaaaaaaaaaauacaaaaaauuauccaggcgugguggcaggcaccuguagccccagcuacucaggaggcugaggcaggagaauggugugaaccugggaggcggagcuugcagugagcugagaucgugccacugcacuccagccugggugacagggugagacuccgucucaaaauaaauaaauaaauuaaauaaauaaauaaaauuacccagggaauucugccacuaauagucuauuacccuuauuuuauaaaacaucgguggggucuggggcuuguaguuccuugcugcacaccacugagacucuugcuacuugggaagaccccuccuauggggaauaggaaagcagguauaaggaaccacggguggcugggcacuguggcucaugccuguaauccuagcacuuugggaggcugagguaggaggauugcuugagcccagaaguuaaagaccagccugggcaacauggcaagaccccaucucuacaaaaaacaaaaauaaaaaauuaccugggcauggagauggacaccuguggucccagcaccucaggaggcugaggcgggaggaucgcuugagcuugggagaucaaggcugcagucaacugagaugcacuccaaccuggcuagcagagcaagacccugacucagaaaaaggaaccagggguguggcuuauuccccaagugugaucgacugcccauuuucccuuggauccuagccaggcuuaggcagaacucaucaucacuuguuuuugccuuuguuuuucuuucaugucacuuuuccagguucugagcuggguuuucuccucaagcuuugcaggaagugaguccaagagacuauaacucagagauucuuuggaggggaaagauacccuugcaggagcucuaucugcccagccagauguccuacccacuggcagagcagcugggguugaggaggggugcuuggugcucucuccaccuaggcccuucuccuuacccagguccugagccagccuuccugaugaauaugaguaauuugaugucaacugauuaacuaggguuuccucauacucccugcaaaauagcaucuggaacauuuugaccucauccuccuaagggccauaaaagcugauagauuuuucuugguuaucuugaacuuaacaaaauacuugaguugcaagggagccaggcagaacucacuuccuugggagaaaggagguugcuuucuauccuguuaccagaaugagaaacggagguaaagaaaggaaaaaacuugccuaaauucacagguugaaguuccggauccuggucucagcucagccuacuuuggugcccaaaggggaauaggaaggcaaacaccggaggcucugcacccgccuccucuaggccauggauuaaugcugcugcgccagggcccuuuccccacuguggugugauaagaggcugcccucacagucacaaugcucccgggucacagaggugcugggccccaggccagccucugccugggaaguucucucugggaacaucugguggguacuacaggcccuauuccaggcccuauggccuguggaaccucaccacgggggggagggcugggccagacggagacaucaccuguggugucagccccauggaugagacagaguggauacacagacaucccaaggcugaggaccuaaggguugggcucaucagcugggcaggaaccuaccucaccuuugaggcaugcaagaauacagucacugcaacugcgaagaguuugggcaggagacaggugacaaagcaaacccaugcuggcaccaguuuucugaguggccaagcugugugugugugugugcgcgcgcgcgugugugugcgugaguguauguguguguguguguguauguacuugccuguauaugaaaguauacuggaaccgguuuucugaguggccaagcuguguguguguguguguguguguguguguguguguguacuugccuguauaugaaaguauacuggaaccaguuuucugaguggccaagcugugugugugugugugugugugugugugugugcgcacuugccuguauaugaaagcaggguguacucucaaccuaaucacuuuccuagguucugccagugccaggccugagacuuuucuacucuaggcuuuuguucacagacccuauugccccaucucccaccucucaauuuauuccgcaaggugaagccucagccuugcccuu

SEQ ID NO: 14555 - RNA, 3320 nt, Homo sapiens
cgcgcggaggcggcggcggagccuccuccugcugcugcugcgccccauccccccgcggccggccaguuccagcccgcaccccgcgucggugcccgcgccccuccccgggccccgccaugggccucaccguguccgcgcucuuuucgcggaucuucgggaagaagcagaugcggauucucaugggugaggcagaucgagcgcgcggcccggaccggggcgccggccccggcgcagcccuuccgcccccgcgucccuccagccccgcucaccugggucucuggccccgagucacccaccucauaacgccccggggccucugcucucgggcgggucccggucugcaucgccgaccccggggccugacacccggagcugcgggccuggguggggugaagcucccuccgccccagcccggcugguaagaagggaggauuccgcccuuggagacgacuuuuaaaacgagcgcggccuaccucccgugccccuugccucccaguccucucccgcuccgcgcccucuuuggaguuggcucacgccacccgacugcccuccaggccucaaagguagauaacgacgcgcaccuggaggcgcucccgcucuccgccccagucaccaucagcuguuguggccucucccuuucccuggucucuagggggcucccucgcucccaucuccaucccugugccccuuuccguugcaguuggcuuggaugcggcuggcaagaccacaauccuguacaaacugaaguugggggagauugucaccaccaucccaaccauaggugagcccggggacgaagcagggagcgggagcgccgcggcgggcccucgcggggucugcucccaguucugccacuuuucuggagcugacccugacaccagauacagcuauuugagaagugggucaggguaucucuacguggauaccggaggcaggguggaugugaccuagccccgcccuguugaccgccaguucugggguucuguuccccugggccuugaucauugccuucugguuuugugucccugcugaaaucuaaguaguuuuagugaguuccuuucuuucaggaguuuucucaucuuuuuuuuccaauuaucugcaggcuucaauguagaaacaguggaauauaagaacaucuguuucacagucugggacgugggaggccaggacaagauucggccucuguggcggcacuacuuccagaacacucagguggaguguugggaggggacuuucuaaccccacgggaaaagguguuagggcugggagaacagaauuguuggccuaggcugggcccccaggccaaggaaaaaacccuuccccacuucuaccccuucuguuuggcuauccccuacucacucuucagaacucaccuuagucuuccccagcuuggacuucucuuuagaagcaggauucugggaccaggcugccugauuuagcccucauaacaugucuuuauuuccuugcacaucuuuggauaaacuacuuccucuuugcaguggggucucuaguuugugccaugacuccuguagagcuucuauagaguucuguaaacuucuguagaguuuacuagaugagaaggauugacacaauuacaaaugggaagaaaacagaaagggccacacuacgguaugucccaggcagaagugauugcuucuccuuucuuccuuccuuccugcccagggccucaucuuugugguggacaguaaugaccgggagcggguccaagaaucugcugaugaacuccagaagauggugaguacccagagcccugggaacugagcccucagcuuggggacagagugaucucuguagugguauagaagucagggagcccccaacaggcauugaagaccaggaauauaaguuuuucuuuguggacagacacauuguguaucucacccuguuuuggaugggagugacuuuuucacuuuuucugugcauugucuugucuuuuuuuuuuuuugaaaugggaguuuugcuguuguugcccaggcuggagugcaauggugcaaucucggcucacugcaaccuccgucucccggguucaagcaauucuccugccucagccucccaaguagcugggauuacaggcgcccgcugccaugcccaguuaauuuuuguauuuuuaguagagacgggguuucaccauguuggccaggcuggucuugaacccccaaccucaggugauccacccgucuuggucucccaaagugcugggauuacaggagugagccacugcgcccggccgcauucucaugucuuuacaucugagucugagaaguugugggagagaugggacuuauauguggcaaagagaaacauuuuacauuccugccuuuuccauuuggaaauguugucauuuugccuaggcaaguacucaaauuaggaaaaggucuuucuuuucuggacuuaugggcucaggucaccucaagcucauuuacaacuaugucuugucuucaacggcagacugcacaauacuuuuuuuuuccaaucaagaugcuaggagguagaaagggaauuccccaacacaguagaggagacgcagccugggucccaccuucucuucuccucucucagcugcaggaggacgagcugcgggaugcagugcugcugguauuugccaacaagcaggacaugcccaacgccaugcccgugagcgagcugacugacaagcuggggcuacagcacuuacgcagccgcacgguagggguccugcccaccuggugcugaauccugccucuugagggaagcugcaggcugggacagagauauaaaggcauuccuuuuguuccugguugcugaccucuuucuuuccuuuuccccacagugguauguccaggccaccugugccacccaaggcacaggucuguacgauggucuggacuggcugucccacgagcugucaaagcgcuaaccagccaggggcaggccccugaugcccggaagcuccugcgugcauccccgggaugaccagacucccggacuccucaggcagugcccuuuccucccacuuuuccucccccauagccacaggccucugcuccugcuccugccugcauguucucucuguuguuggagccuggagccuugcucucugggcacagagggguccacucuccugccugcugggaccuauggaaggggcuuccuggccaaggcccccucuuccagaggaggagcagggaucuggguuuccuuuuuuuuuucuguuuuggguguacucuaggggccagguugggagggggaaggugagggcuucggguggugcuauaauguggcacuggaucuugaguaauaaauuugcugugguuuguaca

SEQ ID NO: 14556 - RNA, 479800 nt, Homo sapiens
uauuuugcaacuacaaaggaaaagccaaggaaauugcugagaugccugcacugagaugguugaacuuuuaaacaaauaccuccagcuucuugaucuguaagagaaaaauguauaguagugcucacuguaauccgcaguuuugcuuucugcaguuucaguuacccacagucaauugugguucaaaaacauugagauauuuucagagaguaagagagaaucauucauauaacauuuauuauaguauauuguauaauuguucuguuuucuuauuaguuauuauuguuaaucucuuacugugccuaauuuauaaauuaaacauacauaguuauguauauaugcauagaaaaaaacaauauauaucugcaauuacugcaguacuaucugcaguuucaggcaucugcugggggucuuggaacauauaccuuucagauaaggggggacuucuguauguuuaugccaugguuaaucuaguuugcuguuacuugcugaaacuuuaacucugaguuugcugacuuuaggaccgacuucaggauucuggggagagaaaggaaucuucauaauaucuugaucaucucaguuuacagagucucagaacaacaugcuaccuuauaauaaaagugguacaauugcauaaaguuuuuuuaugccuuuuuucuuagaaauuuguguagcaagcaagguugggagugauagaacgugacaguggccaaagccaacagcugcagcaggagcgaauuaauauacaauuaucuaagacuacugagaacccagaggcauugauuaaugacauuugggagaauagaaugaaguuuggccuugccauuaaaugacaacaggacaggguacaaaguugauccacuaacuaaaaguuuuguaauuguuacccaaucauagacuuauauaaaugaggauuacacuuuuguaaguccuuuacauugaguuauuauauagauagggcaaauugggaagagcgcauuauuauccuuauguucaaauaauuuuuuucuacuaugagguuugagaaauaaugucuaagccuaaagcauaggauuuuuuuucuuuuuucuuaacaguaugugugcauuccacuuuuaauguuacaaacuaaacuuuuuuguuguuucuuaaaacuuuuuuuaaaugauggguuaugcuauuacucauuuuaaccaaguuugggcuacacaaagcauacagaaauauuuuuuaaaccuacauagaagauuaugguaacagauaugacagcaauauucaaauuuaaucaccuaaucugaugcuaugcaauagucacuagccauauguguuacauugauuaaaaucaaauaacauuaaaaaucuacuuccucaguugcacuagccacauuucaagggcucauuagcugguggcuacuguguuggacagagcacauauauggcauuuucgucauugcagaaaguucuuuuagauagcacugguuuagacaaguuggguuugugaggcuuuucuuuuaaaaaaauauacaguguaucuugacuccauccuuauuaguuguugaccuagaguuggcuggucaccuuuucuaagcaguaaaguccuccuuuguggaaagagauuauaucuacuucauaggguuguucuuaaaagaaaaaaaaaaggaggagggugaaaggagaagcugaaaaguaggucagggccacguggugagggugcuaugcuauguggggugggggaggcacugcaauuuuaaggaaggaguugaugugauuguaaauugucucgcucugucauccaggcuggagugcaguggcacaaucuuggcucacugcaaccucugccucccggguacaagcgauucuccugccucagccucccuaguagcugggauuacaggcgcaugccaccaugccugacuaauuuuugaauuuuuaguagagacgggguuuugccauguuggcuaggcuggucuugaacugaccuuaggugaucugccugcuuuggccucccaaaguacugggauuacaggugugagccuccgugcccggcugaaaauugcauuuuagaaagaacaucagguuggcaguauggggaauggguugaagcuggaggugggcugggaagaauggaggcagaaaguuauuccacgguguugaguuuucuccuguuuucccaaaggaaacuuacuggagaguugaaaacucuuucuuugcucagcuucugaauucuacagguacaggcccaggaugagaggaacaugcuuggauaucuuggaagcaggcuagucaaauagcucagagaagacuauuuaugguagaaaguucuagguucaaaucuugacuccauccuuauuagcuguugaccuagauuugguucaucaccuuuucuaagcacuaauguccuccuuuguggaaagagauugacuauaucuacuucauaggauugucuuaaggguuaaauuauguaauguagguaaaagcauguagcacagagucuguuuagugcauauguuuagugcucaauauauucaggccauuauuacugagaggaacauauuuccuaaauuuauuuucaaggaaguucaagaaauaggaugcuuuguuuguuucagugaaucuugugcaucuucagacuacauucuguguuuguucuccauugcacacaaaaaaagucuucuuuaaggauuucaaagucccuuuccuuccuguaaaggcacaggggaaagaucaugagcuuuagagccauaagagcuagugucaaaucccuucucuacuagcaugcauuaaaaaauuaacgcauaggucuaggcaauguucuaagucuuuaacauuuacugauucauaugauccugcaaaccaaagcaauccuaugagguagguccuauuaucauuuuuauucuacagacaagaaaccuaaggcacagagauacuacacaaccuggucaagguauacaguguugggaugugaaccaugcagucugguuccagggccuguguguuugagugugcugcuguagauccaacagauuuccaagacugacuaaggaaugggaaagaaggaagggggaggaaucacagauaacacaaaggcuuuaggcuugcaacuggguagcuuuagguaccauuguaugggcugagaaacauacuaaggcagagcagguuugggaggaaagagaauuaguuccuugugacacauguugaauuugaauucuucaggugauagccaugagcagauuuuuuuguuuguuuguuucugagauggaguuucgcucuucuugcccaggcuagagugcgauggugugaucucggcucacugcaaccuccgccuccuggguucaagggauucuccugccucagccaaguagcugggauuacaggcaugcgccaccacacccggggcuaauuuuguauuuuuaguagagacggcguuucuccauguuggucaggcuggucucgaacuccugaccuccugaucccccugcuuuggccucccaaagugcugggauuacaggugugagucacugcgcccagcccagccaugagcagaucuuuagaguaucgcuggacagaugggucuggagcuuaaaagagauuuuaacaggaguuguauauauuugggagucauugguaugcagucauggaaguagauacgaugucuuaagaauguuuagaauuagaaaagaagaugccuuccggagaacccugaggaacaucaauacuaaggggcaggcaaaggagucaucacaauggagaugagaaggagcagcuaggagaugggagggauacacagguauaguaucucaguagaaaggcauuucaaagggcaaacagugucaaaugcuauggagaucucagcaaauggaggucugaaaaguguccacugaauguaguaacaaggaggucaucagugaccuuggagagaacuguuuugguaaauugguaagggcaauagucagaaugcggagggcugaggauugaauauggugugacgaugugaaggcaacaaagagaauuuuagcaagaagauuugccugugaagggaggagagauaucuggagauggauguggaaugaaggaaaaauuuauuuaauuaauugaauuuuacaaagcaagaaauuugagaauacuuaagugcuaaugaggcuggucugaagguaguguuauaucaacugauuguucgcugccaguuauagauugaacuccuuguucuacucuuuuuuaagauuaaaaaaaauuuuuuaaugcuaaugaggagaaccuaggauaaacugagaagcuguaaaaaccggagagggaaugauuggaaauguggagggggcagaucaagaacuaagacgaagaguuuagccugaagaguaggagggagauuuucuuuguaaugugagacaagguagcaaauguaagaagccauguuuccucauuucugcuucucagcagaauuucacaaagccccugacugugacaaugacacaccgcuacccugaaagaugcucugaagaaaaaacaggauaaagcacacggcccccagugucucuugccugagucaauguaguccauaaaagauaaaugaccuuaguccuugccuuucccugcacauaagauaacaucugacagaguuagugguucugcuucuaacauguauaaccaaauguacuuuagagaucuauaaccagauguacucuuaacacccaagcuuugaugugauuuugcauguacugaaccuccaccuccuauauauaagcaaugggcugaaacacugugcaggagcagucugacaaccgcuccugggcuauauguaguccuugggccucaguaagacuucuggauaaaacuaacuuuaauucuuuaaaagcuugauuuuuuuuucuuuaguugacaguaacaagggauaagagaggaaugagaaggaagauaagauuuuagauucaguggugggaaauugaaggaguucuugaugauuuuuucucccaaguaggaggccuuaucacuuucagagugugggaaacaguggagucaguuaaaacaaacucaauagaguucaaggcugaacugacugaauaaagagaagaaauuccaggcaccgugugagggcccauuaauuaauucacuguggcaccaaccugcagaauugaguguuuucuccagguaagugguagguuugaagaaaguagagagcuauagagggccuagaguugagguuuugacaggugggcccagugaaagacaaugggaauuacagaugaagauauugguaggaaaggggcuaaaaugauggacagugcauggagucuagccaaggauccaggagaaggcagaggggagcugguaaagcaaggguagugaguucagggacuuuaaauucuaguuaacgcuuguccucuguugucucucacuugcucugauggaaaccagcuguuauguugugaguugcccuauggagagacccauguagaaggaaacugaaccacugaaaaacugaggcucuuaguccaacaucuugaggaacugaauucugucagcaacuaugagugagcuugggaagcaaucuaccuucagucagaggaggaccuucagaugagaccacaguccccuucccaacuccccuugacaccuugacugcagcuuuauaagagaagaccuggaggaaaaggcaggcacccaccccagauuccuuacccacaaaaacugugagauaaaugcuuauuguuuucuuuaguauuuaaguuuuggggcaaauuguuauguaacuaauacaagauauaagauaauuaacugaaugagaagggagagaggacagcaguuaugaucaaagacaaaguguuugaguuuacaaucguaccuaugaaguuaugguguuuuaucugucuggagaacguccuaaauuggugcagaggucaaguuuacugaagaugagaucaaggagcaaagaggucaggguaugggauaagucaugcucguagauauugaaguauuucaggauuauuggcugaagaccgugcaccaaguguuaacaauuucaaugaaugacacgguagaaauagggguacgguagauaaaaagccacgagauagagagggguauaaucugauggaaccaacuuccacagagguuuuuuuuuuuuuuuuuuuuuuuuuuggaaaaggguggcaaauuagggaucuaagaaggugaccucaaaacuuaacccugggauauguuuagugugggagaauaaacuuacaaucuuuuaagagagcaaggggccaugcacugugguuaaugcauguaauaccagcacuuuaggaggccgagguaggaguauagcuugagcccaggagaccagccugggcaacauagugaaaucucagcucuacaaaaaaaaaauuagcugggcgugguagcgcggacccgugguaccagcuccagcuacaccggagacugaggcaggaggaucgcuugagccugggagugucaaggcugcagugagccgugaucgugcccccgcacuccagccugagcgacagagcgagacuuugucucaaaaaagccacaaaaccaaagaaacaaaaagaacugcaagggaaguacugucuucaguguagagccaaguuuuacgauuaaaugacauaacacaugcaagguccuugguuccacauagugggcacucaacgaauauuaguucucgcuaaacagucacuuaaauauuuguaggccuuggcuuucccguuccuuccccgaccuuuuuacuggggcuagggaagguauccgguggcuggaggcgcuucacacugggucgggugagagcgugaagcgagccuuuucccuaacgucacgggagcagcugggaagagaccgaagaacgagggucacucuccccuguauacguggcauguccuuccucugagacauuuauuccucccaccaacaaacauuaauggaacgccucacaagugcuagaccccagcgacacaaacaagggcgaggcacacucucugacuacaaaaagggcgcgcggccgcguggcaggucaaagcccacaucgguaggagguuccacaaagcucugauuuuccaaguucucuccauacuuuuagccaagguaaaaugucggaagucgaguggagcggguacggagauuccuccaggacucugccugcguggcuccacccucccaggccgcauucccggguacagcggcgcccaccuagguggguauacaagugugcgccccugaggccagcggggaaggacgucaugggcgaggucaggcgggagggcgcggcuggcuccgccccuggggcucccauggccccccgcgccccgcggccagaugcugacguguccuuuccuucccacuacaccucccgacauuaccuacuccggcugccccggaagucccgccccauauuuagcccauccuugcaaaucaacucuuucagcgcuuccuggaacucaccaccguuuuggggaccaagaggcggggcuccgcgagcagggugccuauuggccugagggccggcgggcucugggcgcuaauugggcggagggcgguggcgcucuggcacgcuugcgcggcgaguagaacguguggcggcggcggagaucgcgucucuuucgcuccgugucccgcugcugcuccugugagcgcccggcgaguccgucccguccaccguccgcagcugguagccagccugccccucgccucgacucccuuucaccaacaccgacacccacauugacaccuccaguccggccagccgcuccacucguugccuuugcaucuccacacauggcguccuccgcgcagagcggcggcuccuccgggggacccgcgguccccaccgugcagcggggcaucaucaagauggugagaacgggccccggacaccgaccccucugccugccuucgggcgggagucaggcauugacuccaccuuccgccagccugcuccaugucccagauccccuuuccucugcccccuuccucacuuuucgucgauucuccgaauccucucacuagacggaagcagacacggaguccccuuguuccuugccucccggacaccuugacaucaggggucacagugauuuccgagguugcggcauucggaucuccugucuguuuaccaggacagaucgauuacugauugauuaacagagacaauucguugauaucuguccucccaucccccgucuuucuguucauuuugacauaugcugaguaguuaguaguuuuucgagauccugacaucggcucuucucuacuaguacuuggccaucaugaaacuuuucuguucccacaaacgcuguuacuugacucccaaguuuucucacucuguggcccucuuuuccucucuuucccuccaccucuugugucgaccugaaagcuccugaucuuuguguacuuuugacuucuaaaagguuaggccggcaagaaucuuaguaaucaucauuguucucccgucccuuaaagauaaggagauaggcuugaagaaggcaagugacuugcuuaaggucacauggugguuuggguuggagccauagcaagagcccaaguguucggauuccuggucuagugcucauagcacuauagauucugccugauuuuauauacccucaacuuuuugaaaauucuucaauuuugaauuugaaccugcaaaguuuauuuuuacaauuuacuccuagcuccaugauaauuugauaauauaaauucaguuuaucacuugcccccaguuguccuccccaaaacccuuccaaaucuuggaaccugacauuucuugguuuuaccaauuuucugguuuaugaugacuguaaacuucuagaugucguuucauacugcaguucugacauuuguaucugcaacagcaaauaucuuuugugauacuuucucccaaggcuccacaaguuuugcuguuguagaaaguuuugaaaaauucuauuuuaggccuggugcgguggcucauggugguaaucccagcacuuaggaggccgaggugggaggauugcuugaggccaggaguuggagaucagccugggcaacauagcaagacccaguuuaaaaaaaauucuauuuuauuacccuguuaucuuucacaagauuaaaauguucugcagcuuauguguguguaaagcugauuuuaagauccccucgcccaauucccaugugcucauuucuuaagguaauagucugccaccagccaagauucuugggauuuucaguacugccuuuuccuuuuguuuauguguaauggagggucagaacugaucugaaacugaaugagaagagaauuuccaagauccgcauauauuuuuccucugaaauacugaccugacccaugaaaggauuauccuaaaguggcucuucuuucguuagcuuuuucauuugcacugaucuucucuucaccauaggaacaaaaacaucucuuggcucuccgguguuggguuuggcaguaagaaagaguggaucuuucugagauuucuccuugcugagguuuaaauuguucuuaaaggucucucucauuuguggaaugggaauagaaugaggcugaacauaguuuuguuuccgccaaugcuggaggcuuuuagggcaucuggauucugugcggugacugcccacaaauuacccccauggauacugaauaucaccaauuacuuguuuauugucaugucuugugcugacuauucugcucauauugucucauuuguaauaccuaacaaguagauaacgauuaucagccacauuuuauagauguguaauuugagguuuagaaagaauaguuaacccaaggacagguaccuuauauugguaauaagaggcagagcugagacuugaacccaggccugucugccacggcacaugcucuucaauaucaugcaugaugucucugacuucaugacuccaggguauuaauuuauaacauggaggguggggccagugaugcauaaccacaaauugcaggaaagugaagcugucuauaauugagaaaagauuagauguuacuccuugucuugucugggagcugcuauuaugguaaaugacuucauuuggugcuuauggucuucacauaggaguaugguguggaagaugauugagucuggguaguggcauauacaauucagugauuugagccaucuguacugaguauagauugcacugccuucucugaccacacuacagggguugggugaguuacaggcagggauuaggggaggaaagcugagugaacugcagagugacaggcagauuugugccagguuuagaagccuugucuggaaugaaaaauugaccacuggcaaauugcugugugugaagcucuucugcuaagcaaaguuguauuuuccuguagaguaauaguuuccauugguacuaggaacugcuuugcaagaacucuacaaaggaagauggagcucugugacagaugaaagugagaaagaaauaguuugaugaauaggaaaacaggagacacuacuuuucugccuuuugggagagagguagaaauuggaacacugaccuacgcuuuucauuguuaacucuuuggauuuaucuggacucaggcugagcugaaggucugaaaucgucuaggguugaaguuugcugcuguaaagaggaauaguccuuccucuuuuuuggcaaaagaaaguguugcagggccgugaaagacacaaguuucuucuggucucugcuuugcuauccuguuaaguccuacauuauuuuguuuaagguugaagaacuugggaauccaguuguaaaacacuuugaccaauuuuuaaaaaacgagggugauguugacaccugugucugcuauugagaguuggggugaagggacagaguugguucuggaauauuuaaggaggaaguggacaguaaguugauacagauauuuuggaguuguucuguuacagaaaaaaucagcaaggaugauggaaaaacuuaagauggauuuguauuuucugaguugggaugagacuagcaaguauguggguggacaaaauauaacccagauaaauacaugucuucuaucaaaucagauuuuauuuucucgaaacccugaaggauuuaaaaucuggguuucuuugaauaauuugcuugauacucuuuaacugcaacagaauauugucagcagaugcuaaguagaugagguugggagaaguguuggguacuuaguauaaauugagucaccccccuuagcuuugagauggcuauuuucucugguuuuacugaccugguuuacucucuguuuuuuuucucuuuggguauguuuacaugucuugucaagcauucgcaacagcagaaugaaucuugaauucuugaaucuucugugcuuaucagaagcagccauggaggcagcauaucuuauccuacuuaugguguggaaggcugaagggaggacggacagugccaaaucccaguucccauuucaccuuacccuccccucacccacuuaauugccucagaaggggaaaggaaugccucugccagucuuuuguuuuauucuaagaaccaugauucucacugggugaccaaagcaaagggacacaagggaggaaagggccauaauuuucuccuucaaugggacuugugcugucagguuguuguaaagcaagauguagacuucuugcuggguagcuuaguggugauuccuucaguguacagccuuuaggaaaucccaccuauaauucaguucauuauagcuaaauguuucuuagguuucuuucuuuuucuuuuucuuuucuuucuuucuuuuuuuuuuuuuuuuaagauggagucucgcuuugucgcccaggcuggagugcaguggcgcuaucuuggcucacugcaaccuccaccucuuggguucaagcgauucuccugccucagccucccgaguagcugggauuacaggcgcgugucagcaugcccagcuaacuuuugugcuuuuaguagagucauaguuucaccauguuggcuggucuugaacuggccucaagcugucugcccaccucggccucccaaagugcugggauuacagguguaaucuuagguuucugaacuaagaagugugugucuuugaaaaguucaguggggacagagaaguuuguugaccugcucguucuuacguguacuucgcucaugcaggaauguugcgggaagucagggaccccgaacagagggacuggcuauguugaaguauuggggguggguucccccaauacaggaaaaaacaaacaaacaaaacccaccuuuccuaagcuacuuaaaauacccuucuacuauuccaagggauaagguagcugaauaacaauauuuuagaagggccauuuaugaagaaguagauaggcuaggauggaaggcuuuucccaguggucuuaaaaugcccauuucccggcagguaagccugguagcuuuuaaucaagauuguaaguaaaggaacacuaaguuuuuacuguaucuuaaagguuuucugucauuuuucugucaaaaggaagcauccaucuggcucuaguuauguuagcaguguaauaacuaaugaaauagaaucauaagcaaucauacuuccuuucuuucuugaacaaauauuuauugaucaucugcuaucugucaagcucugggcauuggagaaacagaauuuaaaaaguagaucaaauuucuauccuuauggcuuauggaggagucagacaauaaagaaguuaacaagaaauaagcaugaucauacaagauagugauaccagguaagggacugggacagagugguuuguaguaagggagaggguggguccuuuggauacuguguuuaggaaagacuucucagaagauggcauuugugcugagaucugauggacaucaaaaacuaaccauaaaggaagggcguuccuggccgaggaaacagcaaaugcaaagccccugggguuuccaccauugaugauuuauuuuuuauuuuuuauuuuuuucagucaggauuucacuuaguugccaggcuggaaugcaguggcacaaucauggcucauugcagccuugaacuccugggcucaagggauccuccugccucagccuccuccugaguagcuaggacuacaggugcgugcuaccacaccuggcuaaucuuuuauucuuuuuuguagaaauggggucuugcuauguugcccaggcuggucucgaacuccuggacucaagugaccuucuccacucuggccucccaaagugcuggguuuauaggcaugagccacugcacuuggccuaugauuuauucuuuagaguuuuuauaguagcucuucaguuccuucacguucaguaucccauguaaauaguuuggguuuaaccugaguuauuauguaauauauguguuuaagggugauaaaaggaagagaggcaguggagaugguaauuuuucugguacccuggugagaucaacagcugacauuaaguacacugaauaaauauuaagaauuggaggcugggcacaguggcucaugccuguaaucccagcacuguaaucccaucccuguaaucccaggccgaagcagguggaucaccugaggucaggaguucaagacuagcccaaccaacauggcgaaacccuaucucuacuaaaaauacaaaaaaaauuagccaggcaugguggcgcgcgccuguagucccagguauuccggaggcugaggcaggagaaucacuuguaccugggagguggagguugcagugaacugagaucgagccauugcccuccagccugggugacagagugagacugugucucaaaagaaaaaagaaugagagacugauaagaaaaaauacuuagucauaugcuuguuucuaauaggauuaagacuaagauuuucugacuaucagcuaguccuguguauucccaaagucacuauuuuucuucuaauggagggaaaaacauggauuaaaaaagaaaaugccaaaaguaggcuuuauaagagcuaaauagcaucuagaacuugccauuguugauauuucucuuagcauuuuguuacuacauggaauuuacugcugcucuggccucuggcaguacuuuuuugccuagcaagcuuuagugaacuguguuagugaaaagcaaaguagcaugcuucaggggaucaaaacuaauuaucagguaagaacucgcuuacgcauccuguggcucauuaacaugagugggaacuucugaggccagugacuagugcuggcaauagugggcaaaugauuuggugaagucuaugccccaguuuauuuggaggaugaaauuuggggagcaagugaaaauugugauuucuguuuguagguuuagcagagaaaauuggccagguuuuugaauucagguaacaagguaucuaaggccuguuguccacucacuucucagcauaggcuagcuauccaucugacaggugugguucuaacaggggcauaguagauauccuuuagagucugaucuuuggauuuauuucauuucuccaagaagagcauaguuacauacuguaggaaauuuugugcauuaucagggaaaacaaaugcaaugaaggaacucaacucuuacugggcuuaucuggcuuuuccucauauuucuugcugggagaugaauacacaacccgguuucuguugcuacuuccucucuugggagacugacauaugcuuuuugcuuuuacagcagaaauuuauguggaaucacagguugugaacauucgauauagauggaauguuacgggauuucacuuacuuucauuagacucaauauaauacauuaaugaucuuuuucuucacucuaauguuuaagaaaaaaaugaacagugguuucaguuggcauuuuuuaaaaauuaggaaguuaagcaacuuaugggaaaaauaaaacuaaaauuuugaugucauuuucagaugccauuuuugaaauguguaaucuaugauauaaacugguuuggcacauuuucuucacuuaugugcuuaucaugugugacuuaagguaccaucuccucucuauuccucaacaaauuuugaggcucuuuggguucuuaguucuguuuauguggcaaguagucugcuugggauggucuuguagcaccaaccucauguauaucaagaggaauaaaggagauuuaaagaaucugugcuuaaaguuaguaaucuaauuuauuaacuuugucccuggaaagcagcauggcagagagaagagaucauuggcccagaagucaggggacacaaguucuggccugggugcugccauuuggguaauguuggguaagauauuccaccucaaacucuccuuuucucuaacaugagguugcuggaugcauugucucuaagcauuuuccagucccauaaggcuguaauuuuauaagaaacccuguguuacauuucauuuaggcaugcugaaacaaaguugagaaaucucauaccuuaacggcuugacuuugaauugccguuuaucuugcauaaagcagguuuucuguuccuauucuuuuuuuuuuuuuuuucuaaucuuuaguuugagaaagaagauuaguggaaauaugguuuuccaguguggaagaccagagaguuagaaugagacuaaaugauugaauggugggguggagagaggguagauagaaguaaggggaguucuugguuuccuuucaguaguguaucaugauaaacuagugggaguguugcuugagacccagaggaacaugguucuaguggguuuuauucaccuaguccuaucucugcuucagaacacugugacauuuuccuggugcagcagaucuugacuugagaagggaaggagagaggaggcaacuuagggagccucuggcucauagggagagucuauucuugcccugcucuugacugggagacuguggugggagugugggggcuaauaggguccugagcucuguucuucuugcuuggagccaggacuuugguuuuuguuuaguuuuguuuucagaucuuuuucaguucuauuuaaugcacaaguacaaguugaguagcccuuaucugaaacgcuuggacuagaaguguuucaguuuuuggaauauuugcauuauucuuagggcuuagcuucauucaccuggaaaucucauauucaaaauccuccagugagcauuuucuuugagcauuauguuaguguucaaaacauuucagauuuuggauuuuuggauuagggauguucaaccuguauaggaaucauuuuaaucuauuuuuggcaguugcucacacaguuucuuuacuuuugaguuuauuuuuuaugguaagccuucuuaaauccuuucugggaguagauucagagugagagaaaggagcccagugauuuccuaaacaggucaucgcaucaggacaaccuagaagacguuucccaggcauugaauuagaagcucugggacuggccuggaaaggucuauuuucaaaaaaaagccacuccuaggcuauucugaaagaaucaguuugggauugaucuggggcuggcaugugagauccacugaucuuguuuaacuccuguacuguuuguaguugaaggggcgggacauaaaugauaagugaaauguauguaugugggggugggugcaccagaauuuuaugaggggaggauagugguuucuuucucuucgcguuugucuugaugguucccaggacgcuuuguuuuuaauuuguggcucaauauugggcugggguccucaggguccacuuauagugacucagauccuauuccuaggucacaacugacagcugagaaguuguuuuauauuccugauuuaggccauaugcucauuuuaacacucaucugcgacuuuuccuucuguuugcauagauucccaggaucuuccuguaauuuggcaccaauaacuuggcacauuauuucaauggaagucuuuagugucauuuacaaaacuaagauuuuaaauuccucacuuucuguucuugcaauccugaggagcuucaucccuaggccuuuuggaucucuccuguuucuuauucauaggccccauucuuaacaacacuaaaaccccaaaugaucuacucaauggucuuagucuuuauauuccacuagcuugucuaauauggaaguaaaaauaauucucaggucuuacgaaguccuuaugauuaggggucacauuuacaguucccuugauggccuuuuuucauuuuggucaacaguuuuccaguuuauccuggaauuccuucagagcguucagguggaugucauccaguguuaguaauugaauaauugguauuucuauacucaacuugcuguuaaaauuucaagcaguagagagguaugaaguaaaaaagaaaaaucccuagcugggcaugguggcccacgccuguaaucucagcacuuugggaagccgagguggguagaucacuugagguuaggaguuugagaccagccuggccaacauggcaaaaccccaucucuacuaaaaauacaaaaauuagccgggcaugguggugcgugccuguaaucccgguuacucaagaggcugagggaugagaaucucuugaaccugggagguggagguugcagugagccaagaucaugccacugcacugcagccugggcggcagaggaagacacagucucaaaaaaaaaaaaucucucucucucugcccuccuugccccucaguuuucuaccauucauucucauccucccagcaaacgucaacaguguauuugcuuccaaaauguuucaugcagauacacacccucuccuccuuuuuaaaagaaacugaaauagggucaaucucuaugugucuggcaauuuucuuuuuuuaguaaauugucaugacuaucuuucugucguagaucuaccucauucuuuuuuaaugguugagcgguauuccacaguuuggauguauauuaucuauuuuucuguugauauauguuguuuuuagcuuuucauaauucuaagcacuauugcacugauugaacuguauaucuuugugcucugaugcuagcguuuguauaagauagauucuaaaagugcagccacugguaccuuuuuuguaaccuuuuuuguuuuugguggugguuggggugcuuuacuuguaccuuagcuguuuauuucuuacaggugucauguuagauaaaauuuaggguaaaauacugcuuaguagcucauuacucaauaguuuuuuuguuugguaguuuuauuuccccaauaagacuauuccugaaagccacuuugccuuuucuguggagcgcagggcccagcaccugggccuugguaaauaauuacuguugucccuugguauuugguuccaagacuuccccaaccucccaauaucuggagaugcucaagucccuuguauaacaugggauaguauuugcacauaacccgugcacaaccucuuuuaucuuuuuuuuuuuuuuuuuuuugagacagaaucucucugucacccaggcuagaguacaguggcacaaucauggcuuacugcagccucaaccucccaggcucaggugauccucccaccucagcccgcugaguagcugggacuacagguacaugccaccacacccggcuaauaaauuuuuuguggagacggggucucccugucuugccuaggcugguguugaacuccugggcugaaaugauccuccugccucagccuccaaaagugcuggaauuacaggugugagccacugugcccagccuccuguaugcuuuaaaucaugucuagguuacuaauaauaccuaauacaguguaaaugcuauguagauaguugcuauauuuuauuguuuuaaaauuuuuuuauuguugcauuguuauucuuacuguuuuuuucuugaauauuuuugacccaugguugguugaauccacggaugugagggccuacuguacuucuuuuuuuuuuuuugagauggagucucgcucugucgccaggcuggugugcaguggcacaaucucggcucagugaaaccuccaccucucggguucaagugacuccccugccucagccucccaaguagcugggacuacaggugcaugccacuaugccuggcuaauguuuguuuuuuguauuuuaguagagaugggguuucaccguguuggccaggauggucuccaucuccuuaccucgugauccgccuaccucggccucccaaagugcugggauuacaggcgugagccaccacgccuggccuuacuguacuucuuaauugguugccggccccgccaaccccaggugucuuaaggucuuaauacugacagguggaguagauccuuuuuggcuuuguuuuuaaucugcuuucucuggguucuggagaguuccaugacuaaggaaauuuuugacuuccuaaagugcagauagacagguggaggugagaggcaaaaucaugugagagaagucugacuuuuuuccuauuugcuggcucauagcucuuccucuuuuuccuuuuucuucuuggauaagaagguggugugugauauugugauguaaaaagaaauauaucuggucguggucuucuuggcacagagcuccuaaaacucuagucauuucuuuuuugcuuuuuucgagacaaggucucuguugcucaggcuggagugcaguggugcgaccacaacucgcugcagccucagccugccaggcuuaagacauccucuggcuaauuuuuguauuuuuuguagaggcggggucucucugugcuacccaggcuggucuugaacuccugggcucaagugauccuccuaccuugaccucccaaaguguugggauuacaggcgugagccacucugcccagcaaacaagccccucugaaccacacuugaguuaaugagugacucugggaagcuccuaagugugaguggggccugguuacuagagaucgaguucaaucacugauggccagucauuuaauaaaucaugccaauguaagguaaccuccuuaaaugaugggguuuggagagcuuugggguuggggaaaauggggaggugcugagaggguggugugcccagagagggcauggaggcugugcacuccaccccccauauauuaccuuauguaucucuuccaucuggcuguuccugaguuguauacuuuuauauaaaucuaguuacuaguaaguaggcuguuuuccagaguucugugagcuauucuagcaaauuaauaaacccgagaagaggcucaugagaacacacaccugauuuauagcuggucagucauuaaggguggcuugagcuuggcaucuucagugggaggaguauugugggauggcacuuuugacuugugggaucugacacuaauuccaggaagacagugucugaauugaauugaauuguagaacacccaguuggugucugcagagaauuagaggauugcuugguguggaaaaaaacccacacacauuuggugucagaaauguuugugugacuguagaagaaaaacaaaaacaauuuuuuuguccuuuuuagggugguaggugguaguaggaaugacaauaucuggcacggagaacacuuguuuuuuagaguuguuuggggagauaucacuggaccaggggaucugguuugcagccuuucuggauacugggaagugcucauccuaauccugguauugguuuacccaaaguuucccaggcuucacauguuucuguacuccugcagugguuuugacauaccacuuuauugaguuuuggaaaucguuuugacagucaacauuuuuuuuuuuuuuugagacggagucucacucugucgcccaggcugcagugcaguggcacaaucuuggcuuacugcaagcuccgucucccggguucucgccauucuccugccucagccuccugcauagcugggacuacaggcgcccgccaccacgcccggccaauuuuuuuguauuuuuaguagagaugggguuucaccguguuagccaggauagugucaaucuccugaccucgugaucugcccaccuuggccucccgaagugcugggauuacaggcgugagacaccgcgcccggccgacagucaacaauuuuuaaaauuuaaauaauuuuauuucuaaaggcaacuuaaauuucacuauugaaaauggaaagucaauauuaaagaaaaaauuauucaugacacuuguuaaagaugguaaggcagacuuuauucaaggagggcuguggugauagguauagggaccacugcaguggagucuugcauugggaaggagcgauuuagagguauuuguuuccagucucugaaauaacuaaugugauguuauuuucagccuuaggaauucuguuccaggagagcgggaauuacuguuuuauagccuuuaauacaaggacauuaaaaaaaauuuugguaauaacccaaaacagaaucacugugccaagugacauuuaucugcuugccuaucaggacucugccgcagguuuuaaugagaaaaguggugcauucuauuccucccgguguguaagguagagggacacucccgaguaccuggguccugaaaucccgccaugaucuauuauugugugugguaauuacuugcauuauugcucuuggcaggugagcccuuucacagcccagaggccaggaggcugccucuaucacuuaaaagcugaguuaucuuguuaagcuguucucuugugagggcuuuagaaucuccugagaccuccccacaagcucucagcaggacacagguccagcuccuggcuaagccugcccugcccuuguauucggccccugaaccguagcucuagaggaauaacuugccauuauauuacaaguaaggcgauguggggcugcuagcccggacugcuugguuuccauuuaauccuuaagaguucccauauuggugcucuuaaugaaaguucuuaggagaaaauguguuccuuugauuaucaacaggaggagcugaaaggcaauguagagagaagaauaagcucaggacucagauuaucugaggaaaagggccucagaaaauugauuuuuggaagugguugauggcacaaggcuaagcauacaguaaagguggccccugagucugagcugucauaaacuuucauuugaaaucucugcuuuauauguuaaagaguuuaauuauuuguuauucauuggagagagugccccccucaaaaaaaaaaagguguggacaaucacagagcugcgcuuuagugauagcauagggaagguagaauauuaugaguguuuuuaauaaaaauggaugagaagucucuuuuauggacaguacuugcagugccgggaucauaaacaaguuccagaucaugcugauauagcugccuguuaaauaucuugaugugugcagaucuguguuugaugacagagggcgggaagggccugggacacuggcaucgugguggggaaggacugaccaguucucuuguaauugccagcuguguuagaugaucagggacuugaguuuuuauuccuuuaugauaaucucccuaggauuuuaauaaugaggagaauccuaggaugguaccuuaauucagcaauaauggacuuuaaaauguuuaugguagaccugugauuugcacuuuauuuugacaucuaaaauugacuaucaguauuucaaauaggaaaaauuuccuauuugaguuuggaaaauaaguggggaaaagucaugcuucucaugaguaucauagaagcugacuuauuuccucaagcucuauggucagcucuguauauaaaucugaguaaguauauuagacauucuuuagagaugauucacucugaguaauacugaguauuauacuuaacaucacuauuucuauaggucaaguuuagggaaaagugugcaugacuuuacaggaacaaaccugaagaagaguaaaugcagucauuuucauuucucuaagauauuucaagaucucugguuggcuuucauuuaguuguaucugguauacagguccccuaccacguuuuaucauuuuauuaugauuugauauuuuguacaguacauuuuacucaggggcacagugauggcagugcugugaggaggagagaugagaugacagcagccauuguuauuauggcuaguaacgcaguagcugcugucccccaucccuggaucaggaacagcagcugcugugcuucucuccuuucucugggccuuggaacuggggaggaggaaaguuaaaguuaaaggaaguuaaaggaagggguugcuggacuuaacggauuucugguagugcccaaacuaaaucuuuagacuagggcugaguccaucauuguuugguaaacaauauuacagaucaggcgucgaaaaauauuccgaaagcacaguccuuggaauuguuaaucccacucuugacaggcacaagaacacaucuguauuacagacaugcacauacagugcuuagaauaggucuuuaugucaaaaugagagaguguagaauuugguguuuugaguggcugcauuguuuuccauuauguaaaaugcuguugaucaacuacacuuugaaagcacugaagaguuaaguuauaugacugcuagucaacauggcuacagucucaggggaagaaaaaugacucaguuaaaugccaucaucuuucaauagaaacaaaagaaaaaggcagaauugaagagaggcaugugcagaaaucuucugaaggagacuauagaacaguagucaccugagaacuuguuagaaauguagacccucagacccuaccccaaaacuagugaaucagaaucugcauuuuuacaagauccccaggugauugauguuugcacaguaaagucugagaagugcuguccauuaauucccugccucuguuccccacucuaacuuccucauucagaaacauauguucuccagcaaauucugcuuaaacuuugaccuuccucaaagaggacuccccaaacccuagacuagaucagauugcccugccguaugaacaccauacuucucucccauagaacucgugacaguauuacauaagagaauaauuguuuaguaucagucuuccugucuaugcuggauguucuguaagggcaaagaccaugucuguccuauucaccaugguaaauccagagcccagaacaagaccaggaaaaaauaaguauuuuuuuggaauaaaugaauggcacuacugcauaucaaguacagugguggacucaggagaugacaacaacaauugagacaugguccuuguccuuaccacagcucauagcuuagugaauuuuugcucaagugaaugaaagccgaaccccuaagagcauguacugcacucacagcugcuuugccuauuucucugccaaaugacaagagauggcccuaaugucucuggggccuuccacucccucggcaugaucucuaggcaagcaugcccucacuucuuucuccccucauuuggauuccccauuuccauggugcaguccccugucccaccuucucccucugcccucuuuaaugcaacuccaacuugccucugcaucacugcauucuccccucaguaguucauguuaucugugacaacauuugcuccagucagauucccucagcagugccucccccuuuuuuuuuugagacggagucuugcucuguugcccaggcuggagugcaguggcuuaauccuggcucacugcaaccuccgccuuccagguucaagcgauucuucugcgucagccuccugaauagcugggacuacaggcgcucgacaccacgaccagcucauuuuuguauuuuuaguagagacgggguuucaccagguuggccaggcuggucucgaacucuugcucaggugauccguccaccuuggccucccaaagugcugggauuacaggugugagccacugugccuggccagcgguccccuuuuuacaguauaucaaauuucccuuguuacccacuucaguaauguuuuaccuaacucauuucuaaccacucaauugauuauuuccugugagcugucaagccuacucuguucucaaccaaaaccacucaaaucuaugcaauaucccugaccacuuuggagaaucucucaauuaacuguucaauauucaguugucuucccacuuuccucagucacuaccuauauccuccaaagggaugcuugguguccgagcaaauucuaucaucucuucuaugauuauauuguccacgagucuuauauuuguucuugcuuccuaggcaagacucucaguagauuuaccccaaagccuauauccaauaccaugguaacaaaaauacaucugaaugccuacacugagagcaaugacagaguaacaguauuuccuuccuguccccuccauguacugugcuggcuaaaaauauuacccuguuaccuuugcauuuugauccagacagccugcauuuuagagaagaucaaagguguggggacaggaggaggaaguguuaggauuugauaaggaaaaaaggaaauaaaauucagcaccuugcagauuaacauagagaauuucucuuggcauucccaaagcaucuuuucuuuuuuuuucuaguuuagacuggaggacuuaggcauuguuauuuauguauuuauuuaacuaauucuaauuuuuuuuuuuuuuugagacagagucucucacccaggcuggagugcaguggcgugaucucggcuuacugcaaccucugcguccuggguucaagugauucuugugccucacccuccugaguagcugggaucacaggcgugugccacugcaucuggcuaauuuuuguauuugugguagagacaguuucaccauguuggccaggcuggucucgaacuccugaucucagauuaucugccugccucagccucccaaagugcugggauuacaggcgugagccaccacgccuggccuaauuuuaauuuuuuuuuuuaagaugccuguguugcccagccugaucuugaacuccuuggcucaagccauccuccuaccucagccuccagaguagcugggauuacagaugugagccacugcuccugguucucaggcauuguuuuugauaauacgauucuuuuuugaaaauaaagacagccaacucucaagagugaacgguuugcggccagauuggaaaacuucacuuaaaccaaaaacagauuuaauggucuugccucuuauagaaaguucucaguuacuuuaacucugaacuuccaugacuuguuucucaaaucuuuugagacacuaagagguuucuagcuugucugaauauaaaaccuaauuagaucacauuuauuuauuuauuuauuuuuauuuuuaauuuuucuguaguaaugggucucacuuuguugaccuagcuggucuugaaauccuggccccgagagaucuugccuuggccucccaaagugcugggauuauaggcgugagccauugcacucagccauagaucacguuuauaugcaauuaaaaaaaaaaaaaaccaugagauaauuggcauaggaaggaaaagggauaucuuuaaaacccaagaucuuuuuuggagcaguagucuuuuugaacagcacacucagaaaguuugaauucugugauuugaaagcgucuaccauuuuauuucauuuggaaaagauaaugaaacagugcauggaucacacagaaagauguaugguccaugcaacauaauaauaguuugauauucaaauucuuagaaguugcaugugcauggagagagggaggacugggcuagggagagacaaaguuucagaaccaccaacgagaccuaguuccagugauuugucuaucacugaugcucuacaacagccuuuaguauguuuagcaucuugaaagguguuuuaaaaaacuucuuauugugaaauaauuucaaacuuugagaaaaguuagaauaauagagauaacuccuguauccccuuuaccaagagucccuaacugccuuaucauccucucuauauuuauuacauccaaucauuauucauucacaguaguuauguucuauaaaguugcaaacacugugaaucuauugaguacugaugguuaggucccuucaaacuucuggucacauuuucaucaacugaucaauaccugaccuuguucuaugcgcacgcuccugguuuauuuguuuguuuguuuggagauggagucuugcuauguugcccgggcuggagugcaguggcucuucacaggcugagucaucauaguacacuauagccuugaacucuuggcuucaagugauucuccugccucagccucccgaguagcugaaacuauuugcagguaccacugugcuuggcuauuuguguacuucuguuuaaagacacuuuauuugauauauauuuuugauucuuuaacuuugaacucaaagccaauagcacuauaacucaugacugaaugaaguuuaucugucacauaucuguuuucucuguaaaguacaucauagcagcuuucuugugcuaggaauacuagacagcaagucagaacuaccauuuggggcuauuuuaaacagugaaauaaacaguagcacuaaaauguaaaaaauguggcauuaaauagaccacauaaagaacacuuguuuacugagugaaagcugaaacaagaaggcagagcauuucccugcugggaacgaggacauaggcaacucaaaguuuugccacuuugugcguguacaugccuguaaauaacaguaacagugcugagaguauugauuuggggguuacaaauauauuauagugaguaggcaaauuugaaaauucagaaucugaacagugaggaucuuccguauuuuuuuuuucugaauuauuugagaguaaucugcagauacgguaucccauauaccauaucccuuucauacuuuaauacuucuaacuauugucuuaaaaccggggauauccaucuauaggaacacaauaaaaccaucaagaucagaaauuaacaugguuauggcaggugcaguggcucaugccuguaauccuagcacuuagggaggcugaggcaggaggcaggcagauuacuugaggucaggaguucgagaccaaccuguucaacauggcgaaauccugucucuacuaaaaauacaaaaauuagcugagcaugguggcaugugccuguagucccagcuacuacucggggggcugagaccggagaauugcuugaacccaggaggcagagguugcagugagccgagaucgcaccacugcacuccagccugggcgacagagcaaaacuccaucucaaaaaaaaaaaagaaagaaaaagaaauuaacauggauacaauacugccauccaaccggcaaacucccuucagauuuugccaguugccccagggucaccuauuagcugucaugucucuaguuuccuucauucagaaauaauuccucagucuuuccuugauuuucaugauccugauguuuuuuccaagaguuacuuuauagaaugugccuugucaugaguuugucuguugcuuccuuaugauugaauuuaagacuguaauuuuggcagaaauaccacauaaaugaugcuaaguucuccucagugcaccauaucagugaggcacaccaugucacugucacauuacuaguguugauaacuguaauuacuugauuaagauggugucugucagguuuccucaguguaauuuuagguauaaguaucuuauauaauaaguauuuuauguaauaaguaauacauauuuuaaccuguucauuauuuaguaauauauauccuucgguaggagauagcuaaacuauauauucuauuauauaugauauaugauauauaauauauaucauauauaaacauauacuauauauuauaauauaugauauauaauagauaucauguaauguuauauaugauauauaacuauauuauauaguauuauaauauguaacuaguacuuugugagaagcuauuuugagauuguacaaauaucuuauuuauuuauuuuuuugagauggagucucgcucugucgcccaggcuggcuuacagugaugugaucucagcucacugcagccuuugccuccuggguuuaagcaauucuccugccuuagccucucgaguagcugggacuacagacacaugucaccaugcccagcuaauuuuuguauuuuuaguagagacgggguuuugccauguuggccaggcugaucuccagcuccugaccucaggugaugggcccaccucagccucccaaaguccugggauuacaggcgugagccacugugcccggccucuauuaaugauucuuguuagugugauuuguuggcacacaauuauuuucuaauuccaucauccaacauuuauuaguuguuuuucaacuguaauagagaacuuucucuuccacauuuuuuauucauguauuuauucaguggauuauaaucuauuacuauuauguugauuuuaaaguugucccaguuuuggcuaaugagagcucuuguaagcugguucuuaugucguuuuguuauguccccauuauuugaguacuuucuucugacacagcaagguauuccaggcucauauuguacuuucccugccgcaacccuggaaucagcuguuucuucaagaagccuugguucuauuuagcagagaagaguuuuccuuccuucccuuuccuucccuuuccuuuuccuuccuucuccuuccuucuccucccucccucccugccugccucccugucucccugucucugucuuccugucuuccugccuuccucucucccuuccugccuugcucucuccuuuccugccuuccucccucccuuccugcccuccucccuccuuccguccccacuugcauuucugcauuccguccaagaaacaggaauguuuagccaagaucuggguacuaggugugcccauugcuacuaggguaucauaguuuuugggcccucuucuuuaguggauggagucaggaaauauuuguauauauaaacaacacacauguaucucucuauuuuuauauuuaucuguauauauuaaaaaacaaggguuuacuucuaauccaacaggauuuuuuuuucuggacuuucuguaucuguaacucuccucugagaaaccuagcucucauuauccuccagguaugauuugcucaguuccccuguagguaacaaaucugcucacacugagucuucagcuuucugugaccugccagcaaaugcugguuuaaucuucagguccuaguacccugccagcuugcgcugaccaaggggaguguuuauagcuuuuuugaccuguugguagcuuaaagugauuuagccauaggauuagucacccuuaaaauaaggacugccuagcaucauagcagaaaauuagcaucucuuuuguuuuuggagaaaaaaaaugcuuugcuuuuaggcauuuuuuucuuugaaauauuuccagcuuccuuuuaaacuucuuggaaggcuugagcuggguuuauuuuuuuccuccaaauuuaaugugcuuuucguauuugucuggaauugaaauaaaguacuuuuaaaaaugaucuccaguuuuucugugauguauuuaguguuuaaaacaaacacuuuauuuuggccgggugcaguggcucaugccuuaaucccagcacuuugggaggccaaggcaggcagaucaccugaggucaggaguuugagaccagucuggccaacauagugaaaucccauuucuauuaaaaauacaaaaauuagcugcacuugguggcacacgccugugguccuagccacuugggagggugaggcaugagaaucgcuugggccuggaagguggagauugcagugagccgagauugugccauugcacugcagccugggcaacagagugagacuccaucucaaaaaaacaaaaaaacccuucauuuuuuuuccuuauuaaaacauguuucuucacuagagguuuauacauuuaccccaauaguauauguuugauuccuuuuucccaucagaauguuauauuuaugaguugugauaacuguuagaccuaaauucucaguggcuguucagaaucaaacuucuugauuuuugcuguauacguuuagaugcaugcuccagaaauucuguuuucucugaccuguuaguaucguuauucaagaaaauaauauguaguaguuaaucuuauugagugguuuggugcucuagucugucuuuaugcuuuguuuucucagauugcaacacuuaagaaaauucagaaauguuccuuucugaaggggaacaugggaagagaaaaaugaacacugaucacugcaguaacuuucccuuaccuuuaauagccugaguacuugacccucgccauuugauagaggagaagguccccucuauauagugauacucuuuuuuauguccuggagucaguuaauuuuugguuccuccucugauaaguuaacacauaacuguuaccuauccugaaagauuuucuuucgacagcugggcuagauuucucuuaaaugacacuucacauuugucugcuaugugcgguuaguucuuccugaguuguucugucuuauuucugcauaaauaagccuugaucucccagguccuuggcaacagcagagcucagcgugagguagugaggacuuggcuuugcagaggaccauuguccuggagacaguccugacccugguuuccaggagguugagugaguuccuucaugguaaaguuuucgauugugaagucuaagcuacagucuugauuguguucuuuuauguaagucaucgauauuuuggcucaugauucucauaucauagauuuaguauuugggguuuauuagcaaguacacugggaaaaccuguguucuagcccucaugccaucugacugugccauaguuuucucaucugcaaaaugaggauaagggucccuguccugcuuccucagggcauuguugugaggaugaggaggggaggagagcagggaaggaagggaagagagauuaauguuccuuuaacauuuauugaguuaccuucuugguuucagggagucaaggaucuuauguaauaauacaaauaacccagaggagauagugguauuaucuuuacuuauagaugaaggaauaucacaguguucagaaugauuuucacuugaguuugcguucaaacucaaggcuguauaauuucagagcucaugguuguuccguuagccacaccaucugaggcuaugauugccaagacaguuugucaaguaugaaguucaauacaaacuuaagagaugauacuuacuacuuucaccccagaggauagagauuuggacauagguacuuaaaucuacuuuccuagugaguggguaucuuaacugauaaaucaagggaauuagagauuacagguuaucagucuaaaucugacagaauucaguggugagagaauuucugugacuuugauauuuucuuuauuucuuuauuuuugauacgcaguuucacucuuguugcccagccugaagugcaauggccugaucucggcucacugcaaccuccgccuccuggguucaagcgauucuccugccucagccucccaaguagcugggauuacaagcaccuaccaccguguccagcuaauuuuuguauuuuuaguagagaugggguuucaccuucuuggccaggcuggucucgaacuccugaccucaggugauccacccgccuuggccucccaaaguguugggauuacaggcgugagccacugugccugaccaugauguuuucuucuauaucccuagaggaauguccaucuuuuucuauuguacauacucuuccagucuuuauagcagaccacacuuugagccauuucuuguaacaacaauguuggcuauauuuauuguguccuugugcugggcucugugcuaagugcuuuuauuuuguuuagguuucauaacaacucuuuauuuuauuuuuauuucagcaacagauugacaaacuggaucauaacaacuuauauauauucuuauguauuuauuuuauaaaugaugaaauggaggcuaauggagccaauuaaauaacuuucaaaggucacugcugacauugauuugauucugaaacuaaauucuuauugccauauacugcagcuccuucucugauuauaaaaacgagcaguuuguguaacuugaauugguccagaauuuauuuuugccaugcacuugcuauuuagacgaccauaaaacuaguuuucaucucacucgcuugucauaaugcuuuauaucagggguuggcaaacuuacucuguaaagggccagguaauaaauauuuuaggcuuugccagccauauggucucugucgcaacuacucaacucugcuguucuagugcaaaagcagcccuagacaauacauaaaugaaugagcuugacguguuccaauaaaacuuuauuuauggacacugaaauuugacuuucauacucuuuugcauguuacauaaucuucuuuugauguuuuuccaaccuuuuaaaaauguaaaaaccauuuuuagcucauggucuguacaaaaacaggcaguaggcuggauuuggcuaguaggcuguaguucgccaauccugcauuuuaucguuuugaaguuuucuucuuugcaucuacuuuuuggguguucuuuuguaauauuggacucuaagucagcuugccuugcagaugguacgguuuaauaaauguugguaugauuugggacagccagcucauggaagcuuuacuugcuuagugauuuggucuccaacaccuguucuacuggcacauauaaacagagauuuuaauugagaaaaagauuuaaucaguagguaaccucagauaccauuuuaacagaaaucagcucccaaaugcuuguuuguauguguggcauaguggaauaucaggauugggaaacuucaaccccaauccuugcucugcugucaauccugguuauuuuaggcaaaaguuacuuuaccucucuugcucucagauuucucagcuguaaaauaaaauagcccagauuagaugcugucuuuaugugaagucucucuguagaugauuguuaugguccuccugagauuuaaacuccguauauguaaacugcggcccgauuuuuggcacaguuggcucgggagcagcaacuugugcuuguaccuguugggucugcaaguguauccagagccagugagucagcacugccaugagcuccugggcuuccgguucauuggguuugaauguugggcccucuaauuuagguuugccucuuguucuugccaggaaaaaaaccaaaaagcaauacaaaaacacauacgcacacacacacaaaacaaacaaaaaacuggcuguguuggugaguauucagagaaaggccucccagaccacacagcuuauguuguuuugggauugcuugcuuugucuaaaugacuuuuuaauuuucaagagaugauucuuccuguggaggcaacagcucugacugccaggaagcuuuuuccugauaugcauuuugaaauauuccccaauugaguuucuuuuuaguuacucuugcuuucauucaguuucuuuaaauguuuucauuucauuaaaggguauccauuaggaccaaacuuugccuccucuuuuuacaguagcuccuuccccauccccugaugguauuuuuagguguagaaaacaccuuguccagaggggagucccuggccugcuucuuugccacucugacguagagucccugcaugugcagccuuuggguugugacaguugaagaauggcaucauggacccuucagcucaaugacuuuccugguucuccuuucugugugacacacaggaugcucgcuauauuguuucugagaaaaagcuuguauugcuucuggccauuuucauccuuuuuagagcuuuguagauuucacugaaguucugucuuuuuccuguggcuuccuaccuaguuauuucuagaggauuugaagguuuauacuuauagccgcuucuggggugagucaccaugccugacuuuugcuucucaggcagcugccauuuaaaaaaauuuuuuuguuaauguuuuucagcuagcaucuaaucuuccugcaagaauauggaaggcucuauaguaaaauauacauuuuauguccccauguuuuuguacuucuguguuggaccuuaaaauuuuuuuuuuagauauaauuaacauaccauaaaguugacacuuuuaaaguauauaauucaguggcuuuuuacuacaaucauguaacaaucacuacuaauuuggaauauuuucaucaccuccaaagaaaucuguauccauuaguauauuccccacucuccccuucugucagucccugggaaccacuagucuauguucugucuauggauuucccuuuucugcacauuucauauaaugggaacaguucaguauguggccauuugugucuggcuucuuuuacuuaacauaauguuuucaaggcucacccauguuguaacaucaaucaguacgcaaucucuuuuuauuucugaauuauauuccaauuguauggauauacaauauuuuaucaccaguuacagcuguugaugaacauuuauuguuuucucucuuuuuuuggcuauuaugaaugauguugcaaugagcauugguguacaaguuucugugugggcauauguuuguauuucucuuggauauauacuaucggggaaccugccccugauagucacguagguucuuuucuauuuucccuaagcgucggcugguuugagaaauaaagggacagaguacaaaagagagaaauuuuaaagcugggcauccgggggagacgucacaugucgguagguuccgugaugcccccugagccguaaaaccagcaaguuuuuauuagggauuuucaaaaggggagggaguguacaaauagggugugggucacagagaucacguacuucacaagguaauagacuaucacaaggcaaauggaggcagggcgagaucacaggaccacaggacuggggcgaaauuaaaauugcuaaugaaguuucaggcaccauugucauugauaacauauggagacaggguuugagagcaacuggucugaccaaaauuuauuaggugggaauuuccucguccuaauaagccugggagcgcuaugggagacuggggcuuauuucaucccuacagucucgaccguagaaaacggccauacccaagggggccauuuuagaugcccacccucaggggcacauucucuuucucagggauguuccuugcugagaaaaagaauucagcgauauuucuccuauuuacuuuugaaagaagagaaauauggcucuguuccgcccggcucaccggcggucagaguuuaagguucucucucuuguucccugaacguugcuguuauccuguucuuuuuucaaggugcccagauuucauauuguucaaacacacacgcucuacaguuuguacaguuaacgcaaucaucacaggguucugaggcgacauacauccuccucggcuuacgagaugacaggauuaagagauuaaaguaaagacaggcauaggaaaucacaaggguauugauuggggaauugauaaguguucauggaaucuucacaauuuauguuuagagauugcaguaaagacaggcauaagaaauuauaaaaguauuaauuugggaacuaauaaauguccaugaaaucuucacaauccacguucuucugccauggcuucagcuggucccuccguucggggugccugacuucccgcaacauauacaccuaggagugaaaucacagggucauaugauaacuguuuaacuuuugagaaaccuccagacucuuuuccaaagcagcuacaccacccauaauguaugagggguccaguuuuuacacauccuugucaacacuuguuauugccugucuuauugauuuuagcuauccuaguggugguaaagugauaugucauuguagcuuugauuugcauuugucugaugacuaaugaugaagagcaucuuuucaugugcuuuuuggacauuuauauuuauuuuuuggauaaaugucucuucaacuuacuuuaauugggcuauugucuucuuaucaaauuaugauaguucuuuauucuggauacuagacccuugucagauauaugagauaagagucuaguauucagaauuugcauauacucauauuuuuuucuuucuugauaguguccauugaagcacacuguuuuuaauuuuuaugaaguccaauuuauuuauuuauuuuuaaguugcuuguguuuuuggugucaccuaagaaaccaucaccuaaugcaaggccauguagauuuacagguuuguuuucuucuaagacuuuuauaguuuuacucuuaaauuuaggucucugguccuuuuugaguuaucuuuuguauaugguaugacguagagggccaacuucauucuuuugcacauggagaucuaguugucccaacacauuuuuguugaaaggacuacucuuuccccaucaaauuauccuggcacccuuguucaaagucagugggccauaaauguauggauuuguauugggccuucuuuuuguaauauuugucaucagaugucugcccuuguucuuuauguugguucuucacacagguagauauugcuguuacaguauaccuacuauacuaucuuaacuaguggauaugcccguuaaaccaguccucuuugcagagcuaguaagaugccauucucagaccaaagugauuuuugcucuugggcugggaaaaaauauuggcuucauugacauacaaauuucuguaccauccuuuucuuugcccuuaguauggcuggguuuuuguauaagaaguuuucugucuuguugugucauuggcccaggaguuaaauaguuaaacaaaccaagucauuuaucagaaucuagugaagauuuaaugugguguuccuguugcugggcaacauuuuaguggcugcccauacaguguuucacuguagguaaaucucccaguaaacccauaaguggguuugaacaauuugaguccccaauuuuccuucucagcugccuuguuucagccuuuguaaccacgugacuugugcccugaagccagguccuuugaaucacaccacgucccucugcaaccuuuauuggcagaacugagaaaugucuaauccauaaccucaaucaaacugacuuauugugacaccugguuucacaaaccuccugcuguaucagguaguucuaagaucauuuuucuagaaugucaguuuauuaauauaauugcauaaagcaguaaccauuugacuugauuucugugcucuauaaauuagcaauuaaggauaauuacugcauccaugaaaguuugcaacaugaaucagcacagcuuuggcagacuaauuaccuaugacaguuucuucucaaucuuaacauuauucuccugaaauuaaaauucugguaaacaacauauuauacuuacaugugauguuuauuguuugucugucucccccuacuagaaugucagcuccccaagagcagaaauuuuugucugcuuuguuucacugaaacaugccacuugccuagaacaaugccuggcacauaguaggcacucaguaaguuuguagugaauuaauaacugaauaaaucaaggaauaaaauuauaacaauaaucaaccuggcaggucuuucugagaagaaaaacggcuuguuuuggugccauaugacauauaaauuguugagcauauagacccuuggccuuuuucauauuuuacccagacauuuaaaguauuuuucccccagaagguauuucucauugguuuuauuugguggcgacuguuagcuauaagaaggccauuacaauguuuucauugaggaagaacuugaauaaagacuguuggcgaguaagacaggugggagaguuuaacagugguuggcagaugaaguggaaauagcaaaaaggagguguaguguguuucuguuuguuucuuuguuuuuuugagagagagucuugcucugucacccuggcuggagugcaguggcacaaccauggcucacugcaaccuugaccucccaggcucaagcgguucuccuaccucagccucccaaguagcugggacuacugaugugcaccaccacacccagcuacuuuuuuugauuuuuaguagagaugaggucuugcuguguuguccaggcugguuuugaacuucuaaguucaagcagcccucucgccucguccucccaaagugcugagauuacaagcuugagccauugcacccagccuguaguguguuuugaaugauuucaguuucugugagugguaggagggaaacuaguucuucccuaguagaaauaguucucuuacuuccauaacuguguacagucagucuuuucuuaccuuuccaccaaggcaauagccaaaugaggggaagagaguuucagaagaagggugcacacaugccaauccucuccuccuggaggaguaggaauagcaguaccugccacagugaaucuauuucuuuugcuuaggaaguugaauuggugacagcugcuugaauucauauauucaaugguauaaaagguguagagagccuguagaguaaaaaucaucuccguaacauugauucaagcauuaacugaauggcauuuuuggugcaacaaugcaaggaaguucugacagcagccuuuagcauucagggagaggagagggcauacaaaggaguuuugcacaauuacuguguacaaguuguuugccaaagccauuaauggggccaggauaauaguuguagauccauuguccccagggauccgguuuacuaggcagaggcauuagagaggcaauaccuuucugauauuuagagaugaggggcucuucucaucagucccucuguucuugagcuucucaguuugauuugucaggcuugagaaacaaagaugguuuccuaggcuaggucaaugcuugcuuaucagaguucaccuucgucagagaggaugaguuuucuuguaaauaggccuuagcuuuuaugacugggcuuuaccaagagguccccugggaaugcguuauuacuuuuuuugugugugaaaacuugaccaaaauugagcagcaagcacuagaaacagauguucugguuugugugcuguauguaguuuggcuguccucagccucauuuggaauuugugcuugaaugauuucaagugcagguauucugcacuaugcucuucuugcuguguguuuuguuucuaccacuugugagaaagaauugaauauaaaugagucaggaagcucuccuuuucuucuuuggcccuucuuauucaggaacuucaagcagccucuacucuaguauaccuguucuuuccuggcuuuguuugguuugagagcuuaucuuuuggaaugucaguucccugggauaaugccuaggacaugaauucucaggauaggguguuagcaugguuauuuggcuagaaguuuuaggguuuaauugcugauaacaggauaaaaacgaaaagcgugccuguaacuggauuaggaagacagucuuuuugugugugugugccaugguauauaaccagggauuaaagugacuuaggccagggucugugugcuuaagguguuggggauauugagacauuaucagaguacuaauuuaauguacaauuaaauauuguauauuggaauguacaauuaaauauuguauauuggaauguacaauauuguuugauagaauuuccauaaaaaguuaguauggauaaaugaauugugauauauucguacaaaauccuuggucaggguaauggugggguuugagagaaggggcugcaaguagagaggggcacauggauuccaagguucuggcaaugugcaguauuucaguucuuaacuuggguggugguugcucagauguuuuacuuuucuuauucuuuaauuuguacauguggguuuaaauucauuuguguauuuauaucaauauuuaacacuugaaagcguuaguuaagguagagagguggagagcaaugcacucuaagugaaaggagcagcuuccuuucauucuccuuuuucucuuccuuugauucaacuuccucacaaggauuauuccuuuacugagaacuccauggucuugucuaaacaguguucuguguugacagaacccuccaaccuucucacuacuaaccuuucgaagcuauuuuuuaugaagcguggaauugagagucuuucagaucuagugaagccagggcaugagcccccaccuguuuguuguauugugagucucuucgcaaagacaauuugaauagcuugggucguuuuucccuuaugugucuucuucccuucuuucacuugaaauccuuucuucuucuccccugcaaauacuuuaagguuaaugccagugagcuuuagagcucuuuucacaguugcaaguggguucuaugccuggcaucuuugauuagagagaugaaaggagccacugacugcacuugggagccuuaagguguuuauuagauucuuacguuuuaaucauguagggcauggguuuucuagauuacuucuguauuucucucuuguacuguccacaagggacacucuagguauugcauccaccuuagccuugggcaugcucauuuccucccagggguguguagggacuucccucagcuucuccuuuuuuuucuuuuuuuguuugagcagaguuucacuuuuguugcccagacuggaaugcaauggcgcgaucuuggcucaccgcaaccuccgccucccggguucaagcgauucuccugccucagccuccuaaguagcaggaacuacaggcaugcgccaccacaccuagcugauuuuguauuuuuaguagauacaggguuucuccauguuggucaggcuggucucgaacucuugaccucaggugauccacccgccuuggccucccaaagugcugggauuacagguguaagccacugugcauggccacagcuuccccuuuuccuaagccuuucauuguucgcuucaaucugagaauggaaaguguugauggagauauuaauucuuaauaauuggaaagaaugcaaggggugguacuugcuaggaugaaauuauagaggucauuaaucuguaugucucacaugccuuuuuaccccagucuguuuauucuaugacuuuucuauuguuggauuucugggucaaucauuucagaauuuggccccaggcuuuauguagguauuucucuuauaaaauuaaaaacaauccuguuuauuuagucauucaacagaugacuuugcaugccuuugaagugcaaaugcuauuugaaauguuggggauacggugguacacaaccugcauuauggugauacggccucuggaccauucauuuucucuuucuucccccuacguagguccucucagggugcgccaucauuguccgaggucagccucguggugggccuccuccugagcggcagaucaaccucagcaacauucgugcuggaaaucuugcucgccgggcagccgccacacaaccugaugcaaaggauaccccugaugagguagguguuuccugaggccaucgugagccuguggaccuagguaauagcccacugucuucugucgcugaugccauuuugauguacucuuucuuuguauuuugaguauuuuuauaucauagaacugcugauucuggaugugcccacaagcagcuuguaucuguuguuuauauguuuacuaccuuuaguggcaguugaagucuuagagcuuuuucuuguaccuuuucccauagacuuagauuuguuguguuuucacuacuacuuuucuuggaauaguuuaggaacauuuccuggguagccuuaagcauuugaaaucaccauugguuauggcagagcucuuuuauuaauuuauuuuugaauucuucauucauuuacauuguucagaaugcagaaggauauauagugaaaaaucgaguacuuccccugagacaccugagguuacuagggucuugugucuccuuccagagauaguuaaaaccuguaugaucagacacucucauuuucauaaaucguagcaugcuauaaaugcuaggcccauauuuuauuauuuuauuaaagauuguuuuucuuuaagguucagaggguacauuuucauguuuguuacacggguauauuguguaauguuggggauugggcuucuaguguauccaucaccaaaauauugaacauuguauccaauagauaaucuuuuaauucucaccccccucacuccuucuccccuuuuggaguccccagugucuauuauuucuaucuauauguccauguguacccauuguuuaguucccacuuacaaaaguuagaacaugugauauuugauugucugcuucugaguuaguucacuuaggaugcuggccucuagcuccauccauguugcugcaaaggacgugauuucaguauuuuuuuauggcugcccauacuuuauuacugauuuuuuuuguuuuguuuugagacaaggucucuguugcccgggcuggagugcagugguguaaucauggcucacuguagucucaaccucccaggcucaagugaucuucccaccucagccuccugggaguagcuggaacuacaggcaugugcuaucauaccuggcuaauuuuuauuuuuauuuuuuuuaguagaaaggaggucucgcuaguuugcccagccuugaguuccugaauucaagcaaucuuucugccucgcccuaaaguacugggauuacaggugugagccacugccccuggccuauuccagauucuuaaucugggauccaugcaccucugaaggcauauauaaaucccaugaaauugcaaaauuuuguguaaacgugaauuguuuuagagagggaguuuuaaaaaucaguuucuuaagggaacuuauggcucaaaaguaguuaagaaccauuguuuuaugguuauuugagaaccuucugugccuaauggugauuugagaaccuucugugccuaugucccaucaucuccuccauccuucccucacaccccucagccucuaaugcccagcccccuugcuuuuguggucugccuuugaccccuuaaguuucugcucuuugggcagcugcuauguguaccaauuuggcauuguuuagucuuuuuggcuucuacacuuugaaacauuagugcuuugcuguccuuuagcagugcuuuggcugucagaaaugaaauuucugggcuggccaugguggcucauaccuguaauccaagcacuuugggaggcugaguggggaugauugcuugagcccaggacuucaagaccaguccugacaacugacaacauagcaagaucccaucucaaaaaaaaaaaaaaaaagaaaaaauuagccaggcaugguggugcaugccuguagucucaacuacuugggagguagagguggaaggaucacuugaaccugggaguucaaggcugcagugcaucaugauugugccacuacacugcagccugggugacaguguaagacccugucuaaaaaaaaauaauaaaaaaaaaaaagcaaaauuucuggauuccaauuauuuguucuuugccccaacuuuaucauguugggcagguugguaccucagcuuuugugugcuauucccugccagggagguaaagaagaaaaagcaagaguuuauguggaacuuuuauuaauauuuaaguaaagcauuuaguuuuuaaaauuauaauaaaggacauuuuauuuuaauuaagaaguuagugaagcaaugguauagauaauagagauagagaaaaacucccauaauucuacuaccaacagcaaucagacuaaauagauuaaaauaaauuuaaguagauuaaaaucaguucuuuuucacugguccuccaucagggaccacacauauugagaauauuagcauauaccucagggucguuuaaugaagauuaaacaagauaacaugaagugcuuuagugcaugcuuauaaaauaauaaauguuaguugugguaaucacuacuacugcuugcuaauuucucuuacuacagauacuccuaguacuguuagaucaaccacugaagauuaaauaucuuucagcauuuuucacauuuugggcauuaacaaaugggugaaccaacauuuugaauaguuucuuuuccuauuguguaacagcuugauugcuuccaaaugaagaguguugacccuucuuggagcugaccaaguucauuugcccagaaggaagaacuaguguagccucuaagaaagaaggguuggauuuuaauuuccuguuuuguggaugagaaucuugggcagagaaauacaaggccaguuggaacuuguucuaaaauaucauaacuguaucccauguuaacaggacggugaaaucuuaccagaacuauccuaggugaaaggauacuguguaaucugauccuagcauucugguguaguuccauauauuuauacagucuagugcuuuuugccucucccagacuaacucagucucacuguuucuccugguaacucuucagagaucccugugagaugaaauauuugauagcugcagauuucaucuuuuccuagcccacagucaucauuucuccuuccuaauaauccaaugucuccucacccugcugugauuugguuuuccuccuauuguacccucaaagcugcaucgacacaaguuaccaguaaugucaauugauugaaaaaccugauuucccugcucucauuuugacucccccaccccccaccccaacgcugacauccaggccuuuaacaaggccuagggauucugccuccuuaaaaccucucuuauccauacuugacauuugauuaauacugcuauucuuuguucaucucugauagagugcuuagauguugaaauaauagucucuuugcccucauucuccuucccucuaauccuuucuccauaugcucucagauuuuuuugaaacauaauuuuauuuuuucccagacucuucagugguuccucauauuccaagacacuuuagugauuccucauauuccaagacacuuuaguaauuccucauuaccucugugacaaaucuaaaugccuuagccuggguuacaagcgcauuugugauaugacuuuuagacuucucuuacugaaaccccucugggaugccaagcccccaccaugcugaagaacuuaagucuuccuacaggcugggguccugccuucugcccucagcucaugcagcccccuccaucaguaguuccuucgccaccucuguggcuggugagcaccugcugucuuuuaagauucagccacuuaagaaaucacaccugacauuuccuuucaucaucccaucuuggugcugucauagcauucacaacauuucauugcauguuuacacguuuauauaucuuucucuacuggauugcaagcuccaaagaagagagccuuucucucaucucugugucuuugugccuagucaguaccugacacaauacagguaagcagugaauaaacauuuaaaugaauaaugaggaaaagaaccugagcgucuccauuuuagggguugaaagauugugcaauguggcacuacgcuuucucucuggcuuucuauuucuuuggagcauguuuagcuuuuucacauucaggaauaaucaaggaccuuauugcucauuugcaucccuuuguaucacugucccaaauaucuucacaugauuauucuuugccuucugucaugauaucgucuuucaaagaaacucagcugucucuuaaguccuguggcaaugaaagcagccccacuguaugcccccagccaucucuucacuguuccaagcuaauccccagcguugccuagcuacuccaggcagcuuagauacugcauugaugggcacugugggaauuauauauuuauuucccacagaauuauugagcuccugcugcggguaaaguuguuuauguuuucaugagaaauauagaaaugagugucacaaccacuaaagaacuuauucauuuaacuaaacaccacccauuccccaaaaccuauugaaauaaaaaaaaaaauuaagaaauacuaucuuuaaaaaauaauaaaaguggcugggcgcaguggcuuaugccuguaaugccagcacuuugggaggccgaggcgggcggaucaugaggucaggaguucgagaccagccuggccaacauggugaaaccuugucucuacuaaaaauacaaaaaaaauuaaccgggcgugguggcaugugcguguagucccggcuacucgggaggcugaggcaggagaauugcuugaacccgggaagcggagguugcagugaaccaagauuaugccacugcauuccagccuggcgacagagcgagacuccgucucaaaaauaaauaaauaauuaaauaaaacaaacuaaaagaagguaaaaaauaaaaaaauaaauauuuugcuguuuuuguuuguuuguuuuuagauggagccucgcuuugucgcccgggcuggagugcaguggcgcaaucuuggcucacugcaaccuccaccucacagguucaagcaauucuccugucucagcuucccaaguagcugggauugcaggcgugcgccaacaugccuggcuaauuuuuuuuuuuuuuuuuuuuuguauuuucaguagagauggaguuucaccauguuggccaggcugguccugaacaccugaccucaggugaccugccaagagucuuggccucccaaaguguugggauuacagccgugagccucccaaagugcugggauuacaggcccggccauauuuugcuauuauuuuaaaaaagaaaugaaugucacaauccugcauucauuggagcuguugaggacugggguagcuggggaaagacggcagagcaggauuaucaguuacauauccagauggcacgguggggugguuggaagagaaagagggacaaaaaguauugaauguugggucauuuaccuaguaacuaguuaagguuuuacauucugggguuucaucuuguccugguaguuuuaagagucuaucuggucaaagagaagauuagaauuaaaagcucaguuucauugugguagauaugacaaccuuucuugggucuggaaguucugagcaggccgccagauugccugcaguugggcauucuaaaggaaagaguaauuuugagucucaacuucuuaaaagccacuugcuucuuagaugggacucuggggcaucauuugaauagaccacaguuauucuuccuguuagaccauucuggcccuuauuugaauaaaugcuuugagcaaauuuccuuauuugagcaagcuucuguuaggauagacuucuccaucagauaguccucugccuggcuguccuuuguguggacacauggguaacacuggccucacuuccauaaggguucugucccagagcacucucuugcccucagaggagugauguggucaguugcuuuccucuauagcucuuugagucucuugauugccucucuucuuaacuaauaucuuguccaguuauugaauuugcccaacucuggacggaacacacuugagaaggcuuauuuaggaaggaagauugcagaaacuagguuauuuuuucuuacacgguuaggcauauguccuuugcaagaccuccagugugguuuucucuuauugaccgguaacuaaccagcuggaaaacaugagguccuaaggggaagauguuucuucagcgagccuuaaaaguuuuuuagaaaaguucugccugguugguagaaauuggagauuucccugcaggggcuaguuauuuuccugugaacugaccuuuuguaaaaguguuuucaccaaagucuuggccucuuuuaggagcacuggucuuaucagagcuuuuccaaguauuuaggaaagcucuauguuacugaauuuuaaauauuaauacucaggacuacaucuuaaacuuaucuguagcuguguauguuuuuggaguaaguugaucccuaagguaauaaaaauuugggacgcuuuguucauugguucggugcuguuucugugaugugguugauaauugggaucauuugucaaucaucagacucuuuggugacugguaucugauuuuauuuuuggagauuggggugggggguagaaaugagacauaaaaucaaggugaacuugauauugucauugagugaauuggguuggccucugcuuugaagagagggcaugaugugagcaaguaucuguucauuuuugcaucuuuaagaacccuuacugaggaucaguucucuagaaccucaugauuuauguuauguaacaguacuguuuuuaugacuaccagcccaacaguuugguggaccugccaccuuuugauugguuucugguuucuuagaagucauauggauauuuuucuucuagaaaagcuuguugggugacuucauggaauaauuagcauggaccaaaaagguuaacagaggcuuccuuucaggccaucaguuuacucuuuugccuuuacuguguguagcaugaguucugugguuugaagagauuauaauagacaauguaugcauauuguauaucacuuuucccuuuuauacuucacauuuuuuucagcaugugagcuccuacuaaucauacgcuccuugaacaccuaccccaucccuccccauuuugguacuaagggaacuugggacauuaaaccagguccagacuauaaguucaagugccaguggccacugugccaauggcuucagaggagaaucucccuuugucugaaccaucccaggagugauaggauggggaggggcaaaaccaccccuuuguguauuaucuugagaugacauggagacucugcuucuacuguguggauguguagcucaguccucgugucugugcauggaacggugagaggaaagaaucaccauuaucaaggugauccuuugucaggggcuguuacugguguccucccaaggauguugggaccuguaaaggcuucagacuagagcagaaguagaagaagagccauuuugggggauaucuucuuacuauugcugaucuuuaaagaggggaguggagaugacuuaaauaaggcucacuugagcaggggauucacucugaaauaagaacacuagaaucaugucccuccuccaacaauggcuuuaacugguuucaggcuaguuuaauaggcagugaaacuguuuuagaaacuggaaagaggcggagaaauggaggugguaguuguuauuuaugacuucccucugccuagguggguuccuggagccuggacuucccauuugaaggaguggguugauauauauacagcauuuagagcaguggcuggcacaugguaugugcuauaaaagcauuggcaaauguuauucacaaaguaagcuauaacucugaacagacagugauagggaaaaaguccugcugccagugucuggaaaacucugaggccuguuuuuagugucuguguuaguuaaaccaacugcuggacccuccuuuuuuuaugagcccccuaagugugcgaucugcauugugugcauuucauuuuuauauucucaagguccagcgcagggccaggaccaugguagguacucagacauuuacugaagguaugaaguugcuugaaugcugauuggcaucugaaacuaggcaguucucaugugacauauuuguuuugucuuucagcccugggcauuuccagcucgagaguuccuucgaaagaagcugauugggaaggaagucuguuucacgauagaaaacaagacuccccaggggcgagaguauggcaugaucuaccuuggaaaaggugagcugcagggagaggacucauuucucucaagucuaaaguucuguuaaagaucaguuuucuugugguggaaggccaguguggguucugguggaggaagcucuaggacaguuggcugaaggcauaaaugcaaaugcuuugggcccugagcacagggaauauauguguacagaggcaugcccccgguguuccuguuccuuguguaccccuuuuccugcuuugguuuaggugcauguaguauagaguugcauucuuccucauguuuaggccauucacucauggaacucaauggcucugugcuucuaggucagaaugcuaauugaauuucuauagauuuccuuuuguaucuucuauuucuuuuaucuaucuuguggcuuuucuucucuugggaacucuuuuggaaaggaagauuuguugagggccugugguuuuuugcagccuacauguuuuuaauggaauggaaggagcacagaugucgggguugcauagauguagguuagaauucugauuuccuaccaugugcccuuacuuaacccuuaaccucuguaagcccuaguuucuucauuuguaaguuauugagagaguugaaagagauaguauaggccaggcaccguggcucacaccuguaaucccagcacuuugggagugugaggcaggaggaucucuuaagcacaagaguucgagaccagccuggggcaacaugguaaaaccccguuucuauggaaaaauuagccaggcgugguggcgcacgccuguagucguagcuacucgggaggcugaggugggagaaucaccugagucugggaggucaagucuguggugagccaugaucaugccacugcacucuagccugagugacugagugagauccuggucaaaaaacaaaaaaauaguauauguaaagcaccucacucuggauauuugugugugugcauauuguauagcugggccagaugcuucaugggauauuagauguucugggcuuuuuggauuagguaguaagagaauaagauugaggaauggaguuggaacagaaauaggauguugaaagaggaauugguaggauguucuccagaaagcagccagaugaacaugaaguuauguucauugaacuauuuguggagcagaauuuuuuuuaaguuuccuuugauucuuugauuaaaaaccuuucagauagcucauguaacggaguugauuuggauaaucuauuugaguuggauagucagugcuagcaauaagcaagcaggguagaaugacagugcuaacaguauucugcuaagacucuguuuuuaaugauagaggucucagaaaaaugaguugagaaugaccuuugaggcaucuuguucgauuuccuaccuaguagagaaauaccucuuuuuagucucccagaaaacggcuaccugcuucuuauuugaaugagaaauuauagaaaccuaaggccucuuuucaaaaagggaaauaaguuugcuuuuuacccguaauucuuauaauauaguaagaaacaaaacgcuuaaagauaauuauugagugguuacugguuagaaagaauguaagaggaaaagaaguguacuaucuucaaaaugcaauuguuaaggauuucauuaccuaaaaaauuucaauuccauaauagcugaucagucuucuguuaccccacaagagaccuuaccggaccacagauaauugugggcacagauauuucuauauguagagcaccccuaagaguucauuuuaauacccuuggucuucagccaaaauggccaaauuguuuauuuuaagagaagcugauauuuuaaauuaucuguagaguuguuuuuuaaaaguuuacuuuuuaaacugacucacauuacaaacuggauauaauuuaauuuaguauguuaacacauuaguguuuagaauaagaacuggcacauaggugaucaauaaauauguacuuaaagaaugguuggaauugcuuauaaucuuuccauuuuaaagauaaagaaauaguuuaauguuuaauauuuucacuaagguauuuuaacuaacucuuaaugccaauucuauuauaaugaaagaaaacaguggcuuagauaauuagcauuuguguuuauuuuauugcuacccacuuuuuuuuaugaugggagagaaugguaaaauuugagacuuugugguuaaccuagaacuuauugaagagaugauuaguuuucuggcuuuugaagacaauauaaucacccaccugcucugaauacugucuccagaugugacuuggucaaauucagaauuugauaaguaaggagcaagaauaagauccuuggccuacaaauuccuguuucacuuuccuaucauccacauuucguugccuccguugaggguucaccccaggggaagauacuuuucuccuuuuugcaggcgcauucagaacucacuuuuuagaagugggccauuucagcaagcuaugugccaagaaaaugucugacuuaucgggugugcuguugaucagcccauuuuauggucacucaccuuguuuguaccugggcuucguucuuuccacccccagaucuccuggcacuucacugcucaauuuucccuuaauuguugaguccuuccuuuugacuuuucacucuuugggauuccuguugcuuggaagaaccaaugcaaaauuuacuaaugugucuuuggcuggccucagcaguaaccucaacagaaagggucaggugauccacacucacccucggaaccugaaccuucuuuguauaaacuucucaguucaacuuuucuugguaggaaaagaggcuuaagauuugccccugcagaaauuugggcaugauaauggcgaggcaauuagguugggcuuguggggcgguguauguaccuguuacugcuugcagaggucgauguguagugugccgaauguaaaucuuacagaauuuuauuauuugcugacauuaccuaucaguuagacugcuguguuucagauuaucuuggagcuuguucucugccauauuaaagauuuuuaugugauuauucccucauagaugucuuccuuuaugguuuuggccgacaagcagagauuuaagagaaaacacugagccugaaagcuuuuucaauagccucgaacuacaauuaauauuucaagugccuggguagaaccuaaucagauuggauuuuauguuuaacuuuauuuuucuugcuaggucugauggcugcuuugugagagaugagaaaucuagccuguguucucucaguaucccuaugagagcaagagaaagucuuugucaaaugguguagcuugucuugguguccucuuggagcagagaauaggacaucccugagaggaauuggacuuucuggcauaacgugugauagccagcccuaaaugaauccgucucucugaucguacacggugaagggacuaacuuuuucuaauucuugccaugcgcuuggcacugugcuuggugauuuacacacauuacuauuuaauucucacaagaacccaucaaggcaagugcucuccccacuuuagagaugaguaaauuaagaugcugggagagcuugucgaagcuauuaagcagcuggauuuguguucagcuccaggcuucuauuccuccagucaccacuuuauacucucuugagcugccagcugugugugucuugcuuucuuguccgucucccaugguuccugagauugcguuuggccuggaagauacacuagaaaauuaaaaacaaaguccugagaagaagauugauagaacuuuggguccuagagacuagauauuaugggaaaagagguuuucugaaaaacccaaugcuacauugcugcuguguccauuucucuggcagcauuauucuccuugaggagcuaagugugaaaguggucccauuugggcucuguugcuguuggaggcagguuugaaucuuguuuuuaaauccccccuuuuccuccucagauaccaauggggaaaacauugcagaaucacugguugcagagggcuuagccacccggagagaaggcaugagagcuaauaaguaaguauucauuacuccgcugucucucugacagcgguaaauuggcuuugcugcauuuuucauucuugcccccagacauggguaacugcaggggcuuucacaccuucgcggacauucuugcccagguauggauuauucugagcuaggaagucacucagcauucacuaaugguguuugagguauaugacucuuuuaaacacaggcuuugagacuaggcaauucuauucuucauauucauaagagucaacaagucuuagacuagauauucaguuccagaguguuuaccugucugucuagcgagucccaaauauuuauugagcacuuacuaugugccaggcaguuuucuaggcacugagaauauagugugaauagacuuagcuucugcugacguuuuaauggggagacagucaguaaacaaguagauauacagucagugcaaggaauaagugcagucaaaauuaagggggugaauaaauagaauacaaagcaaaaucuguuguuuagaaucuggagaaacugacaaggccucacuuguucuguuuucagagucaggaaaaauuuauaucucuucaaagucuuucaagucuguguuguuuauguaucuguaguugcuuaauagguaaaauguauuuguuuagccaauggcaaugugaaccuguuagaaagggguuguguguaugucagguuuauaguauguauaucauguucaaguucacuaguguuggcugucaguaggauggauugcagcugguuuucauuaacauuuuagucucugaaaagugcuacaucuauaauuuggaggcuauaauaaugcuguuuuauaucauuaagucccugcucucuuauaugacugucauagcuguaggaaaggcuuuagagaaacauuugcaugagguauaccaaugaugaggaugagcaaaggcaaaaaugcgccuuuugcauucuuucuaccuucacagacauaggggccaggucuuucaccauagacuugugugguccuuucugacugcaaggagacauuugcuggacucuauaauuggggugugccagugggaauuuguugaauuaagauacuuguuuuggugguguuuuuggacguaugccaaauuuguaucuuaaggacaauuacuggcuugauuaccauuucaguauuuugggggaauucaguuugcaauuggaaugaauaauaaaaaaaucucacagcaggacuggaccaucucaacaaauaaaucuccccuggaguaccaguccuuuuuccuccaaaauuguuuugacuucaagucacuuuuucccaguuuuguguuugguucaaucucuuacacuacauuucuucaucuaauuuugacugugaauuuggaucccugagggugugguugccuuuugggguagggaagagaggugaagacuucuggcuugagaaauugguaggucauccuugcuuaggagucccuccugcugaagaugagaagagauucaguuuaugcauacagccguugauggcaccgagugucugagauuaugcaaaagccaugcaguuccaugcugccuuuagcucagauauaacagagaaagaggagccauuucuagccuuuuuaaaaaaacuugauuugauuugucuacugauauuuuggcugcucuaguacauaguuugguuucuugccugaugaaggaggaggcuuccauuuucaagcugcuuuugucuagcuugccuuauugaauguguaaguaguugggggguaacauuaucugugauagcaguguucauuccacauuccucagccuuguucuguaaacugagagagagaaagagugguucuuagucggcuucucugcacuaccgagcugugccugggauuccaguuccugaauccgggaugguuaaaugaagcucuaccaccuggagcaacucugagccacuaacuuguucucuucugaucagugaugguggcaguacugagauguguguucuuuagaucgucucauuaaauacucuuacuauuuaaccuuuuguuugaaaggacaaguuuggaaucuagaaauugcaaucauggugauuuucugguuauaggcuugggucuuaagccauagaucugaaacagaccuuuguugucuucaaggggugaagaugcugaagaaaaccuauaucagagagccucguauuucuguuugugaacucacuaaccacucuuguuuauuuuuuaugucccaguccugagcagaaccggcuuucagaaugugaagaacaagcaaaggcagccaagaaagggauguggagugaggggaacgguucacauacuauccgggaucucaaguauaccauugaaaacccaaggcacuuuguggacucacaccaccagaagccuguuaauggugaggcuggugggaacagacagauacgacucagggugauuucuuucuguuugcacucuuugcuucuugagguuuguaaaaucuaguaagccuuucuuauacuuauuuaguauccaugggaaauccuuaagguuaaaacagcaccuuaguauuucagaagggaauuuggacucaguucauguaaaucacaucagauacauucugcagaagcuaguccugugcuguugcaggguaguaaauugcugguauuuugcacauugauuguguucuguucucuaaaagaaggcuacuuaaauaccaacccuaaaacuuaaagguagcaaaauguauucuguauacaucuaaacagauacggucaugcuucauuggagauugguuccaggacccuaucccgcucuuccucccgggaauaccagaaucaaagaugcucgaguccuuuauauaaaauggugcaguauuugccuauaacccacucacauccucucauauacuuuaaaucauugcuagauuacuuacaauaccuauuauagugccuauacaccacuucaucuguguggacucaacauaauacuugguguguggcaaauucauguuuugcuuuuuggaacuuuguggaauuuuucuuuuuucugaauauuuuugaccugugguugguugacuccaugaaugugaaaccuauggauauagagggcugacuguauguguauuuauaugcuauauaguuuuuggcccgguuuugagaccuugcuaacugcagacucuguaaaauaagauuuuuaccaaucuuaaguuacuaauuauuuuuuguuggguaccugguacucaggugagaauccuagcuuauggauaacaaaccuucagugugagccaugaggucccagacaguucagaagacagagaagcaggucuaaucugcauucuccaggaaucauuuaugcaagagucuguuauguaaacucucaugaucugcaagugcauccuuacuuuucagagggaggcuuucucaggguuuuuggggagaggaaacuguguuaagugcaguuugauugggcaguguuuauccuuguuaggauguuugcuaaggacuuaagcuguuuauucugucacacagcuaucaucgagcaugugcgggacggcaguguggucagggcccugcuccucccagauuacuaccugguuacagucaugcugucaggcaucaaggucagaccauacucuuggcuacgugguggguuuagaguguguggauguucagugauggauucuucuacuuggggacuucggaucugcuguuucuuccuaaugugggccauuaacauugacuuuauacuuguuuuaguuuaaacuuuguaguacgacaguucuaauuggaucaaauuauuuauuuauuuuuuaaaguauucugggucuagaaugggcugugcuuaggguuguuaaguauguaaaccuagagaaauggaacaaugagaggcuaugaaguuugcugaauauggcuugcauuaagcauuaauguaaaacauucauuuugguuuuuaaaaaaucagagauuaaaagcugagcacuggcaagucuuuuuuugguaaggggccacuuuuuacuguaauuaaaauuauuguccucacgauaaugugaguuuuauugucuaccuuugccaagaagucugagaugaugauauuuccagucccuuuuuaccaguguguuuuaaauuagaaggacugauuuaagaccuuccugaguuuagcuucguggcauguguguuuuuuggaaggcuuaguguggggcgagagugccuagcacucacauuuaggcugcauuacucaccuaccuugccuuugcuuuagugcccaacuuuucgacgggaagcagauggcagugaaacuccagagccuuuugcugcagaagccaaauuuuucacugagucgcgacugcuucagagagauguucagaucauucuggagagcugccacaaccagaacauucuggguaccauccuucauccagugagugugucugugcagacuggguggugaugggcuagggaugcauuugggguuugaagaauagggguuugcuucucuuucucuguauuuaacauccauuaagauauuggccaguugugguggcucacgccuguaaucccaccacuuugggaggccaaggcggguggaucacgaaguuaggagauugagaccauccuggccaacauggugaaacccuguuucuacuaaaaauacaaaaauuagccugucgugguggcgugcaccuauagucccagcuacucaggaggcugaggcaggagaacugcuugaacccgggaggcggagguugcagugagccgagauugcaccacugcacuccagucugggcaacagagcaagacucugucucaaaaaaaaauuauggcaggauuauuauuaauaucugcugauuuuugaggcauuuucuagggaguuaucauuugucuuacagaauuggacaauuuucucaccuuuaggaaauuaaucucaaguguuauuggguucauaagaagaggaacuugaucacauauuuaucuaacuguuugguccuagggguugcuacauucauuagaaguagaacugaaauuuguagaauaggguugaugaggucuagaagucagcuagcugaaguauugguagaucaaugaugaggaaacugagguauggaaaaauuauguuuuguauuccaggcuuuauccagcuaccuccuaacucugcuuuuagcagggaguagguucuuuauguucuuauaguuccgauucuuggauguuuuaccuuauugugcacuuugauaguuggguuauucuuagauguaagauggccuucuuuuuaacaccugaaauugaauggauuuucauuauuuuaaccuguguccaauacagagcuaagcuacuuacucuuuggcuagauaauucuuccaugauggcaguuguggaagguugaaaggcuugguuuggggugugccaaggucaugucuguuucuucuggagugcugucuggcugugcccugccagauggcucuguguuacaguacagugugaauuuuaauucacugggcaaaauguagcuuccguuauucccugcucagccuguucuucagcucuuaugaaagggggaggaagugcugaucuuaagggagggaagaauaagguguaaucucuauuaaagauuaacauccuccucugcccacaagaagagcuauugaaaugucaauuccauucagugccacuagcauuuauccuacuccuauuaagugaguuauuaugguggauauuguggggauacgaagccaaggcuauugaaaggagucucagaguggcaucucucccaucuuaggagugguuucguagugagagaagcuacucuacuguaaacaaacaaacaaacaaacugcagacuaguuugugacuguguuaauugugucagaagucuagagaaauggauucuuuuacaacagagucuaauccgugccugccucucauguaccuuguuuuucagaauggcaacaucacagagcuccuccugaaggaagguuucgcacgcuguguggacuggucgauugcaguuuacacccggggcgcagaaaagcugagggcggcagagagguaaggucuguccaagaggccuuccagcuguggaucuuguuaaggaucuuuagggaaagaaaucuggugauuugcucacaccccugugugucaguguucauuuuacuucaguaaaggaguagggcaguuccuuauagaggagugacuuaaauauuggucuucagguucagucuaauugaaugcuggaugguaaggacuuacaguuuucacuuagacauuauucuucacuugauuugcuuuuuuaauguuuucaggucauuuuuuucccaagccccuugcuuaaguucuggguuuuagacauuuggaauguaauaaacuugaagcuuauuugagaaagaugaaauugcuuauuagcugcucccaaacagacagacaagagcagggguaugauggaaagacagagccuguagguuuuaaaccaggaccauucaauauuguugugaggccuaugcccuaacuuauuuaaaaguguguuucaguuauaaacacuaauauaacucugagacguuauugguguguuuuugacuuguuggcuaucguuaaagcagauauaggaauaacuuguuucuagaaaacugcauguagaaauuccaaauauuagucgacauuucaacugucagcgucaagauguagaugcagauguagauguagauguagauguagauguagauguagauguagauguagauguaggugaacuuucuccauuugaugggauagauggaagaaaauaaagcagguagcaacaauagaugaauggaaaugaugcucgggaaagucugaaucaccaccuugcaugacacauuuaagcaaagacaacacacagcugaugacaguaguccacucucaagucuugcuguaugacuuguuucagaaucuuaaaguuauaauggucuugauaacuacauuuuugugacagauauacagcuaagagaugugcaacgacgugaaugaauaacuauaguauuuauuccauuucuuaggucuuuuucauccuugaguaccuauaagcagaaguauuugcagguuuuuauaaaaguagauauuaaucuaggccauuugauguggcacaucugacauguguauugucugauggaaaagaacagugauugcuuagaauuuuuuuuauguuguucuacaauuaaguuagaaagauauaauaaccguaucaaguacaguguuccaaauacuuccgauuauucuacaaugcucaauuucuguuuuuugguucagagaauccuguuauguucauuaguauucuaaauuaauuugauuuuuuuugcauucuuuaauuucuugcccccccuccccccccccaccuuuuuuuuuugagacggagucuugcucuguugccaggcuggagugcaguggcacgaucuccacuuacugcaaccucuaccucccugguucaagcgauuccucugccucagccuccccaguagcugggacuacaggcgcaugccaccacaccuggcuaauuuuuuuuuguauuuuaguggagacuggguuucaccacguuggccaggauggucucgaucuccugaccucgugauccgcccgccuuggccucccaaagugcugggauuacaggugugagccacugugccuggcccaguaucuugccuuucuuucaagaaagugaaugcaaugaaaauaauaucuacauguuauaugacaucgguagaagauuuuauggauuuuuugggggagugcucaucauuaaaaaacaagcuuagaccagagaaugcaaauccuauuuugauaauaugugauuacuugucugcuguuuugcaugcuguauuugagcuacuugaauuguagguaaaauugcauccucuguauugaauuacuucuuguauuuuacaacuacuacauccugcuuuguguuuuucucauuuuagugcuucucuaaaacaaaagauugcaauacuguuuucagaaauaauaguuccuuuucacugcacauguauccacuuauuuguaagugguuuaagacagcuguucauugauuuuuuuuaaucuuugcacauauuccauuuccuacucauagucuggcucagaaaauaucuacugggcauaauacuucaaaauaaauuucuggcuacauagguuuuuuuaaacucuugucagugaacuuaugaggauuuuguucauuuucuaauuauucuauagaugcacugucaugacaguuuucuucuuauauauaggauuugguagcugguaaccuuuuuguaauucagauagaaauugagcaggucugugcuuuuuaagaaauauguuuguuuagauguguggguucuucccauuuuuuuguaguagucacccaggagauauuagauaaaccagaguuaauaaugaagguggacuugaaccaucuaggcucaaaaaauuguaugccuggaccauagucucccagcugugggcuuacauuuuauauauguaucuugcauguuuucauuuacucucgcucuuuguucugguuugacugguagucuuucuucuggauacaucuauaggguagaguaggaugcugcaccaacugugcucccaugguagugguggauuccauuugcugagucugaaugaucuugcauccuugcuuuguugccagguuugccaaagagcgcaggcugagaauauggagagacuauguggcucccacagcuaauuuggaccaaaaggacaagcaguuuguugccaaggugagucauucucagcaucuugauaugcauaguggacauugccaggcgaguaauaauacaagaauuugaacaauuagaaaugcugaagcucuugaaaauuucaaggcaagccaguaggaguguguguguguguguguguguguguguguguguguguguguguguuuauuguaggggguuuagaaaccauuagacuauuuaaauuucuuuguaaauuagcuaacuucaaacuagcuugaaauaucucucauaguuuaggacuucuuuuuuaucugccuagcaaauagcauuaucuuaagauuuccuauguccaaguauagauggucccugacuuaugcugggucgacuuaagauauuuugacuuuacaguggugugaaagcaauagauacucaguaggaaccacauuuggaguauccauacagccauucuguuuaucacuuuuggucuaguauucaguaaauuaauuaaaugagauauucaacacuuuauuauaaaacaggcuuuguguuagauuauuuugcccaauuguagacuuauguaaguguuccaaauguguuuaagguagguuaggccaagcuaugauguuugguagguuagguaaacuaaccuaagcaaaaguaggcuaccuaaccuaagguagguuaggccaagcugugauguuugguagguuguauuaagugcccuucuuuccuuccuuccuuucucccucccucccuuccuuccuuucuuccuuccuuccuucuucccuuccucccuuccucccuuccugccuuccucccuuccucccuuccuuccuggcugaagagagauaaaugcauuuucaacuuacagcauuuucagcuuaugauggguuuaucaggaguuaacccuggugcaaaucaaggagcaccuauaaauauaugaccucaaguuucucuucuuucuguuuuggagcucuugguuccccgccccaccgccccgagaguuuuccauugauaugucuugggauagacuacuuugaagggaacuagagcuauuauccuuggugguaucagcagugcuauaaaaauguuuuuucuuaguugcaugguuuuguaacuugaguaguagaccugcucucugugucuucccaaaaugcuguaauguuuuccagccuauuuuuacuuuugccaagagaugcuagaaguuuuguuuuuaugggcuaaaagugguuaagugccaaauucuuggacugagagguucugucucccugucaacuaaccaugaguuuaggauggaaagccacuagguggcacugugagccugagaaagucugucuuuuaagcaaccucugaggaacuggcuaaauuucuucacucucuuuuuuaugaugcccaaaguaauaggucacagaguggucuaguggccucuuucccucuuuuuguaggugauguccaggcagcugugaggugagccaaaaucauuccuuuugguaggcaugagugggacuugcaccuguugggauauccuggcauccuccaggucuuguugcagaccacaaugucccuucuuugugaggcguguacguguguggacacuuggacauggcuugcucugccuacuuggaacucacucaguugugcuuaugcuucccguaguuagcauagcuguguuaacauagcuacagaaugaaaggaugauuuuucacccaaaaagggaggcaggccuucaauuuuucgccaucuucacuuugagagucugugacauuagugauguagaugaggcaugugaggaucuuaguacccugucguguuccuaccagccuguccucuauuaaaacugaguuuguagaaaaaccuagaauauuuugaagaguuuugggccuuggcugguuggggaguuaacuaaagcacugcauaagaacaaaauucaaaggauuuagauuauugagcuuugcauuuaucuuaaauaugacuuuguugguaauuagaaaagggagaccuaccuguagaagaauuuuuuccauuuucaaaaaucuaggauccuaggaucuguuuuuucuuuaaaagagagcgaggcuuuuaucaugacaaugaaguuuuauucauuacagugccaaaguagaggagauugccucuagaaaucaucugauggagaauuaugaggaauaaccaaucuucuguagaaauugaaacauaaauugagacuguuuggguacacguccgcuuagaggguagagagaaaugggaaaagaguuuuuaaaacuugacuuuuaaaaauucuuuagcauucguuuugcuuuuaaaacaggaaaaaaacauaaagaagauaagcauaaauacccauaguacaugaaacacuaugacuuggccuuguuuuguaauuuuuuuuuuuuuuaacaaaguugaucauagugucugucucaggguuggcaaacuauggcccaugggcugaauuuggcugggcacuuguuuuugcaugaucuguggauuuuacacugaaaaaaauggauuuugcguuaauaaaaaauauaucguggcaugugaaaauuaugugaaauuaaaugucaguaucguaaauaaauuggaacauagcuauauguguucgcuuguguauugugugugucuguucuugugcuauaauggcagaggugaguaguugugauagaaacugcguggccugcaaagccuaaaauauuuguuaucuggcuuuuuacuuaauaguuugaugaucucugaucuauaccaguccuacucaaaaugccuugauaaagugacauaaggagcuugggccagaauguaaaucaaggcauuacuuccuucaucaagaaaagcuuacuacaaaaaaaaaaaaaaaagucagcaauguucuuagugauguaguugauuaauguucuaguacaaguuccuuaucuuacugcagacuggcagccacuuugaauagcacugaucuguacucuuuuguguguaauuuuuaaguuugcacauuuuuauuuuuaauacagaaaauuuaaaaauuuuuuauaggcuuacuaaagaauguaccaguucaauuucacucuuccuugaggcagucacuuucaacucuuggcuaauucaucccugaauaaaacauuuacauggcuauuucuuaauuuuucaguuuaagggcaacuccuuuccuucauaccauggaagaggaggacuuaguuuuuucacauaagcacacauacucaagagggcgcacagugcucuuacccaguucuuccaauaugauuaugucauaaguuaguuaauagucaguauuuauuuuaagugauaaucaccacagugcuauauagcauauuauggcuacuucuaguuuccugcaaaauuuuuuuguuuucccuggaguuaauaauuuuuaaaauuuacauuuuuuuacauacuuauuuuaauucagccuccaaacucugucuaaaucuccucucaagaggagauucauucagucugcuaacaguaucuuggagcuuugcaaccugcaucaaucuggacugguuucucuuuuugccuguuuuagagcugucaucuuuggauuucuucaccauuguccugagggauuucuuugccuuacucuuggauuggagcuaggauugcuggaucucacagcuuucucuuuauaauuugcaacuuuguuuuaguggcauacauucucuaacuucauggcaaagaaugcuugggagguaaauuuucugagaccuuucauguccauucucuacauacacuugauaguuuagcuggauauagaauuuuauuuuagaagucauuuuccauuagaauuguaucuaucaguaucacuccacugucaguaguuaucagaaacuuuuuugauuucuaauuuuuuuauggaucugaaaccauccugauuucuuauccuuauauauuuuuuucuuucugaaagguuuuagcaaauucuuuuugauccuaguguuccaacauuucauagcgaugcacuuuguuuaucuauauuugagcauauuaugccucaauguuuaguuguuuuguucugagacuuuuucucccaacucuuuuguugguuuccaucuagaaucuuuguucucuuuuuucuagaacuccuauuauuugguuguuggauuuugugggcucaucuuccaguuuuuuucuccuauuuucugucucaucuucuauucuuuuuagauuucuuuauaguuaccuuucaguaguuuuauugacaugauacuguuuuauuuuuuaagaacuuuuuuuguucucugcauguuucucuuuuacuauuuuaaaaaauaaaguuuuauacugacuucagagauaaaaaucaucucuuagcuuucugcgaaauugauuuuuuuuuuuuuaguuucauuuuuacugcgcacucacuauguucuucaagccucuccucuccccuucuuggguuauuuuggucccuuauuuuucauauuagaggcuuuccucagauauuugcugagucuugguuuucugucuuauuugagaauaagauauuaaaacacugaguuuagaagcaaugacccuagugugggauuuaggguauacauauuugcuuguuuguuuuugagacagggucuugcucugucacccaggcuggagugcaguggugccaucacagcucacugcagcuucaagcucaugggcuuaagcgauccucgugccucagccucccgaauagcugggacuacaggugcacgcuaacacaccuggcuaauuuuuaaauuuuuuguagagaugaggucucccuauguugcccaggcuggucuugaacuccugggcucaagugauccucccaccuugagcucccaaaguugcagggauuauaggugugacccaccaugccuggccaggguauacaucuugaaauccaucugcuucuuacaaagauuugaaaccauccaucauuuuuggucccauuuucauucccaauugagaugcuugauuugacaguuucugagucuuggcagauuagggagagugggacugcgguauaaaucagauugccuauuguguuuucucgccacugucucaggauuuagcuuuugugagucaguggaguaaguuacuacucauccaucugcuuuccagcuuccaggguuuuguugcaguguucucucucauuaucuucuuccuuuugggcuuauguauagauacguuuuacagaucccuuuuaucuagagguguuuagagagggacccaaaauaaagagcuuacuucuuuaauugauguguaauauuucauuguaggcugcaacauaauauuuuugaccagucucuaauagguuuauauucauguaguugagaauuuuuuucguuauuuagaaaguggaauaaaucuccaaguaauuggcaguuauuuccuuagaaauuauuuggcucacauuugccaaacaugucuuuagaaauguuaaccaguauauaccacuaaguguguucauuuucuaauauguuguaaaacagggauuggacagcuuuuucuuaaaggaccacauuguaaauauuuuaggcuugguggccauguggucucuguugcaacuacugaacccugccaugguagcaggagaacagacauggacaguguguaaaugaaugguuguggcaauauuccaggaaaacuuuauaacaauaugaagugggcuggauggcccuugggccauaguuugccagccuuucuuguagaacacuggauagcaacauuaaguuaaaaauggaaaaaaauacaugcauuacuuuucauaaccuggaacucaacagcaguucuguaucauuuuaccugauuuaaaauaucuguuaguggcaaacagcuuuuuucagggaauccuaaaaaaguucuaagauaccugggaccuucacauagucugaaaguccugcaagucuucccugagugauucugcuuucaagaucaugugauugugaagccuuaacaaauagugauucucucuucaacaaucacccuguuuuuuaggaauuaauuguacagggccccgcuaaaagccucaaaagccugcaaaggguaaccuauggccucuaacuggaugccucuggggcucuacaguugauuucuggaacugaggcaaagcuguaggucagagugccaagaggcuuauuaagccugagaaaugugaaacuugacaaaguauucucugauacauguggccuauugagagacugguucccuuugucugcuuaagcaguuuuacuucuugaggaaugaaaugcaaaggaagggcucuccuugucuuuccagguuagcagagaagcauguucacuucacagcgauuagcugagcuugcccgagacuuuugugcccgucguggccugccaguucccucccugccuucccuguggcguuuuagcugaucugugcuguuuguagccauaugguccccugagcacguggcuuggcuucccuguuccugcugcuggauccuugggcauugcagauuucacagaccugaauaacauuguuguggggggugggggagggauggaguggaaucauguccucaagaggugucuccuuaccacccuaccugguuagaggcuucuugcuugguccucuguaccuauauauagauuaagcagagcccugaacuaggugcuuugaaaagauguaaaauaacuagaagugguuccugccuucaaggagcuuaccugcuagggcuuugucugggagcaguaagugguuaacuggcauugguggccaaguccaguuuuggagaucaggauauaaacuguccauggguacaguagauuuuaaaauguauuugguuuuauuuacccugauaguuuuuugcugugcuuccagucauagcucuagauggaguucauuaucaugucucugagaauuuuuuuccucaaauuguuuauaaugacaaaauucauaacauaauauguaguaucuuaacgauuuuuaaguguacaguucagugguauuuauauucauauugcuauguagcuaucaccaccacauaucucuacaacucuucauuuuauaaaacugaaacuauacucauuaagcaauaacucuacaucccucuguuuccccucuuccaggcccuggcaaccacaauucuacuuuuugcuucugugauuuugacuacucuaaguaauucauauaagugaaaucagacagucugugucuuugugacugucuuauuucauuuagcauaguguccucaggguucauccauguuguuggaugagucagaauuuucuuccuuuuuaaggguaaauaauauuccauuguauguguauacauuuugcuuacaaccuguucauguguccauggggacacacuuggguugcuucuacauuuuaacuauuaugaacaaugcugcuaucaacaugguuauacaaauaucucuuugagacccuguuuucaauuauuuugaguuuguacccaaaaauggaauugcuggauuauaugguaauuguauuuuuaaguuguugagggaauuacuauauuguaccauuuuacaucggugcacgaggguucuacuuucuguacauccucaccaacauuuguuauuuucuggguuuuuuuugguuuuguuuuuuuuuuuuauaguggccgcccuaauaggugugaggugaugucucauugugguuuucauuuguauuucccuaaugauuaguaauguugagcaucuuuuccugugcauuugcauaucuucuuuggagaaaugucuauucaaguccuuugcgcauuugaaaaagaaauuucaacuuuucuuuuagauucggggauacauaugcagguuuguuacauggguauauuguuuggaguaggaaugauccagucacccaggucaugagcguaguacccaauaggaaguuuuucagcccugguccccucccuuacucucccccagcucuaggaguccccagugucuauuguuccugucuuuaguccauguguacccagugcuuagcucccacuuguaagccucuuugccuguuuuuuaauugagguuuuuguuuuuuuguuguugaguuuuaggaguucucuauauauucuggauauuaauccuuuguuggguauaugauuggcaaauauuuucuccuauuuugucaguugccuuuuacuuuguuacacaaaauuuucaugaaaucuaauuuguauuuguacuauuguugccuguuccuuuggugucauauuugagaaaucauugccaaauccaauguugcaaaguuucugcccuguguuuucugcuaagaguuuuguaguuuuauaggucuuauauuuaaguaaugaauccauuuugaguuuguuuuuaguuuugguguuacauaaggguucaacuuuguuuuuuugcaugaggauaucuaguuuucuuaggaccauuuguugaagacagucauuuccucauugaauggucuuugcacccaucucaaaaaucauuugacuguauaugcaaggguuuauuucuggacuucauucuguuucauugguuuguaugucugauuuuaugccaguaccaugugguauugauuacuguagcuuuguaguaagcuuugaaaucaggaagugugaguuuuccugcuuuguccuuuuucuggauuguuuuggcuauucagggucucuugagauuccauaugaauuuuaggaugagcuguucuguuuccauaaaaaucaucacugggauuuugauaaggguugcauuacaucuguaaaucgcuuuuggguaguauugacaucuugacaguauugucuuccaguccaugaucaugggacguguuuccguuuauuuaugucucuaauuucuuucaacaguguuuuguaguuuucuuuguacaaguuuuucacuuccuugguugaguuaauuccuaaguauuuuguucuuuuuugaugauacuggaaaaggaacuauuuucuuagguuuuuuuuuuuuuggauuguuuauuauuuauagaaaugcagcugauucuguguguuggcuuuauauccugcuacuucaugaauucauuuauucuaacaguuuuuguggaauuauuagaguuuuuuaccuauacgucaucugggaacagugauaauuuuauuucuuuccuuccaauuuagaugccuuuuguuucuuuuucuugcugaacuucuuuggcuaagacugucaguacuauguuaaauggaaguggcucucugacaugguuuuuaagcaaggaugcagcugaauauuuuuggcauuaucuggauuucuccaguauauuccuaugugauaauauggagagaaucaaaaaauaccugccacuuccuugccuuuugccauuugacuuucaguuggaaaggaaguucuggagauugucucacuagaaaggugggcucugcugaaccaaaaagggaucaagacuugguuugcagcuuauacuaguaaaccagugugcugauaagaaaaagaaagugauugaguuagaagagauugaaagaauauuaaccuggcuuuaaaaauuaaauuauuagagacuucauuuuuuaggucacucuuuagauuuacagaaaaauuaagcagguagcacagaguucuuauauuacucauccacccucagcccaguuuccucugucauuaauauuuuacgggaguauuguauuuuuguuauaguuaguauaucaauauagauacauuuuuauuaacuaaaguuuauauuuuauucagguauucauuuauuuauacuuuauuucuguuccaggauaccacauugcauuuaguugucauaucuccuuagguuccuuuuggauaugccagugucucagacuuuuuuuuuguuuuggaugacuuugacaaucuugaaguacuggucagguaguguguaggacgucccucuguugaaaguugucugaugccugauuuccauguaaguacaucuuaagaguaucugguuugguugugcuuaggugccuggaagugccugcaucaggauauuguugugguuuguuuuuguugaggacaaggguggcagcuguacucuucuaggggacuggggagaagagacauagcauacaaccuuagggagugggaaaaacagccagaugucaugauuucagagaggagaauagguaucugugugucauucucagugacgucaucaaaccacagucucuggucaugcuuguagaaggcccuuuugggcugagaauccuuuuguuucuaucugguacuggaaauuuuggcagcauuggggcuauuggugguuauguccacagcucaggaagcuguugaacaaaaaggaagcuuuuuuguuuguuuuaugugugcuucaggguuuucagaaucugaauaacagcagcccguugcacccagugagcgcuguggaugggcuguacagaugagagagugugacagaggcugaagauaggcauggauguuccccuaacggaacucugguuuucuugacucauggcagcccuuagccuacaccuuauuaucauuaaaccauuuuuuccuuuuaugauugggcuucaagaaauggggagggaauuggauuuagugcauguauuugaguccagcuaaugacuuuuuccauguagacuuuugcuccuaugccuuagguuaucucuugguguguggggugugagcgugcaugggguuggcuugauuagagaucuguagcuagcagagaaagugggcagugugggcauacuucaguuauccugaugaaaagcaccagaagaaauaucacuguuaaaaugugguccguaauggugcugaugagcuggcuucagacaguaauccacucugcaucucacuuacugcacaguacguggcuauaaucaguauuuuauugccgauuccaugucucugcucaggagcugcuuguucucuggacaguaaugacacaauuuacagaggaauaaaaaaccauaaaccccacuuauacacacacgcggacacgcacgcaugcacucacccuuccuaucuucaccagcaagcuaaaccuugcuuagcuggcaguggcagagugcacaguuccugaagaggagguuucuaaucagggagaugcugagcagcagagagagucugcugcuggggccuaaaauuuacagcucuaagaauucauugcugccguugcugcuaacauauuacaaggggugccuaauuccaguaacuuguuacaggacauccuuagaucuucauguucuguaaucagcagguaaaggugugagcacuaugauacuuucuuugguuuuauuacucucuaagcaugacuagggagcagaaaacgucuagauauuucucgugucuugauuauaggaauuuccuuauguuuuugggaauucacaacaagaauuuguuuugguuugagagaagguguagaucuguccaguauuaagauuugggaaauccugugauguaugugccuuugauacaucaucugacaguuacccucuauccuuuggguaucuguuuggaggaggagugguauugauuugcuauaguagcuauuuugcuugguauggcuuaguggaauuuuuuuucuuuucuuuagcuugaaauuaggauaccacaauagcagauaucauggaaacugccccccugaaauauucuguuauccauuuuauaauaucuuucccuucauccaaaugugggauuuugaaggaccaggaaaucauuagcuggggucuuucuuuuuggucaauuguccaacccacuacuggaauuccauuacuguguacauuuuuacuuggcauuaguguguuuagaugguaaugggaauaagauguacucuauuuuuucuuucagugacugaaucuguauuuuugguuauacugucuagacaguuuuuaaguucuaaacucaugaauauguuuuugugauugggcuggcauuaaggggcuguuugguuugggguagcuagcccugaccuugguccuggugugaucacucauccugccuuugauuaccauuaaucuucauguuuuucuggcaagaugaauuuuggguucuggcucucuggguuuuaguguuuagccuaugauucucagaucugucaaaaagguuauaggagaaugguuaugguuauuugaaguugucguuuuccuguuuucaggguuguaaguuaauuuuaaguauaguagaaaauuaaaaauuucuccugaucuacucaguucuuucuuagaacuuucauuacuuuucugauugcugggcuguucuucucuacacugcuuucauugcuuacagugguaaaacccagggauaccuucccauccaccagccauaguaaaccuucuauggacuuacagauugauuccagcugucaucuuuguuuuuucauucauucuguuugauggcacuuaacuccugcuguuuucuguuacauauaauuucucacuuguuuauguuuucuauccuucuugagauuguuucuuaaggcauuccuuacucuucggugugugguugguugguucuuuguguuuccgguguguggcugguugguucuuuggaaaagguagagaauugcuguuuuuggaggaagcugcaaguaaaugaauacauucugugcuagaagaucuaaggccuuucaagaaauaguuagagaggccuccuuuaagauacuuaucagugugacauccaugauggcaaaaaagagucuagcuccuuuuguuucacgcaugaaagaggagggaaauuuugccaguccgcccuugcuguguggcagcugacccuguaaguuuguucagucugguagcucuuaaagaggcccgauugaagccuagaagaguucgauuuugauucugcagaugaaguagauggugauaguguuuuguagucugcagcuaccuuguaauaaaguguugcuucaaagaaaaaaaaaggcauugaauauaauugggcaaauuguagacugcuggcuguauuaugcguucuagcuacaacacugaugugguaagaucccaguuugaauggaguuuuauucugcacacauuguagaauguucuaauaaccuucacagaggaguauuuaugcuuuuguccuuugacuacauacccuuguaauuuaucccagacuaguucuuuuucuucugagcgugggguucuguguuacugaucuuggguuccaaaacaaagauguccguaguaguagugcucugaaaagguggcuuucagaguaucugagguaauaucucaguaauuucauguuucugccugugagauuaacagcugagcaucuccuuucccaugcugagaugacaauucuuuuugcccuucacuugccuuugauuuuucugcucucuauuggggcauccuauuuugguucuuucucaucuagugcugguaucuucuucaaauccaacccuugccucuuuuucuagauucacauugagauuuugauuuuaguuuagaagcuguuucaaggaaaaucuucaauuacauguagagacaggauuuccaguucuuaagcuuuguagugaaccacaaaucuuugucagggcaaaaauaaaaaaagauugaccaucuuuaugaaugauacagauuuugucucauugagaaaucauaauaaggucucugggaacugauaauuauagcauaguuuucucugacauuguugcaccaugaaggaugauacuguuuuucccacaaauggcuauugaucucacuuucuaccugugaggguggugggccuugcucuuggacaugugaugggggccauagaagcagguuuaagcauguuccuuuuugcucacaggugaugcagguucugaaugcugaugccauuguugugaagcugaacucaggcgauuacaagacgauucaccuguccagcauccgaccaccgaggcuggagggggagaacacccaggugagaauagggaagcagccgcgccucuuugcauaaaccaaaaggaagaaguuggagaauugauuaauauaugacauauauaauacauauaugugggaaugcaaagggacaaguauuuuaaaucuccacaguauuauuuucuaauauuuauagccugacuacuauugggcaggucucagugucuuguggcccacacccacugcucugccgaauuucacgugggcacuguuggcacuucuccccagggggcuugagugcagugaggguugggauaugugagaugguggaugaguuuaauuaacaagaucuuauuuuucugugaauaaggagaggagaaggucuguaucucguguacauuguaauaggacccguuucugcuggucauuuugauuugauaguucuuuauguuuuugcucuaggaagaaaugaaucuugguauauguauucacuggggucaccuacucauuuuuugcagguaguaacucuaauuaguaguuaaacuguuugcuauuuuuuggaucuuuuggcagauagguugguguaugacucagguauaucauuuuugagaaaugcuuuguaugaaaacucuaacaagagcugguauuacaugugcagauagacugauuuuuuuuuguagucaugacaguuauguagccauaagaguuaugagaauugggaauagggauuaagguugaaaauuuuuggggauuugguuaugucauauuuuuacagacgucuuucccgcuucuguuuuugucgucugauaacuaaacugugugauuauguuaacuaguuauagaacuaguuccucagugagagccagcgccaaaggcaaacauuuggacaguuuucaguaauuaacuauuguggauugaaguuacugcuguguguacuaucuacugccugcuuuuuuuuuuuuuuuuaagaaacagggucuuguuauguugcccacacuggagugcaguggcuauucacaggugugaucauugcgcccugcaacuucaaacuccugggcucaaacaguccuucugucucagccuccugaguagcuaggacuauaggugugagccacugcacccaacuuaucuaccuuuuuuuuauuuaugccuuuauacaaaaaggaugggauaaaaaaaaucccuuuuguauaaagggauaacuaaaaaaagguagauaaguugggugcagugguucuaaaggugugaaauuugcuauucugauguuuugcacauauacauaucuuggugcauucacaaguugaaauucagcauuguuuucauuugugugagaguuuauagacagcccguaagaguaaaauaaaaauaugauugucuuuugaaucagaucauacauaaaaaccacguacaggaugggugauuugaaugucuggccaaucaguucuuucucucucuuuuuuucccuuagaggaggcaguuuaaugcagcaaacaguauuaugguaagguugagaauuuaaauguaugaaagccuagaaaugccaaaauaagguucucucaguaacuguagcucugccucauugcacagaguaaauacacaucuccaauuuuaucaguauugggaguaguccacaauucugcaucugugccguacaguuggaauuaagguucccacagcaaccacaacuuugaaauucuugaacguuaauuuuugugccuguaucaucagccagugcauuauguuaauguagacuauauagcugaauuuuaagcaguuuuuagggggauggggguguuauagcuuagguaggaugauagcagguuuucugaaguaagcacuaaccuacuacugaguauuuuuagucccaguauccuuuggaacucaucaguggguaaacgaugcauuucccuuagccuacuggcugacaggaaauuguuggaauuggaguauuuccuaguuuaggcagaauccugauuauagaauuucuugucucuuacaaggcguguuaccucuuuuuuuucuucuuuuuucuuuauucuuucuuuuucuuccuguucacuccugagaucuuacuccauuuuaagacaguucuaaguaagacuuagcugcaauaaucuacaacauauggcuugugaggaagauggaggaaugauuuccauuauuugucuguuaaaguccuuuggaagaguuuacugaagggccacguaagaaauaaguuaauauaaugaaccuugaauguagugguagaagguacccugaagaguagccgguuuugguggguggucugggugaucuucccaggucagcugcuguaccuugugagugucaaggaugagaagugagucaacaggaggaauggcucucuaggccagcgcuguccaacagauauauaaauaugagccacacaugugagcucuauuuguuauuuuaaauuaucauauaacuacguuaaaaaacuaaaaagaaacauuaauuguaauuuuuaaauuugacuuauauccaaauuauuauaucauuucaacauuuaaugaauaugaaaaauaaaugagacguucuuccccuuuuuaaaacugaauauuugaaauaugguauguauuguacauuggcacuacauuuuaauucaucauagcauauuucaaggacucaauaggcacaugaggcuaguggcuaccauuauggauagcacagcuuuagaaauuugcaugaacagguagucauuguugguacauauuuacagauacuuauuuugugccagauacuguguugggggugcagcagggaauaaauagaugucccuucucugccucauggaacuuuagagucuaguaggggaaauacacaaguaauuucauuuacguuaagugcuaugaaagaaaagcuuagaguuuaggagagugcauaguuugggaaggcuacuuugaggaagugacauuuaaggccugaagagauauuaggaauuagcuagauaaaaagugggagaagacaguuucugaccuggagagcagcaaugacaagaaugaguuuuggggacuagagaauggauggcuccuguggacggugcaugagugguaugacaccugugugguacgaaaccacaggcaaggccagaucaaacauguccugugaacaucuuaggauacucaggaagggagagagaaaauggggcauaugaugaacugcaagugauuuuguaugacuggaauagaggauaaauuucaggggaguguuaagaaaugggccugggaguuagacagggaccacuuguugaaggcuuauaugccaugcauuuuagguuuugucuugaagaauuuugaauuggugaguggcauguuuggauuaaaauacucuuguuucgguuguuugaauuuacaagauaugaaagcaguuugcauauagagagaauauuaugccugguaaaaacuuacuuuagcaaggaacucuggauuuucuuuugguaaguuucaguugaccaaagaccuggaaaauggcaugaugaagaguuaaugucuuaggagacguuaacucuuucaggcugaugagugagaacuauggaugcugcuccagcaguccuucuuuauacuugccuuuugacuuaaagaaauccccccacgccaaccccugccccuuuccuuggccugagauuacuaaaagaaaaaagaaaaagaagaagaaaaaagaauuccccagagcucuuauaaagaauacaagauccugcuguaugcuuauguuaaaguuaccagagauuuacaauaugggugugguaagaaacaucaccugggcauccuagugugacuguaacuguauguguuuaaagacugagcaacaggcauccucucggagucuuagguuucugguuucauuuacuacguaccagcuguuacagucacaaguggagcccaguugaguauucauggcauagauguuggggccaggaccucuguuagcucauauggcaucuuugugcaaauuuagagaaggguacugcuucuuccugucagcaucaugccaggggccauggcuuggcaagcagaauggaagcuaaauuuuagcuccuguucucccuuuguccgcuuugccagguacccuucugcaaggcacagcauggguaaaaauaugggccugcccuaguuagaacaggcugguagaaucuccaaggaaaacaucaagggcauuuuuuggaaauugaggagugguuuuguaguugcggaaacauggagugcuugaggaauguuaagagaugaaggucugugauggauggacgguggagggccuugaaagaaacacuaaggacauuuccuucucucuaauuacaggacucugccugggggucaauggcuuuggcauggaaaggauaaccugaaaacuuacgguaccagagccuuuuccaaaccaaagaacaaagcgggagagggugcagaauaaggaacuagaugaguaggagaagagggaaagucuguggcaugggcuuccucaaggacaggcagauggggcagacauuccuguucuagggcgggccuccacugcuagcucccagaugaggacucaaugggacuuucccuucaaggaagcaugggggagguucuuuuaauauuuucuuccuccgagacaacucuacauuuggaggguaguagggcaaauuguuuuuuucuguuuuguacacagagacaaguucauuucucuuaaauuauacuggaagaugagcuuuuugccuauggcuaaccauauuucugcucccuuaauuugguuacuuucuaauuggagccagaggaaguacuuggacaaacacugugaucaaaggaacuguuuucauccuaggcuuuccaauauuacccggaaauucauggguagccacuucuggauuuugguuggagcuugguuuguuccuagauaguguuaugcgagaguuaaaaggagggaugugcaauauuucccucucuagaauucuagcuggauuugucugauguugacgguguuucuguggcacccugcuucuggauuaauccagugucaacccguaggagacguuaacucuuucaggcugagagccaguuaagaaagcugacgugugaugcucuugugaaccuggccauguaucaggguuucucuaaagguauaguuuguuuuauccaguuguuugcuauaaaggaaugugcuaaaucuuggagaaaggcuguggguuuucugagcugcugccuuaaaggagauaacacauuuugcgaucucaggacuuccuagagagugcuuggcuuugaucugaaacuggaaagccuagugcucuauugcccagggcugcugugggcuuuguguuacacuuggaguguuaaugacaaaggaaacagcccccaggcauccgaugaaggggcugacuuauucucccugaagucuguucuugcggugcuauuguaguugacuaagagauacagagcugaaauuuaccuugaaaacagguacauaauuuacccaauccccagguguauaaaauuugcuuuagguugcugggccuuuuucucagauuccuuuucuuagcugucugucucucccauucucugucuuuguaucuguuucucugucucugacagcccccacugccagcgcucccacuuaguauuuugggaaggaaguguggaaacccaaagguggagucuuucccucagcugguagucacccccugcuaccagccucuauucauuuccaucacccugucuuuuaguguccucccugugaauuuauuuaccacauaaagguuuguucacaccagggccuccaaauauucagacccgggugcuaaaggaucaguuuuguuaaagcugccauaugcugaagcccccaguguccuuguugccuuuguuuggggaguucaucucccagaccuggcccgccuggcucuccagggcaggcaggugggagagaggagcugagauaggugcauuauuagugaugccuugggauucuuaagggcuuuuugucagaggcaggguuauguaaggcacugauaacuccauucauuguaaggggcuccggggugcuuugccauuaaaagcgauuuucaaccuauucccuccaguuuagauuuguaaaggcaaaaugacuggucccucuggacccucaagccgacuuugccgacucugagacacgugccaacagaaagcugugggguuagagacccuaagugaaauuggagcaggccaguaaacccacucacugugaucuccugcuuguuacugggagcauaaggcaaauagcaaauuagagagggacuccagcuuggcauuaaggaccuuggagaaaagcaaaagcucuuugaaauggauauagcauuucaccagucuccaauggagagauuuugggacugcagcaaugugaucaaaagauguggaauauguuagaggcuggcguaggcauucuguacgaguuucaaauuuguuucaucugggcauuuuugagaagaacacuugaaaucuucuuuguuagaagacugaaaaaaauuacuauuagaagacugugggugggucuuagcucaucuauuuaagauuccaggauauauauguccugauuuuuaagauuaauaucuggguaccaacacuuaaaacaucccugugaccuguuccucagcaguagaggucauggaguagggguacaagccugccuccuucugaugaggucaagacauuugguaucuggauagauagcagacuuugcugaagugcacauuucacugaucucucuaagugaauuuuaaacuggagaagacagcaugugccugucuuguugcccuuugauuuccuuucuucuccccauuacaaauuauauuuucuuucauuuccuuuaguuauauauucccuuucccaggaucuugcuuaucuccuucacauaauuuuuugggauuuuaacaaucuccuagucuuggugguuuaucccugaacugggugcauuuacuucuaucaauccauaucucucucuuccuuuaaucaucacuaucacacaguucuacauuuucaauuuaucuaaaucuuucuagugcugguguguucacauuucuugucucuucucagucucgugagcugcaguaauucuguguugcuuccagaguugucagcaccaucauauucacugcccugugagcauuuacuguacuugcugugcugagguaacccucuuccuugaccuaguucuugaaggccccuuuaggccagagacuuccauacacaccaucuuucccuucucuguagcaucgugcacuguuuauuuguguacaucucuaccuuccauugugaagucucaccucuaccaaggccaggaauggcagggucuucccagcuucauaucccuucuuucagaaucuuacagagugcugugaauaaauaaacauuuaauaaauguuugaaucagaauaucugcugaggcuuagaccuaauuccauauauugcuugugagugggcaucauuuuuaccaccucccaauccauggcuaacccccuugacugcucugacagccaucuugacuugagccaaugugcugguaucuaacuaucuccggagggagguuuuacacuccuguuuuuuacugcuuccuaauuggauugcuuguuuugcuggcuaggucacacauggcuguuuucuguaggcacuucuucuucuacacucccaguuuuaaucuaguugcugccauuggguugacucgcccugccucucucuguguggugguuuuccucauaauguauauuccauuagcacagugaagauugaguucaguccaccagagggguuaauuucaggauuuuaagugcuuuugaagauugguccccaauugacuuucuuucagcaccucuacucugauucaggcuuuucugaauaucuuccuuucauaguaguucagguaucuugauucauugaaguuuauaguugcaguuuuuacugagggguauauauauauauuuuacuguugucgaccuuguugguugucagauuauuucuuugcuuggaacuaauuuuaaaaucaauuagagaucucucccuucaucuuucucuuuuauuuaugagauacugauugcagagcuaccuacacuguguuuagauaaauuacuuuuuuuuuuuuuuuuuuuuuuuacauaacauuuauauucaaggcaaguuuagugcagucauccagugcuucgcauuuuugcaggcugggcuguagguuucauuccuuggugggcuaauuagcuuuguacugggaaaauuuugugcaauucagaaaccaaacauuuaaguuccuuguguacuuuaggcacuguaggucugggaaauuauuuuuaugaauaagguguuuauaauuuuaggauccauaucucuaauccugacaaguauguguguguguuguggucggucaccagguagacuuuagacuggaugauggauuauggaugaagcagcaucauuucugucacuguucuagaaaaaagcuuuucauaaccgagacuggaaugggaagcugaaggacacaaaugauuucccuaccagaugacaggccaauugcuuaggcauauuuuugaugucacuuuucauuuuagccuuccucugaaaaucuacggucaauuuaugggcuguucacauuggacagcucuuuauuuauuuauuuauuugagacgaagucucgcucuuguugcccaggcuguagugcaauguggcgaucucgggucaccacagccucugccucugccucugccuucaagcgauucuccugucucagccucccgaguagcugggauuacaggcaugagccaccacauccagcuaauuuuguauuuuuaguagagaugguguuucuccauguugguuaggcuggucucaaacuccgaccucaggugauccacccgccccggcuucccaaagugcugggauuacaggugugagccaccgcgcccagccugacauuggacagcucuuagucucaccaucuacucugauauccgucuguuuuuggcaaaugccuuugccugguuuaguaguguauugguggccaccaaggaguauugcuguuucacaguagggucucuauucaguuuagcugugaagacauucuggagacuuugucuuccuugccuuuucauuucucugcuagaagccacuugauguaauagccuucauccuuguuucacuuuauugggcaauuaguguggauaagcagaaauauccccuuuauguguguucagacauuggucucagaaucugcuuaccucugcuguccugcugguucuggauagcccacaugauggacgccuguaguucugcuguaaaauacuuuuucauuguuuucugcauuuuuuucuccuucucuacucaguuugauuuuucugggucauguagauuugucauuucuucagaucuguugcuaacuaaaugucuagcacauaguugauacucagguguuagauagugucucauugcauccucacugggggccuuuacucauuauucauaguuuggggauauagggaugggcagaauaugcugacacuuggcuuucugauucuaccacucugccuuuccuaggacauguuccucaucacuacugggaacgcgggacuuuuuucacaugcuguugucuuuuguaaggugggccacaauuaggagaaagccacauucauauucguauggagcugccuuuagcagcaucugcuucuccagcuggagaggcuuguuuuagaacgacuggcaugcggaagcgguagguggaggucugggaggagcugcguagccagggcuccccuuccagccucccgucucccuuaggcucuuucuggccugaggcauggucgccaugggugggggcacugcccgcccgauucugguuggacccccuuuccucuacuucauaccgcagcugcugugagcgagugcacugugcucugcacaggagaauuggcagacaguuccauaugcugguuuuggccauugggacauucaggauuauuaggccaguuuguacuuuaagaggagggagacuugacaucgcucaaagcagcuuauuuuauuuauuucuauuucuuauaaaggggaaagaagcuagcccagcccuuagcuguuccuuucaacguagccggcucaacguuuuccucaggaaaacaugcaggguuccucacagcugcuugagccaggcucuguccuuccuucgcagauugccccguggcugccugccucuucacucuccuaaagcuuuuuggcuuuaccuuccuucccucacuccucccagucuucccucagaggacugacugguucuuucagccuagacacuccuguuugccugccaaguuacccuucuuccggaggugcauagccucagcacugucagaguucaggagaacagaagcuccuccagugagaagccaguuaauaacagcuuuuggacccauuguuguuauuauuagauauccauaaaaucuagcagguagagaaccgucacuggggcucugcuggagagauaugucucaauccuaaaagauacaaauuagucccagaguaccugauaccguagacggaaccugacaaacuggaaacucagugugauaaaauccuauaaccuuucaucucucacccccaucacccaguaagaagugcauucucagggcagaagcuaaugguguugaaugucucucucuugucucuuuaucuaggaauacaguggagugugcuccugugggaacacgcugucucuuugccuuugugcccaccccagagaugguggaucuggagacuucggcccuuuuggccaagcacauugucuuccuccaccugaugguucucaaaaguuuuguuuguuucuuuguuugcuuuugcguuuugacuugccagcauuucuggaaguaucugaaugguaagaguauagguaugugcuccugcuacuuuaguugucaucuggauuucuuugaauuaccuuccccaugccacacugugguuccuuccauuucuaccugcuacccucccucuuggagugcagagggaauuuguaaacuuggguuugaaugaugaggucauuucugaccaacacaauuuggucguucuauuaguuguuccugcagaccuuacaaaggaguauguugcuguucuuauaugcccuugucuuguguuguucaaaaauccucugugcuaugcuuuggaugcugcaugagccugcaaaugaaugcuuagcauuguugaaguugacugcugcccuuuagcugucuggcuuuggguucagccagaaagaguggcaucuuuaaccugagucacuuuuuaaaacauggacaacaacgaaacuguauucuaguuuucuugagcaaccacauuuaagcugcuuauuaaauacaauuuuauauucuagaaaacuacauuuguacaguuuaagcaagaccaauauucuucugcuccuagaagaaguuaaguaaauuuauaucuuaauugguaaaaucucuaaaucuguaguuuguagguauugauuucaagaagacaccucacugaucacagaaacgaguggaugcugcaugcucaugguauggcacaguguucuucauucuggcuuguuuguaaugucagguuucaacuuugguguuuguaaauaguggcgggagguuucaaaacuccaguuguuuagagacuguaagauuuacuuccuugaugccuauggaaggaaucaggcuuuagacagcugugguucaagauacuuuuuucagcuucuuucucauucccuuuuucacauccaucuuuaacuuucucucucucucuucccucccccuagcuuggucuucauuauuacugucuugguguuggucaggauuaauauaagggagugaggaaagaagagguuaguuuuauuuccccuuuucucccuuuaccuuaaguccacauugacucuauuuucugccuaauuguaaccuacugccauggauaauugagggauggaaagucccucacgguauuugagguuacugaucuuaaugcaguagaggacugggaagauguaaaaucuaaggaagcaguuuugacucucccauccccaugcuuuguauaucuuucagugaucauggugucccuaaagugauuuuugaacaguucugaagcugaggaguagggacucuuuguuauuucuggcugcaguuugacuuugguacaucugucuuuuaccuagguccccuucccugcuagggaaauuauguccauauauaugguucuaagguauccccugaugcaaaguuuuacaagggcaaaucauuugauuguuaacuguuagauagauucacugcaaauauggcugcccaacauuauugcuucucauuugcuacaaacgagcuccaagccuucuggguuugcacaggacugcucugaggacaaagauuaaguggauuucuguugaugccauauauuuugauugcacagcagagucgcauuguguauuuggggccugccacugacugccacugcccuucuuuucaugguuucucucccuccccucccucuaagcccuagcugagaggcacaggugcaugcccuguugacucucauggugaaaucuaguugagcuuuuccccuagaguagaggccagaucaguuuuucuuaagauguaguucauaagcuacuuguguuaaaaucucugaucggaauguucauuuuucacaauugccagguaucucuacugcacuucagcuugagaaccaccguucuagauuguugcucuuaccaauggaagagugugggcuuacuaaagcucuaucuccaggauuuucgucucugacaaugcaauuuuucuuuucugagccagacuuuagugcaguaauaucucugcaauuuccugugugagauuccccgcuccaggucucagagccagaugcuaagcagacaugucccucuuagcuuagaacaucuccugaggauuccagugaaaggagauauaagaguucugccugaagaaauuuaucugcuucagagaacagaguucucuagggaauaguagaguuucuuaggguuuauaacauacuauuugagcugauguuuagguggggccugcuauuuacaguuucagguugaauuuuacgucaugauaaaaagagaaaagguuuaugaaguggugccuuguuagaucuggggucacaccucaugugcaauuauauuagcugaacucgguaaggcagagaaaaggaugcagguuaaagaacgugcuugccuccagcgugugcaggcagcccucaaaugguuggaagaaaauacaggugcuuuaugguacauagagagaacguaggagcuugauggcgguucaggauacagcacagcaaaauccucaagcaccuucugaacugugacuggcacccuaacacagugugcagguuuaguguuagcggacgaucuguguuaggacugacggaggaaaucuuguccuuguucugaggccuuacaguagucuucugccgaguucuuuucaggacucagcucugagcauuacaggaugagaaaugcugucuguuagacuaauuaucugauuuaugcuaaauaaaugcacagaugugauuuaaaagucaguuuuggguuuauuaauuuaugaugcaauuuccagcugccagacagaccagaauauuuugaugggccaagggcauucuuuuuguggaggaaguuugcuuauuauuuacagagucugaguaaaggagguugcuggauacugaggaaaacugaggugacccugaguaugugccuggcccagguagagcgugaggugcugggcaugcacuauuuuguugacuccucuaccccguccuugggagaauaaugacaacuugcucaggguuccuucucugguaaguggaggaaccaggauucgaauugccuccaaaagugccaccuggaccuggagguugguuggguggguugguggucuucuccuuaguauugaguggacuucuuccuaagcuccuguuuuucaggauuuccacuaucuaccagaagcuguaacuggcugucuuuguuacuguaacacgugcuuucuuauuuuaacauauuuuuacaaaugaaaauauuuccuacaaccacuuuuggaggcaccauaauuuauaucaagagaggcucuagggcugggcaugguggcucaugccuguaauccuagcacuuugggaggccgagagaggaggauugcuucaggcuaggaguuccaggccagcccuggcaacauagugagacccccaucucuauaaaaaagaaaaauauaccuuuaauuuaaaaaaaagaggcuguaacuuuucuaaagggugaccuguuuuuuuuuguuguuguuguuguuuuuuuggagacagagucucacucuguugcccaggcuggagugcaguggcacgaucuuggcucacugcaacuuccaccucccggguucaagugauucucgugccucagccucccaacuagcugggauuacaggcaugugccacuaugccuggcuaauuuuuguauuuuuaguagagaugggguuucacuguguugaccaggcuggucucaaacuccugaccucaggugaucccccgcccgccccagccucccaaagugcugggauuacaggugugggccaccgugcccagccugaccuguaucuuuuaaauugucuugucuccuuucugaaguuuuccuggcaaugaucucaugguuuaaaagagugaggccaacucugugcagagacugaauucucccuuuuuaauagagucucaauacuagucauuuuuguacaguuucugagcccugagaguaccugcuucuaaauaguucauugucaauuuaauuuucauucauuauuuucacacauuaaccccaauagauagauggcuugcguuucugcuuucaucuucucugcccuagaaauuuuccugauuauaaaugugacauaaucacuuuauaaauuugggaaaauuuaaagaagaaaauacaaauuacuuaaauuuaacugcccagaggcaacaucacaacuguuaauaaucgcaaggccuucucacuagcuucucuguucauguuuuauaacugagaauuucuucuggccuuuaaauaauuuccugaaacaugauuuuuaauggcuaugcaguuguuaauguggacgugucauaauuuaaccagcuuucaccuauuuuuggauauaucaguuauuuccaauuuuuaugauuauaucuuuguucuuaaaaugaaaauuugccuugaaguacaaagcauuaaacggucuguucagaucagagguagcucuuagguaaguugugcugucguacaauguaugcgguuuguaccacagauacauguucccagaggggcugauauuuaguccugcuggcaguacacucucuaaucaccuaauuccuuaucuauuuguguuauuuagaagcaggcugugauccaggcccuuuguguuuuguugccagaaugcccauccccccaaacagcugaacuugcugcuucugaaauaaaggguagaguggauagguacaucuucuccuggggaccacugcucuuuucuguugcccuggcugggaaccggugagauguuuuaugggaacacaaaggcucccguggcagcuucaugcaugcagccugcaguauuuacuuguuuuggccgauaagcugcucugucggguacuucuacagugcacuugugaguauuugcacaauuacauuacagauuauuaaauugcccccuauugugauaaaaacagucacccccaaguaaguguauguaaagcaauuauauguaauuaaaauauaagagcauaagugaccaguagauaauuaaaaucacuguugcuaaagaaauauaccacacccugaccuugaggaggaugaugcugccaguucaggguuggcaggaaaucagacaaaugaggguucuccccagcuguucugucuacugugcgugaagucugaguacugucaaccuagucuuguuuguucucaagaagugguaugguggcagggcaugguggcucaugcuuguaaucccagcacuuugggaggccaaggcagguggaucaccugaggucaggaguuugagaccagccuggccaacauggcgaaacgccaucucuacugaaaauacgaaaauuagcugggugugguggcgggcaccuguaauccuagcuacuugggaggcugagacaggagaaucgcuugaaccugggaggcagagguugcagggagccgagaucacaacauugcacuccagccugggcgauaagaaugagacugugucucaaagaagugguaugguauguauagggggguuauggcucacauuguugagaucucuacagguuuaguauccccugucuaaagugguugggaccagaagugauucggauuuuggauuuuggaguauuugaaugugcucacuagaugaggaucccuaguaggaaaaucugaaaucugaaauguucccaugaguauuucuuuugaguauuauguuggcauucaaagaguuucagcaguugagcauuuugauuuuuggauuagggauacucaaccuguauaaccuagaguccgcaucucaaauacacuuuaaggcaagagggcagccauugacaaaugcagacccagggacaguguacugucuguguuccaugucacucaacaauugagcugcucauuuuuuacuggcuuaauauucugguuugaugccuggaaagcauagagaauguuacaguaauccaacccagaagugacuauaacucuauaugguuagcauguauauggcauuaugagaaaacacucucagauccucuagaguguucacauguucagcuuuguaucuucucuaauuauuuuucauguguccuuucucacugugggcagcuucuccucccacccccaaggacugguagguacauugauuacuccuagugcauucucuuagccacuggaagucucgcucuggccuuccuaaaagguguuucuuuuuuuuuuuucuuuuuuuuuuuuuuugagauggaguuuugcucuuguugcccaggcuggagugcaauggcgcgaucucggcucacugcaaccucccagguucaaucgauucucuugccucagccuccuaaguaacugguauuacaggcaccugccaccacgcuugucuaauuuuuugcauuuuuaguagagagggguuucaccacguuggccaggcuggucuugaacuccugaccucaggugauccaccggccucagacucccaaagugcugggauuacaggugugggccagugcuuccggcccugaaaguuguuuuuuuaaggcuaacguguuuaucugggagaaguccauugguaggaggggagaagacccaaaugaaaguugcaucuguuugcugcuuuuucccugaggucuuuuucuuaacucucuuccucucagagaggaucaucucuucagauaaacaggcuccagggaaccuaggagaccaggggaggaugggggagguaagagcuaaguuaccaguuucuggcuugcuuuagggggucacccuguaugacccuccaggguggucucccacucauucuuccuaccuuccugccuccacuugaauacuuucccccuguuccucucuuucuggcucuggagagcuagccuuacgagccaguagagggcuuuggaaggacacuugcaggguguguuugugugaugcacaggaagugugaguggagauauuuuaauuugugcacagguguguagcuuggagcgacauuggcucccucugguucaguucugaugaaacagagcaguggguuugugcugaaaugugucugcaguuucaguaagagaaagaauggguucagggcuggugaucauucagugauacugugucauuuguauagguccuucccugugguucugaagaauaaauuaguaucuuggucauuugaaaaaguaauuuuagcuuguagacuuccugucacacuugaguagcuuuuggaaaguauaauauuuuuacccaaaucccauuaaauguuaggcgcucuuucuauaugcccuuuacuguccuuuuacugauuagugaaauauuuaugugaacccagaaggcugauuuauuuauuuuauugucuuuuuuaauaacuugcuucucccuagugcugggugcuuucugaggcccagacaaccaucaugauuucuuuggugauaaucuucugcccuccccuggccugcauccucaaggauuacuuggagcuuucuuagcuuuaaugaagccucuagcuguucuguccccugggugggugguaauaaauccaaccaaaaugcccaccaggggagaguguaacucauuuuagggcauauggugcauuaguagcuaagacucagcauccugacuccugauucccagggacagccauggaagagauguagaaguaaaaugccacauuccaaguuggacuugguccucuugcccuggaagccuauuucuuguccuaggucugaggguuuaguacaugguuaaauugcuggccaaggugcuucagacauucuuuagcaccugccucugucuggacaaggaaucaggcaggggcugaugagaguggucucugauauguggucucuggaaauucuuuuggcccaagucuuaaagucauggugguaaaagguugacuagaagagagccucugaguggagagacauccuaugcacaaugcuuguucucuucuccccuuucuuauugccagcauaaacaguugcacuucuggcuggcagauucgcccuugcuaagucugugcucagguugcuguccaugauuaaauucucgcugccugcaagcacagauucuagguguuguuuuaagguucagggcaaaacaguuuucuguaaccucuccugcuguaaggguaacuggcuauauuuguuuguaauggacacaugucuggcuguguguguguuuguguggacuaccuuucuuuuauucauuaggcaucuauugaauggauaagguuuguaaaaaagccauuuucuuuagcaaguagcuuggguauuuuuuuaagcguuuauuuuucauguguugauuuggaauaaaaagcacacacaacuuggaaugaaauaaaagacuaaugagaaacaaagccaugaacucaucagugucucaacuccacaaaauuagaguccccaaagaaucacagcaacucaucuguguaucaagcagcagaaccgauuauugccugcuuugggucugacucuguagcaacauggcucaaucagcagaauaaugcagaggaaaaauguuaagaauagaugcuuuuaaugcagcucucaaccccagucugcacaucagaaaucacccagguagcucuuaauuaguguacaugccccaggucuacugaaucagaauuuccaagggggugggggguggucuaguagcuuuucuucccuccaccuuccaaagcuccucagaugcuucugaugugcagcuaggauugagaaccacuuuuuaguguguccugggugucugugguagaaguggaaaucuggugagauugauucuggaugggagucuuaagcuugaaagugaugacaucaaaaccaaaucaaaucuuauagaugcagauguuguuuagccugcuuuaagacuuauauaaaguaaucauauucuuuuacacuuuggagaauuuuuacuuauuccauaauaaagaugucauagccacucauuucuuuaacgaugaguuuaaauauuucccaucuggaaagcucuuuccuugaaaagguuuauuacuucucugucuccucuggaaguagggagagaaaaccauuaacauaauaauagugucugacuucucuucucuguccuauaguuugugccaguaguuuccuuaagagccauaauguggccugauuuaugaaacuuaccugggaaacuuuuauucucccguaagaauaccuguaacauaaucaggauacuuagguggguaaauuucauuccaggcuugauuugccuuauauauaauuaacuuucucaagaaguaaaaucuaaaaugacucuuaaauauugaaugugauuuuauaagauggcuccuugaaaugcccuuuucccccuuuguccuuuaccuguuuguuuuuuguuuguguacuuguucuuuuaccuuaaaaucgccugggggaacuugagaacaaaauaaaacaaccacugcccaggccucaacuaaaauaauuaaagcaaaucucugggaguggagugcaggccuuguuguaccgcaggugacucuaauucugaaagaggcuugcaagccccuguguugacuguugcuuggugaggugcuucucuacuagcccuuucuccuccuuccucacucuuugcuaacauugccuuccguuguguaccuguuauggcccuuaggagaccuaaucauuucacuucugcaggugacuuuaaaaggcccacuuguuagaauggaacacaguagauuccucuauuugaacuuugcuuuuaauaaaugaugacacuauaugcuuauuuaguguucuuuugggguagcucagaucuccuuaaaagucuuauuguuaauccccucaguguuucccgagagugagguaaggguuuccuuguuauuaaaucuaauacccugaaauugcugggcucuguuacauuguucucaauuguucucaacuugaaugcugucccuaucagguuggacaguuucccagaaugccuuucugguaaccgagcauuaagauuuacaaucuagcuuuucuuagccagaagguaagucuugcagggacuucagaaagguguucuuucuaauccuuagugaagagaucuacuugaugggcagcugguagcugggccuagguauucuuagaagaaggauguuguaauguuagcauuagugugaaagucugcaugaacacugggcugauccaagccagaacugaugagucgagaggacaacuugugccaccaagaugugucucuggcugauguuuaaauugcaucaaauuaaaggguauuucucauuuuccauuguggugucaccaaagggcagaauuagugucauuuucaguagcuuugagccucugcaacugucacucucccugagggucacuagagauaguaacucacauucugaagaggccggaaaccucccuguuggaugacuucuuuggagaauuauuauuccagauccacugaacccuacucaccuucguuuuuccugcaauacuuuuuuuuuuccuuuuuaaaaaucuagaguaggaaaaacuuccuauuaaugccugucugucauacuaauaggguagaagauaugggcggguggguagugggauggcggcaaguaccauguaccuuuucuugugugaaagugcuccacaaagaauggcccaugggaauguuuuaacuguguagucauuuucuaaaaguuuaguucaucgggugguuucuucgucuuucuuuccucugaguguuguguuaggcaugaggaggggcacaaagguaugcaagaugaagccccuacugugugguggugggaauaacucaagcacaugcuaaucaaggcagcuuaugauaagaugcaagagggacacaccccaaguggugugggcauucaaaggagaaagaaauccccuuugacuuguucuuuaccacuuggauucuagugguguuccugguuuaucuguugugagguagaaaccaaaguacagggcaugcagagacuguuuaucacugggcacaguuauggagguaacuaacauguuaaccccccacccccauuuuauucuugcuucaggaauuuuugucucuguuuucuccuuguaaacucuuuugccauccccauuguuguagaagccaaucuccuacccagacaaacaaacuuaacuuuuuugguggaaauugauggugagccuguuacaagggauggaacuaaauuguaagaguguccaaaucccacaaaccugccagguguuggucauuagguacauguuugaauguuuucaauuugaagagauuccucuacagucugugggaaccucggugugcaagguguuuucccuugaagcuuucuuugccucuuaccuagacauuuugugaaggcuucuccucaggcagcccuugucauuuugcugaaugucagcaaacauuuacugucacugcucugaugucagggaggaaggugaugcuuuuacuuucuagcaaaauagcccccaacguuuugguagcacuacauuuaaaggucaccacccucucucuccuucucuucccuccucuguccucauugucaucuuuauaaccugucccuucugaaaguuguuuuugaaaaagcauugaagcuguguuuuaaagugauuggauucaguaagucugaaggugcuaguguugauggugaacuugagauggucaccuuauuccuuaggaggaaguucaugguuucuggcucuuggaagaaagugguuguguguauguaugcguguguuauaaggggaauguuuuuggcuuaaacuauguacgccuaucaggcuuggguuauuucacaguuugagcauauuguaauucugaguauuuuuccuguugaaauuggccaaggcaaucauggcuaugguagaagucuuaucugcuggugacaucacauucugcuucccaggccuuccaccuguauuuuaucgacgggcauguaaacuacacauagauacaaauauuuuucaaauguguaaugaugcuaguucuaaugaagaaccuagaguugcuguaaaaaucucuuuuaaauuguuuguaugugauuuuuaaugauaguagauuauaauauaucuuucaugaugaugauuaaguuguaaguuuagucaaacaucuguuuauuuagcaaagcgaucaugaauauucccuuugcaauuaacacugauuuagggaagaucuauauuuauaauuaauagauauugaaggugugcuaaauauauuuaggcuccugguuuuuaauuuuuuucccccccguuucuuccauguucuuuucauucaauuugccguuuuugggucggcuuagagaccacccagaugaccugcuuauguauacuucccuuuguguauauauacugugacuguuuuauuuuaaaaagcaggguacuuuauaaugaaacauuuacucgcuagguacgucacaguuuuuauucuuguauccauacaacaccaagguugaaguuguugcauguacaguggguggaaguaaaugcuguugccugauugggcacuuauuucuguguuucuuggccuauucuguauaagagacauuuugaacugggcugucauuacaugaugauaugcucauuucuucuuagcugcccuaugcuuuuucucaaaggaaucaccuauguaugaucauauuuucccuuuuuuguguucaaaaagauaauguacuugcuaaagucccuugucagaugauaaccuuuaaucuugguccuuuugcccuaaaugcagaaauacaggugcaaaaagggaaaugauuuuggaggagugcaaauagagggaaggaagaguuuagagauacaacaaauacuccuguuuguaaagacacacccacaacuccccugaauguuuagauugcugcuuggagcaaacucugagaugaacacgacugcaacugauuauucuaaguauugucuaacuugcaucuugcaaauuacauaaugccugagcaagguuucccuuuuaaaacuucuguuacauucauaaacugauaggaaguuuaauuccaagaaccuuaaacuauaaaaauaauacccugaauucuauaaacauccuugguaaguagaaagauacucaugggaagagauacaguuaugcauugcccaacgauggggauacguucuugagaagugggucauuaggugauuuugacgcacaagugucauagugcauacucacacaaaccuagguaguauggcuuacuacacaccuaggcaauaugguauagccuguugcuccaggcuguaaaccuguacagcauguugcagugcugaauacuguaggcaguuguaacacagugguauuuguguaucuaaacauagaaaagguacaguaaauuuuaugggaccaccguuguauaagugguucauuauugacugaaaugucauuaugugacgcaugacuacucaacugugugacaacugggaaaaggauggaaacaagggacuugauucagauuuuuuuguuuguuuguuuuguaaacagcuuuaagaaucuugcuguuuuuuauuuucagaauucuacugcuuggguuaccagaaucuucccugauuaaaaugccuaccauagcaugccaucagugacuaaugaugauagcgagacaccuuguuagcaccaggggaaagugagaucagauuaggugcauaugacuuugugugagguuaugacugguacaagcuuccugcucuuuugcuaagggcuaccacaaaguuacuuaaaagugauuuuauuuucuuuucaucacugaguggcuugaucauagacuuaguaaguuugugaaccccuuccccugaacuuccaaaaccuuguguagucugauugaauacugacuauaaacaauaguccuggguggccugggccauuuaaggguguguaucguugagguguagcgaucaugccaaggcaucuccaacagaggcccuaacuucagcugcccucugccugguugcuuacacugcuuauugugaguuuagaaaccuuugaauccauuuugggguagucagcuccuuuaucugcugaggaagcugugaccugugugugucacaguucagauuuuugacaacacagaacacugucacaggacacacacagaugugacuugugugugucaguguuguguguugccuauaagcaccuguagggaaacgguagggaguaccugaagggaauggucaucuuagaacuccuuuuuuacuuuauuucauagcauagucucugccugccaguaugauacauuguaauuuuagaaguucuuuuaaaaaauagauagcuuugacuguaaucauuaucuuauagcaacaggcagaggucuuaauucucuuacagaagcaagcuugaagauuucauucugcuuucuugcccgcuacaccagcauuuucaacccuagcucauguguccuuacauucauuuccauaacaacuguuguugagccucaaacuccagggauuaugauuugaggugggagugaauagcaggaaccaaugaaugcuuaaaugagaaaucuuuuaguaaugucacagacucaucagaggagggcauuagagaaggaaaggaagaauggaaacgccacaggcauccugcugguauggugaaaaugucccucuuuuccaauuuucugugccuuauuucauugggagauauuuugauuggcuuuaugugggcggccuuuucuuacuaauuccuucuuccuaugaacauucaucuuuugaguaugguggugucuuaggcuagaaaacugaugucuggccuuuguagguauaaauaccuauuuauaccuggcuuaugugaugccuagucucugguccccuucaguccauagcacugacuggccacuuugagcauaugguagugagcugcagauaugacuaaguaaggcugcuagcauucagucuuagccauuuaaguagucagcauaugcuaguaauguuuguauucaguauaacuuggaggcaagguguuuuuuacuagcacauuuugguuuucucguuguuguuauuguuauuaauuuuuuaaaaagcuuacauuggggauaauugagaauaaaugccuuugcauucagcaugcaugagauguuuugcuuguguauagggagguuguugcuuggguggaagaguuagaauuuguauguagaaaugaaggaaaaaugugauuugcagggcuacuuuccaggucgaccaaguucuucaaagugacaaacaucucuguuccuuugaaaauuauagagacgcuggugugcccuaucauuaaaugaauugucaaaggcccuggauccuaugguuuggauauaaauagcacauguggcuguggaaaggacucuguugagugugggauugccuaugcaauuccugcccuugucucucugaggaaucauggacuugaaguacuuucugcuucugcuuuauauuguuuuuauucaagguucagaugguauugcaaggaauuggcauuggguauugaaggaccuuucugugaggaugaguucucuggauaagaaugauuuuucuagcuacagucuugaaggaaaauuggagucagauaauccaaaaacuucauguccagccuggaagauccuuuagaaaaaauuguuuuuuucuacugacaggaguuaucagcaccugguugugacauauuugacaagacugaacaucagugcuuuaaggaaaugacucuugcauguauaggcccacagcaugguauuuucuuaaagaauuaauuuuucaggacaugccacuauaauaauuuuuagcagugcuuuagcuaaaggugacuuuugccuuuccauugucaaugucaccaugucguauugucacuuacuuggguuuucucucccuccuuugcuuuuuauuugucuaguguagggacagacuauagaagacaacaagggagaacaggguuucuugauccuuguaggauuaguauguuuguguaugaugauggcucaaauguagucaauguucccccuucccaccccuuuuacuccauguauguguuauugcuuuggaucaagaacaucuugguuuguuucugucuuucuuuuauguuugguuaccaacuggccaagucaguguucaccuuguuucuggcccaguggaaacacaaacuugcaugaaaauaggauauugaagugagaaucuaacacucacgggaaucauuccauguugucuccacugugccugugauucuuuguuuugcuugccuggccuugucuccuguaucuuccucuugacagcuuguuuccugccuuuugauuccacacaaacggugauaccauaguaugcuuacccagacugggucuuucacuuuuuccuaggaugcuuguguacaagguacuguccuuucagaacacgcucaucccccuuuggguucuggaucggaaucagauuaaucagguguaugcugguaguugugugucugaauugguagucaugaagucugauugucuggaucggaauugcaucauuaaucugauguaauuuuaaaaucaagauacccuaauaguaugagugagaauuggacuaaguaucuggugagaguaggaaagagaugaaauauuucuucuuccccuaaaggaauuuauaaccuaacugagcaauaagcuuaaacacacaaaauguuuuuaaaaguaagaagaaaauacgcauuagaaaucauauuccuacuucaguagaaagugaacaaaacuacaugaauuggucuguuagaaacugcuguaauuguuaagaggcaggagaaaguguuucaggaugggguggaacagggugguuuaguagaagaaaugacauucaagcaggucuugaaggguagcugaauggaaggugcaggccuaugugggugcuggaaguaaacaguuuuuuuggacuaguagccuccaaaccuugaguauagacucacagagaagcuuuaaagaaacaacacccaaaaccaagaaauagcaacaguaacaaaacagauuccugcugugcaccccccaugaagucagaauuaucuguguaggagggggauaugcagacauggauauguuaauguauuuuuuucuuucguuuuuuuuuuuuuuuuuuugagacagggucucacucugucacccagguagugcaaucauggcucacugcagccuugaacucccaggcccaggugaucuuucugcgucagccucccaacuagcugggauuauaggcaugagccaccaagcccagcaauuuuuuguagagauggggucucaccauguugcccaggcuggucuugaacuccugggcucaagugauccccaaagugggauauauuucuaaaagcuuuccugauucagauauacuucuagccuuacgaagauaggccuggaagguaacuuggaucccaaaugaaacagucuugaaagcuaucuauccuaaggguguagcuuuggcuuccuucugugggcugucauugaaggcucuugagcagggauuugaugugauuacaguguuauguuaggaauauuuaucuguggugaagaggcuguuggugguauuaauaaugagguguggagaggcuuaauuagacaguguacauggaaaggaaggaaaagauacaagaacguucacaccgggaagagucaacaagguuuguggauugcugaaauuuggaaugggaugguuaaguuguagauuaguggauguagauuuaucaauagagauuuaaaguuuuaauccaggaggacaggaauuaaguuaauaaaaauugguggaacugguuuaagagacucugggaaaccacaagaaguucagcuucaaacauguagagugguagguguagccuccaguugggaaccuucagaugagaaguugaaucugggugcaguggcucaagccugcaaugccaacaauuugggaggccaagaugggaggaucaguugaggccaggaauucuagaccaacuuggacaacauagugagaccgcauuuccacacacauagacgccaggcuugguagcaugugccuuuggucccagcuguuuggaagccugaggugggagggucauuugagcccaggaggugaaggcugcagugagccauaaucaugcuacugcacucuagccugggugacagaaugagacccugucucaaaaacaaaaucaaacaaacaaaaaaacgaguaagugaaguuuaaccuaaacaaaguuuuguacggcaacagcaauuuugauuugguuauguaaagauucauuguucauccaguaacggguuacacagacugcagauaggucauagcguaaguauugagaagggcugaagguugauuuggaggaucuguaggucuucccuaugcugguucuuaugaguggaaaguuucagagcuggaccacugguuggaaugcugaggaagauuaagguaauguagguccacagucucuuuucacaaauccuuagggauugaauucagaaguuuaugaauuuuagaaagguuauaugguacgugugugguauguuaauuacauacuacccucagugggguuguggguaggaaccccauaauuaaacacauuaaaauuuauucaaugaaacauaugaauacagguugaguauuccuuaucugaaaugcuugggaccagaaguguuuuggauuuuuuuggauuuuugaauauuugcauuauauuuccugguucagcaucccuaauccaaaaaucugaaauguuuaaaugaacauuuccuucgugugucaugucgaugcccaaacguuucagauuuuggaucauuuuagguuauggauuuuuggauuaaggauauucaacucguauuuacaccaacuaggauaagggcuuuaaaguaaccucacaucuguuuugcagcaaauaauuucagcuuagguuaaguuuuaccacuaaauguauuauaaaaaaucauaaggaugaguuuauacuagucuguuuggacuaguguaaaauaaauguuucgcacauucuucccuuccauuuaaccuagucuucacucugggaugcauguaaugauaaccuguaucuugucuguuuuggugguagaauuuuuuugguuuccugauggcucugaagagguagaauauacuuuauugauguuacugaagcagaucuagaaaauuaguguaagcaaacagcucuguuuuaaguguuguugguguuuuguuuccaugguagggugugugugugugugugugcgcgcgugcugaaagccauucagucuucccucucuuguugaaugguguaaaagccuagcuagacugcagguuguggaugaccagacuuggcucaaaagaagcauucuuagcauugcuagggggcuuuugcagauuuuggcuugucuccgauacuugagucauuugauauuguagcccaugaauuaggacaguguaguuucaagagcugaguccuggcuguuuccaugguagaguaguaugcauuguuuagaaugucaggugagcaguggcuuuucugccugugcauugcccauuuagcagacucucugcuuuuauacuacauagaugaauugagccaugguuuagaauggggaagguuuucugaggcuuaccaguuaaaaaaggaaguuggcuagagagagagucuuaggcuauagccuucauuuggccuagggacauuacuucuagagagacaggccucaguguccucauuuguuugaaagauagugaugugggguucuaugugacucguagcaaccucgcuguuccagcaaaucugugggcugggcaggguuuggaaaauaaggagaguccuugcaguuuugcaagacaguuguugugaacaaaugacccuauugcauucccugguuacucagcacccucuggacacuggccuagucaugggcaauuggcuguccaaauagcauggacuggucugcagccggagcucuuagugaggaugaggcacgacgcuuccccagcugacugcucgcgggagcauuaccuggugugcagcuguugccugaaucccaaguagcauccaaguguaaggcuggcacgcuugccucuucccaucuuuuuccuugcugcucugugaauaucugaucgauggggccaguuggcugggauccagcuaagccagccauguuguuagauguagcauuucugccuuuccccuucucaucuuuuccauuuugucacauccuaggauauugucuuccuaauauaacuggagaguuuauuccagugggaauuguacuugacaugcuggucuccauauaaaugaugagugauuuuuauuucacucucuguggugucuugugguuucaaaaagugagcagguggaaauuuggaggggguggguguguugguaaacccuguguggugaguuuuguuuugcagccgucguaaugcuuauguucaucagcaguucaacaaaacacauuuauuaaauaccuauugugugccagcuauuggaaauagaaagaugaauauggccacuuuucuucggagacccagccagccuuucacugcuggacaggcugcccaucuggacugcuggguuguuccagugguagugcuggaauuuuagguagugcucuguuuccuuugguaagugaaagaggaauuuaaaaaguauaaugcaggggccaggauacuugauuuucuauaaagggccaaaugauaaauauguaagcaaauauugagauuuguggaccaggcacucuuugucacaacuauucaacucugccauuguagcugaaauuaaacguauacacuaacugccugaaugaauggauguggcuguguuucaaugaaacuuuauuuucaaaugcugaaaucugaauuucauaaaguuuucacaucuccaaauauuguucuuuugauuuucuuucaaaccauuaaaaaacacaaaaaccauuuucagcuuauaggcugcacagaaaggccagguuauguuuacugaccccugguauaaugcuuuuguugagcauuggccuuuauacuaauucugccuccuugucuuccaucguugucuaaggaauaucugcuugaagacagcugauuuagcauugaucagguacuguuuuccugaacucugguuugugugguuuggcagcauggagauaaacaugguauuggcccagugaucuuaacucacucccaguuuuuuagggacaaauagugucccccaucagagcugcaaagugucaaaauuucagugccugcucuuggauaaugaauuccuguuaagugucuuguuugacucagaguuugauguagaagagacuggguucaggcagagguguuuuaaauucuuacuggaguggcuugugcuuuggggggaugaucugaauggaaauuuuuaccaauagcaacaaugauaauaggaaacaguguacuuuuaugucuugaaaagcagagacagugcagaauagacccacuggagccuuggaugcuaggaggcagauguuguuuguagguguguuuggccugaaaauugagauguugauauuuuuuuucuaaacuuuuuuuuuuuuaaaugaaaggccuuuccucuuccccugccaccaaagaugaaaugccaguccccaaucagauccuugcuuauucuguucuuaugguuacauaacgcaacugagaccgaaguaagcaagagaggcuccuagggugccuagguguguaguggaccuuucauuucugacaaauauuuugauacuuuggcagaaaauucagaaugugugaacaaaguaagguagagcagucugguguuguggauuuuccuucccccuuuauuguguucauuagagcacugucuauuauuuccugccuucuuugggcucugaagaauauuuuuagcacugaaauuugucuuuacuacugaacccugcccagcuaauacaauuuuguaacaauugauuaccgcuaaaaugguuaccucucuuugucaauacuacacccauccagaucucagugaggaaguaagauuucaacaccuaaagaaccaaaauggaucccuucccaaaaauuagcuuucacuaaaguccccuugaacgcucagagccuauuuauuaguauuuuauucacauuuagcccaaaguagauuaucaauuagaagugaauuggaacuagcauccugauagcaaaauaggaagcagagaaagauagaacagauauuagacucucugaauguggugugucauuuugugucacaguaucuucuauuuggagaauagaaaaugauuucucuguuggaauuguauagauuaucuucuugagugaaaauagggcucagauugaggaggucagauagaauaaaauaauuuuucuuucuuaaagugggccaucaugcuuugagagauccuauugugccucucugauuggauguuuuguuacuuuuuacuacagcaucaguauccuugccagaaccaaauuuccuauaggcuuuauguaguccacuaaggguaaaucauguugcaguaacaaaagcucaguggcuuuauaacaauagagguuuauuucucacucauauguccauaauagguaggcugugguucugcuucacuuuuccuucacuuugggauccagguugauagaucauuuguuauauggcauuuuacccuuaucacaguggagggaaagagagauguggcaaucaagagcugacucugugauuucacuggccacucccaaauccaccaggccagggaagugcugaugguccuuccccagggaaggguacugaacacuacauggccaagaccagcaguggguugggagguuguuauucucucccagagagggacagacaaaauuuugaaauaauaccacagacuugaugguuggccagauuuaugcagucucaacuggggaacccauauucuuuuggagcaccaguuguuuaaaaaacaacuuuuggcuugcaaauauuucaguggucugauuuucaucagcauuaaaagccuaacagaguauaguauucaaguuguaggucuuauuuucauuagcauuuucauguuuccaaaagccuuauuucuuuuagaccuaaauaaauuacuuugggucuguggauucuaauuugcauggcucuacuuaguucagggggccggguuguaggggugaucucugaaccuacagaaacauuuggcauaugaucuuccaccuaccaccaauuuguauuuuggguaaaugaugccaagaaguguauauuauaacugauaucuacuuccuguugcccaaaauaccugaguagauucaugcuaacucuucaccguaucauuacuuaucuguugauuagcaaggagcccaggaggagagugacaucuuguucuuccauagccaauggaguggcagcuaacugccccuaccucuguucaauuguagugugaggcaucugauuaaagcugaaacgaggaaguucuguucaagaaggguucauuuuucuuccuucuuucucccucuuugcuggagaagaauaacauuugcugguuugauaggagccaagugcugaugcuaaaacccgguguaaaaucagaccacaucuuuuacccuugccagccaaacugaggacuugaaaaagucaaaucugucuuguuucagacaccucucaaaauauaauucugcugaugcugggcagccauaggugcuuuggcauuugggagugaaauuuaaaaucucuugcugcuggugaaugauaggauggauguggaguuucuuugucugugcccuucagaauaugcagcagccagcugcaaaugauggucuaauuugauguggugacuccguuugaaagcggaagcugccgguuucagaccggcucccuguaggauaaugaauugucaugccucugcugauuaucuaacaaguuuguacaacguguaacacaagcugacaagacaaacaauuuuauuaauuuaagccugcugcuaaugggauugcagugcuauaugaauguaggaguauuauacgcaaauacaagaguaugcuacucuacacauacuuguagucuggguuugauaaugggaagucuauuaauuuuuuuaaacaauguuuaguguuuccauuuguuuucaaaaaagaaaauucauuuggauuugaauugaaaaauauuuaugaaugcuuggggauuuauggagcuuaaaaaaggcuaucagccuuugaaguauuagagcugauaaaugccagugggcaguagauaaacuuuugguuguuauaaaccaauuacgcuagaggagcuuuugucuuaaaugugucuagaguuugguugucaguugggagagugcuagggccuguggggagauggauucuauuuucaguuugcggccuuugaucuguaguauuuuuuucaaaucaucucauguucuuauaaacuugauaauuuaagguaguugaaucuugaauuguugacuaggauugauuagcuauguuuaugaaaggaauuuaucaucuaagauaaacuggggcaggagagcagagaggggacuagagccaagcucuguaaguguguuuuguguaauuaaaaugaucacaaauuagaaaauaauaugguggggguauguuuuccuuuuuaucuucauucuugugaagcagaagcuguguuguagaauguagcgccuuuaggccuuccacuguccuuaacucugcuucuucuuguaucuuccuccauaucuagaauuccuuuuucccaccagccucuucuuuagccauuccucugggaucuugcccuccaaggcuuaucuucugcuaggauauguggcgacuuagaaucugagcuuccccaaaucacuuaccuguccccaaauaaauuagauguacagcuucuucauuucuuaagagguagaauugccagauggccaccaggaauaauuugcauauauuugcacaacgguacauauuuuaagaauuuucagguucucuuccuaauacuaauaaaaauauuauuuguuuaaauauaaaugguauuaaucuguguaucugccacuuucugaaagcuuuuuuaaaauacuuuuuaaauugaggucaauauccagucauuuguauacugugcaguaaucuuaaauguaaauauauguacaauuaaauauauauaucuauaugcauaaaccaguguaucuaccacccaaaucaagacauagaaaauuuuuaguaucccaaaaauuucccucauguccauuuccagauggcguuuuuuaugccuugaaauaaccauuauuccacaucaauuaguuaugccuucucaaacuucagucagugcaaucauacaguaggcagccuuuaauaucuggcuuuuuucaugcaauguaaugucugugagauuuaucuuugcuguuauuuauaucacuagugguucuuuucuguauaguauuccauuguuucaauaaacuacaguuuauucucuuguuaaugaucauuuagauuguuuccagccugggucuauuaugauaaagcugcuaaugaacauucuugugucugccuuuugguggaugcgcacauucguuuguuuguguauaucuaggaauuauauuguugggucauccaguagaugaauguuuagcugugguuaguacucccaaacacuuuuccaauguuacuauauggaaaguuguuccacauccaugccaacacuugguguuuuuauguuguuaguuuuagcuauucagaucuguuuauaguggcaucucaguugguuuuaauuuacauuucuuauguggagcaacuuuuuguaagguuaucaggcauuuggauaucuuuugugaaaugcuuguucaggucuuauaaagauuuuaguuuuuggaauuggguuguucauccuuuucuuauugauuguuaggagcuguuuguauauucugaaugugacuucuuaguugaguuguuuugugaauaucuucuaauuugugguugcccuuuguacucucuuaauggcugacaguguuucuuaaauguuucugaaaauguuuccuguguucuuaauuucuuuguguuugagaagacauucauuucuugucuucucuuuauuuuugaaaagcuucccugcuguugaugcuccugccaugcuggaauauaaguaucaauauaacuguaagcaaucgcuaugccgcaagaucuuccugacucucagaggaauacuagguuuccuuguaaggcacccacacaaaauuuacuuuggagaaaguuaaauuaauguuauuacauagaagugaucauaguugccauguuauugugaacuuacuaugcaaagucuaagcauuuuuaaacauguauucauuuaagucauaaaacaguauuguugauuauguacugcuaguacuauccacauuugacaaacaaggaaaucaaagcucacagaggucuccuguggauagaauaccagacaugguauuguugaucuugcaacauuauguccuuaugucauucacagcuggggaucuguucucccuacuuacuuuagugagauuuuagugugugcaaagcguaucuguagaaagucaguuagaaaagacacauccccuauccucaaggaauuccauguccuauccugugaauugccucuguuuaguuaaaagguuaauaguauaucaggggauuuuugcauauaugacuaaugguuuuuuuuguugcuauaauauuuucauuauaaaauaucugauguauauggcaacuauguugaaaccuugguuugauuucagcauuuacuacuaccugaucauaugguuuugauauuuaaauuuuuauaguagaaccuugcuaauauuuuaaacuaauauguaauccauuuugauuuagugaaaaauugacauagcaauuuucaaagggaggagauacauuugugucagauuuuuaaaguagcaggcuaggcacgguggcucaugccugugaucucagcacuuuggggaggcugaggcaggaggaucacuuaagcccagaaauuugagaccagccuagaaacauagggaaaccguaucucuacaaaaaauuaaaaaauuagcugggcaugguggugcaugccugugguccuggcuccucgggagacaaaaaugggagcaucgcuugagcccagaagguugaggcuacagugagcugugauugugccacugcacucuggccugggcgacauagcaagaugcugucucaaaaauagauagauagauagauagauagauagauagauagauagauaggcaggcaggcagauaggugguagcagauacauacugcuuaguagacaacuugcagacaagucaaaugaaucgauaagaaucgucagaauguaguaugugacuuaagauggugucugucaggcuuuuuuacuguaacagaauguucucuaaucaaauaauaaacauuucauggugaggugccuugaaacuauauaaaaucaaauuaauuuuuaucaauauggacucuugguuugauacuuuauucagugaguuauaauacauuaauuuuuuuguuuguuuucauacuuaaauugucccugauuuggccagugagagcucuuaaagcuaguuccuguguccuuuugauguguccccauccuucuuugauccauuucuugcuuugugggaugaggcuuaguuuaaacuaucuccaggucagcccuagagucagccauuuugccaaggaaucuuguuccuuuuaguagaaaaugguaucuaaaagucaagaccuugccaucagauaugcucauugcuacuggaguguugcuugcccccagaccaucucaguugauaagcucuagagaauacauaggggcauauacauccauacguauauuuaugucuguauguauuucuguaacuccauauuuauguugcaaaccauauauccacaccaacaccuccaguuccaauccaacaccacaggguucagcuaguuuucucccuuucuguauuuguaacucccuucuccaacagugagaagccuuugcuucuguuaccuuuaauguauuuacugauuuuaucauuuccccuguguguaacaaacugucgcauuucugcugccagccucuccucuaggaauguacccuauagugccccaaucaggaccuuccuucucuccccaggugggcaaccugcucgacauacuugggcucuugucucucccacgugucucucuuaccuggcuugguuucggacuccucaugacaggcugcccucccuauggacuccccucaguccacuugggcucuggcaccaacaugccagacuugcucuggaaaugucaucuuagucccuucaugauuuggauuugcacuucuuugacuuauuucauucauuaaucauuaaucugucuuguuuauuuauuaugugagagaccggaugaggaauggaaaaggaauggacuuuaaagggugggcuaauugugucggaaaccagccccaucacuaguucugagauagugggaggauaacuguauuuaguucucuguuugaaugcauaaagugggcaccauaaugaugacuuuucaguuguugcuugguaaaugaaguugaauaagauaacacauagaagacauuuaacaaacauuacugucuuuuuguuugcuuucaagaggaaucuaaucaccugcucauagccuguuaagggcaaaguauuuuguuugacuuuaauaacacuauuaauuuugaacuuuccuagcuuugccuaggagaaucauuaugugccuugaugucaguaagaaagauuaguuaugaaguuaauguauaacuuugcaagagucuaaaaaggcaccucucugccauacauuucgccuuucugccuucucuuugccaacauuaagggaagagccuccacaaacuuuuuucccuuaaccuaauuaucuuuauauccaguagcccuuugguauuagcuuuucaucugacuuuuccuuucuuuacuuaaguugcuuacucaugccuucaagcacugaggcccuacuaagugcugggccauuuggugguugcugguauugcaaggaugcaguccugaugaaccagaaacuauauuguaaucgcaaacuguauucucaacgaaauucuagauccucagaauucugguuuauaucauaaucuuuagagaacauuuaaaccguauaaaaagauuucagaaauagauuucaagugguauauugcucuccauauauaccuuaacuaggacuucuggaaagcauaguuuucaucacaucuccauaugguuuucuaggccaccuaccucuaucaucuuggccaucaaguacaaaauuagcaugcugaagaauuuugaguauuuugccugcaucucauuacaauuaaacuucucugacuucagcuaaguuaaucuuccccacaucccaaaaguuucuuuuugugugaggguuuuggggaggacagcauuuucaaauaucuauauguaaauuccuuuauaaaggaaaccccaagauucaaaagcugucugugguuaucauuuucucaguuacaguuugauaaauucuuagaauuucaaggugugagagcuguggucagcaugucuucaaguauauugggguauuuuacccccucaguuagcugagaaaguaucaaccaagggaagaaagcuauacaacaccaaaaaaugaauaugaugaguauagaaggagauuuacggagacuuuaaacacauaaucguauacacacuguucuguaacacuugucucuucugucuuuuccuagaaauguuugcuuuugaaaaccugaaaguuguuugaacuuuuauuauccauuguucgaagcuagcauucaucugauuuuauuauuggucauuuggccccauucuuuauacccaucuuuccuugaaaccuguuaaaauuagauuccuuccucugccaaaagcaguuucucuuauuugcucauagcccuugauuuuuaaaguuaccauuuuuuaguuuuccuuugaaggugcaucuuccguauagcaguaugauuguuacaguauuuuccagaggcuucuacauugguacauuuuuguucaaaaaacuacuggcuguuuuuaagcaugcucaagaacuguauuccagaaauuaauugauguaagauuaaauuguagguccuucauauugaugcuuggaaauacccgaggcucucauuuauaauuauucuaguaauaugguggaaggaguuuuggugugagagaaagagaucuagauuuucuuccuugaucuuccauuuccuugcuuugugggcacaggugaaaacauggccacaccgagcuugauuuuauaucuguaaaugaaaaaguuuacaguagacuaggggaacacauggaaauguccucagggcucagauugauaacuuuauuaguuugcuaggccuaccauaacaaaauaccauagacucaauggguuauacaacagaaauuuauuuucucacaguuucagaggcuggaaguccaaaaucaaagugccucuuguugucccuuggucucagguuugguuucuucugagaccucucuuauugguuugcagaugacugcccccuugcugucucuucauguccucucugcacauguacccccuacgucucucuguccuaaucuccccuuaugggagcaccagauuaggacccacuguaauggccucauuuaaauguaaucaccuuuuuaaagccccaucuccaaauacagucacauucucagguacuugcuuaggguuaggucuucaacauauggauuuuggaggagcauaguucagucuaugacaguuaccuaaacauaguuggcagcuuagucuaguagagagaauacuuugcccucaucuuuaucucugcaacuaugacugaaacucaaguuugucuugauaugugaugcugacuguuaugggucucagagugucugaagcaagcuugacacucuuaaguaacuucuaaauucaguuaguagcuguuacagguuuguaaaauucucugcauuuuauuuuuaaggaauaauuguaaaagaaauuguauaugcaauggcaucauguuuugcuguuugggaccaugcagucaagcuggcuaaauauguagguaacuucaucaaauguacauaaucuguaucaggguaguccaccucugaaaauucuaaggaaaggauuuaaaggaagagccaagcuuugugccuaaagauguuuacuguaaccuggccucucagaaaagguagaaacagucuaaauagccagaaauaggggaauagugagcacauucaggugacaaaacuccuagaacucaugucacauagaaauauguaaugcugucauucuaaucuggaauaauucugguauaaaauauauauaaauguuacuuaaaaucaagcaugugaggcuggacauguuggugcacacuuguaguccuagcuacucgaguucuuugcacucagaaauucgagaccagucugaguaacauagugagaccugucucauaaaaucaagcauaugugcacaucauauauauacauucagucaaauuaauuuuuuuugagacagagucuugcucuguugcccaggcuggagugcaguggcaaaaucacagcucauugcagccuugauguucugggcucaagagauacuccugccucagccuuucaaguaguuaggacuacgggugcacacuaccaugcccagcuaauuuuuuuauuuuuugaagagauagggucucacuuuguugccuaggcuggucucaaacugagcaugauuuuuguuuccauuuauuucuauuaauaauaauaugauacuuguuaaauugauuuauugauaauugacagcaggugaucuuuuuuuuaaggaaaaacuuacggacaaaaaaacccaggacuauucuauuuacuaacuuaguuuuugguaucauucuuauuuuaaguaguuaugaggauacuuuuucugcauuauguuucagaagcacuaguauucuagaaaagcguagggccaggcagacaugguggcuaaugccuguaaucucaguauuuggggagacugagggaggaggauugccucagcauagugagacacugucucuacucaagauuaaaacaaaucagcuggaugugauggugcaugcuugcagucccagcuacuuuggaggcugaggugguugcagugagcuaugacugagccacugcacuccagcuggggugacagagcaagacccugucgcaaaaaaaaaaaaaacaaaaaaacaaaaaaacaaaaaacccaagagaaagaaaagcauaaauugaaaccuacugacauacauugcugauuccuauuaauuucaaauaaugauacaauuuuuuaugggauaguauguaauucuaaacugaauauuagcgauuucauaagagcaaacugaagguugccauugacuuuuuacuuauugauaauaaaaaacacuuuuuguuucuuuugccauaggagcuaucaccuacccuguggccauucccacacauuauguguacuuccacuuccacaucucuuuugguuagcuccacugaguagguacagugugugugugaaugcgaaguauuuuaauagugcaauuuggcuuuucaugguccuuaacucuggaaggaacuccaugcucauuaaguuugugguguugcuguauugcagaugcugcugaaggcuuccucugcccuaggcugccaucuuuaguuugccugcauagaguagaguaacaaaaccaaaccaaaucagaacuuugacaccgauguggcaggcugugcuuauuaucagaauaucuuuuaauguuuguguauuugaguuuucguugagcugauuuucagaaaugcugucuuuuuaaauuucccauuugcauuucugugucaaaguaaaggauuuggaaucugaaaaagaauaaugucuaacuugguaccaaauaauguuuccaggacugguuugaaggaucagaugugaguuuuucaaauuggaaccuuuucuaaugggccccugggaaaugucuuagcuaaauugcaacagugacuggugaagucgaucgagguaaauugcucccauugcugaggguucagaaaccaggcaguggaagcuaaaauuucaggggaaaucgggcggaacuauugcagaugguuucccccuugaauagagauggggguuggugucgcuguugaugaaugggaggagauuaaagccugauuuuugcaacgaguugguaacauucucuuugggagacuaaagaggaauuuaugagaagaccaucagaaucaguuaggugauuauuuucaauuuugacuacaaaugacaucuaggaacacaccaugaugccacuggacucuguaguggucuuuauuagaaaaguagcaacaagagacuuuuugugauguuuacccucagugagcucagaggucgaggaauugcccagaaucuugcagauuuucauuuaacagucaaccauugagcauuucugauuugcauuuaaaaaaaaugaaccuggcugguuuugacuauuuguggugauauguuagaauacagauccucaugcaaguauuugugauuggcacgucucacucagacauaugucucacucagacaucuucuuuguguuugaggaagccccuuaagcucugugcacagugagaauaguaaaauaucacagaaucguguggcaacauuaggcccuuaguaauugguaaaacuugauacuaacaacaucugucuguccauuuuucucaaucucuuguaagugcugagaguacugaaguaaggaccaagcuuuaaauccuucaauuaaauauuucgaggcugaggccuggagagaauuucuuguauuuuagcucccuaugacucuuggaaauucuuccuuuauagaaguuuuagaagauuaaggccuccaauuaagaaagauaaaggaucuaauggcucccuuagcugaugagcauuguguaaccaucaauugaaugggcugaacuuaauauaauuaauagguuugcagcacucccacaccuauuauaagaucauauuuugacccauuuuucauuucuucuuuauaagcauuuagauguuuauguggcauucacauuuuaauauuccuuggaugaacauggcaucauaugauuagaaaaccaaaauucauuuuugauggcuguuguggucagaucguguccucuaaaauucaugugcuggaaacuuaauuucuaguguuaacagugccgagagguaggggcuuugggaaaguuuaauggauuaaugcccacauauaagggcuuguuggagggaauuugggcucuuuguugccccuuccauccuuucuaccaugugaggacgccacacuccuccccuuuggaagaugcagcaaacaaggugccaucuuggaagcaaagacuaagcucuuaccacacaucgaaccuguuggugcccugaucuuggacucccagccuacagaacugugaggaaguuaaguuucuguuauuuauaaaauuaccaagucucagguauuguguuauagcagcauaaauggacuaagacaaugccaaagguggcacuugccauagaucugcugugaugauaucaacucuuugcuuuccaggaguuaaagcuuuggauucugauggguugauuuucuuuuguguggacccuuguacugguuacuauuuaauaguucuuuucuuaucuuaggccgggcgcgauggcucaugccuuuaaucccagcacuuugggaggccaaggcgggcgaaucacgaggucaggagaucaagaccauccuggccaacguggugaaaccccgucucuacuaaaaauacaaaaaauuagccgggcgugguggcgggcaccuguagucccagcuacucaggaggcugaggcagaauggcgugaacccaggaggcggagcuugcagugagccgagauggcgccacugcacuccagccugggugacaaagcgagacuuugucucaaaaaaaaaaaaaaaaaaaaaaaaaaaaaauaguuuuuuucuuaucuuaccgucucccagaauugcuauugccaaaauuuggugcaacuauguauuuuucuguuuuccccaccacuguuuguauguaauuuaggcugaguuccuccaggcucuggugccugcguuuugugguuuguaaagugcuguguacuuuuauagccucuauaaauaacaaaauacagcucauggcaauaacacuguggcacccuagauguuuagauauaguguguguuagaugggaagagagagagauauaucuaggguacaaaguggcuagcuugcaaaacuuaaucgucacuuacucauccuacuucucauuuuuguucauuuguugauggcauuccuuuaucuuugggacauuuuauauguaaugacuagguguggugccguucuccucuucucaguaucccuucccccaucccuuuccacuguuuaauguaguagacaugaagaggagaagagcugguucacaguguggugagauuuccaaccagaugcuugcauggugggggcccagcuuccuauccuggucuuccuguuuuguuucaguagaucaccacagcugccuucuuauaugugggagaugugaagcuaggcccucgaaucuauuucuauuagcccugucaauauaguuugauaaaaugcaaaugucuuugaaaugguagacuuccaauuaaaaggcuccagcagggagucuguuuugauaaugaaagugauuaagaagguucuauuuucuuccauugguaugaauguucagcuaaaauagcuuggcuuuuugucuguaauuggacucugcuaaugagguucuaauaacucuuagguucuaauaaugauucuaacaaaucuauuaauucucuucauugaucagugcuggggaccagaacacagucucuggauagcagugucauauaagguuguaaaugucauucauuucccuuucuccuucauucuaaagaaucaauggagcaaauguuuauuuccuuaaauucuauaaucuuauauagauacaucuuaccucugaguagagccagacauauaugguauaucaguacgcauguuaggaauugcccucaaacccugcaguuuauauuaggccuugaagcauugguuuugguguggaaagaggggcugcagaauaaacacauucacagaagaagacuaggcaccaucugaagccuaauuuuuagaacguucauucuguucaaccccuuuccauacguaccugucagccccugguaaaacuaggcuugauaauugaauaugccgcagcucuuuagccagcauaaucugggacauagaauagguuggugggggugagcugccaugguuaucucucaccaccucauuagcggccugucaccuuccaucuuucguuauuagaggcaauguuuguguucucugauuuuaaucaaaaucugucuuuuaacugacuacuuuucuaucuuguucacuguucauucucaaagguccuuauacuuuucccuuauaacaaacuugugaggcagaauuacaaguaggagaggauuacaaagggauuagaguggcaaauaccuguuuuggguaugcucagugacucagaauggccaccaaacuugcuuuguuauguaaguucauaauuuccauuuauaauuguggccuugucaguauagccgucugaaucacuggggacuuuuauggaacagagagguuuucuaugaucuugauaguugaggaauguuuucaaaugaagggauaaaacugacuaaaaauuuagagacgaugagucuuugugugaacaucccugugguuggaagagccauuuuucucagguuuccagcuuguauagauggugcucauauuaucuauagcuaaucaaauagcagaguugugguuuuuauuuaaauaucagaaugacaaauuacaauagaauuauauuuuacccagggguagaaucuaaggucagaguaugagacgaaaauuguauauagugaaaauuauucuugaaaauccauuuagugucguuuuauucaaacugaagugcuucaggauggucagaugcauugucuaggaucaggaacaguuuauagucaaguccuuucucuuuuaaguacaauugggaggggacagggcuggauggauaaccaucaauauuuaaaguuauuucccaccucccugacuccucuccuaccuucuuuaucucagagaauauaguuauauaccaauaaguuaaauauguguauauggcaaauucuuugucuucauggcaucucuggaguuuauaaaugaauugcuccuggauaaguuaaugcugccauaugguuuguguaucaggagacugaacuggggauagugaggucuugauacugcugguaaaaauguuagcugcuggcguagaauuaagaguggucaagagagggcuuggguuuguuucucgaagcccaaaaguauuagguagaguguuuuuuuuuuuagaagugacaguaguaaacuccguuuccucagggugcuaacuaaucagaagccugggcugucuguccacaggucagggagacggaugcucaucuuugccaaagggcaggauguaaacauguuugccagcccuguugaauucuuugugcuauuacuuggugauuucuucuaccuggaguauugaauuccugcugaauucagaggacugaacuuaaauugcuauuucucucuagcaaccuguccaaauaauucuggucaccucuuuuucugacagucccucccugguuucucucuguuacuuauguuuugaccagcuuccauuccuuguccagaucuguuuauuccauguaucuuguuccugagugggcuucuucgaaauuucuuuuccuuguauaauguugauggaaucuuaaaaaaaaaaucuggguguuuguguguuguauauguguauauauauaaaugcauauauagauagauguauuuaaugaggaauuccauauauauguuuauauucccuuuccuuuuccauuacaaaggcaacuguaugaaccagaacagugcccuuuuuguagcccacugcuggagugugcauugcuuaauccucuguugcuuuuuaacucucagcguguaaugaauuaaauaguuuuuuacccuuccugauaaggauauuuaugagucaggguggcagaauuccauaguagcacauuagugucugcuuugaguugacacauucaugugagguauccuucugaauggagggaaauggaagugcuuugggaccuugcugcugccuaaccuuccagcuuugugccacucaccgucaccggugugcaggguggcaggcaguggauaccagggcccagaaggucuuaaaccugcagaauugugugcacucauugcuuagauauuuccuuagcacaacuauagaacuuaaauauuuuucaguaucauguuagccaccagggaguggagacacgaaaauguuucuaaaaguaaauggggaugguggguggcugagucagggugaaauacaaauaaauacaauguuuuguagaauaaaaguacuuuaagagaggcacacaaguaaaauaacauucaaaggaugaaagaaauuugaggcuuggaauuacauagcuugauauugcuguaacugguacuaaggauaaauagcaauaucauuuugcauaccugcacuaauuagaucacuuuaccugcacuaucuaauugguugcugacaaagucaaagcccuaugagggcuuuuaaaaucuuuauuuuuuaugucaggaaacugaggcuuggaaagguuaaguuacuuguacaaggucuaauagcugguaaguggagucuuugggacuagaacccaguccugacccaaaggcuguacuuguaaccacuaugccuuacucuuuaaauuuucucaguuuucaauucagugcuuuaucuaggucaccaguucuuucaauuaaaaaaaaaagugguggaaugaauguguugaguaguuuguguugugcugaaugcuuauugcuauuucaugccauacacuuaauugcuucuauaugcuuauugcuuaauuacauaaaaugcgguagucccuuuauaauguuucuguaaaagugcccaccuuuacugugauuuaggcagaccaaaaagcaagagagugugcuaauuuuuaauuuugguggccagaguucuuuuugguaauguuuucuuuaugaguacacugauaucucguuggcuaaagcaugugacuggucauaaugcaacuauucagcauggaagcaucaaacagcugucacuguguagcaucuuuuccaggcaccaggaugacaucuggacucaguauuuucguguaagagaaaugguucuugcuaaucguguugucacaggaucauacaucaaacagagcuagaggcugugugccucugccaauugccuucugaucauuauucacccugaguuaagcaaagaaaaugaucagcuugggggccacaggcuaauucuuggcauacguauacuauugguuucccaagggaccaaauuuaagguuuuuguuuuccauagauugguguaagugacaugaaugggugauguuuggccaagcugugagcuagucaggugccuuauguguucauguucuuccaaauaguuggcacaguauacucuuaacucauugaggucuacuugcagguagauugauuaugcuuaauaugaaucauacggaaugaauguaaaagguaggauuaacuauaaaguaauuuuugccagucgauuuuccaucugugguagauuuguaguguauucaugaaguguauccugccuucuuaggcuuauuggagauauaucaucaauuaaaaaaaaagaagucuuaaaaagcaccccccuauacacauacauacacauagcuuaauauauuugaauuugagaugaaacuuagucacaguugauggugguauguaaaauaauacugugucuuacaaguagaaucuuaaauuugauauuuugucuuaaaaaaguggaaccuuaacuuuaauuaaauaugauaccucuauuauacaucauuauuugguuuuaacccccaacucucaugucuauuucugucugcuugguaaauugcccagcagauuuggaucaccucggugguuucgcuuccggcugggccaucuauuuaaaaagauguguguuauucacuguucaucacugguacuuuccuauccaucagauaauguaugcaacacuucagaguuuauguaacauuugagaauugugggugauagaaaagacgcuaauuuaaaugcaucgguagcauagucuucacaaauguaaucaaugcagaggggcauuagagguggggaguggaacauauaugucagugaaaacucauuuagauuaaugcuguuuacauucaccaaaauaaagaaggaacagucacuauguccuugaaucuuacaggcuuagaccuggaggagacucugagaguaugugucuuuucucacuagccaaaauuagauuuaaguacucagaugaaugguccuuuuccaugugaacaagggcuuaguauuuccuccguaauucgguaagaauauuugcccgugcucacaaaacccuuacuguaaauagcgguugucccuucaguccuagagagaugcuucuuugcgaucuuuaaaacacacacacacaccccaaaaacagaaguaaugucugugauuuguucccuuauacaugguaauuuucaggguuggaagaaauggagugucucaucugguguagagcucuacuccuaaaacauaaccauauuuugcucauugucagaaauccucaaaaaauauucccccaauaucucaucugugcugccacaaugcagaauguuaaaaggauauauuucagagggccauuuugauacuuguuuacaugcugccuaaaaauaaauuaugaaacauguaauuuuuuuuuuuaauuaccaaggaguauucuaaacaaacauuuccagcuacuaucuugcaagcaaaucuuaugaaacagugacauuuguuugauacauuugccuugguagcagaaugaaccaggaaucaucugucaccaaagugucaaucucagaauuuauuucaguuucuuccuuuuugauauaauagguauaauuaauuucacuuaacaaguauauuucacuuucuaauaaugaaacuuauuugguuuuccauuugacaauuugggugauggucaccaaguuuuuauuuuccagauuaugcuaaccuuauuugauuggcauacaccacacacugaauggagaaaccacagugaaagcuuuuucauuuuaguccugaguuaagaguuuguucuaacaguaguguugucugugauauauaaauaagcauauauacaaaaggacugucucucuccuugagaaugaaaauucuuggccaggcgugguggcucacgccuguaaucccagcacuuugggaggccgaggcgggcggaucacgaggucaggagaucuagaccauucuguccaacauggugaaacccugucucuacuaaaaugcaaaaaauuagcaaggugugguggcgcacgccuguagucccagcuacucaggaggcugagguagaggaaucgcgugaauccgggaggcagagguugcagugagcugagauugugccacugcacucuagccugggugacacagcaagacuccgucucaaaaaaaaaaaaaaauucuuauuaaugagaaggagucagguuagaauaaugguuugggauguuuguugcaaacauauuuugaaauuaggaaaaaaaaaagaaaaggaaacuauuuuuugcauuuugucagccauuuugagguuuuuggauucaguaugaaauggccaucgcuggguauguggaagaauagauacuucuugcaguguuaacugagcccucuuuuucuucacugucuccucgaaaaaaaaucuguuguggguugaauugugcccucgcagaagagaucuuaaaauucuacuuuuuugaagugacauuuaauuuucuacuuuaaugaaggugacauuauuugggaaacauaacauuuuggucaaggacagaccacauauacucuuuuaugauggugguuccauaagauuacauuggagcugaaaaauuccuauugccuacugauguagccuuuguaacaucauagcacaaugaauuacucacauguuggaggugaugcugguguaaacaagccuacugcacuuccagucguauaauaauaauaaacgacuacaugacuaguuucuguauuuacgauaccauccuuucuaucaucguuuuagaguauacucuuucugcuuauuuuuuugaaaaguuaacuauaaaacagccucaggcaguagguauuuuagaagaaggcauuguuauccgaggagaugacagcuccauguguguuauugccccugaagaccuucuaagugggacaagauguggagauucaagacagugauauaaaugcucuugacccuguguaaaccuaggcuaauguguauguuuguguuuaaguuuuaaacaaaaaacuuuaagacaauaaaacuuuaaaauugaaaguuuauaaaguaaaaaaguuauaguaagccaagauuaaucuauuauugaagaaagauuuuuaaaaaccaauauaguguagcuuaaguguacaguguuuauaaagucuaucguaguguacaguaaugucuuaggccuucacguucacucaccgcugucucacuaacucacccaaauuaacuucccuuguugccacagucauggaacacgcuguagucacgguaagugcaccauacaagcauaucauuuuuuaucauuuuuuuuuuuuuuuugagacggagucuuucucugucgcccaggcugaagugcaguggcacaagcucagcucacugcaaccucggccuccuggguuccagcaauucuccugucucagccucuugagaagcuaggauuacaggcaugugccaccaugcccggcuaauuuuuauauuuuuaguagaggcaggguuuugccauguuggccaggcuggucuugaacuccugaccucaggugaucugcccaccucggccucccaaagugcugggauuacaggcaugagccacugugcccauuuuuuaucuuuuacacugcauuuuuacuguaccuuuucuauguuuaguuacacaaauacucaccauuguguuacaguugccuacacuauucaguacuguagagucuuugcaguuguaaucaaguuagaugcgaucaugcuggcuuagaaugggcccuaaauccaguggcuuguguucugauaaaaauaaguuaagacauagagauacacagagggaagagagcaugugauaauggaggaugauccaacuguaagccaaggaauacuagggauugucaacaaggaccggaagcucggagaggcaaggacggauuauuccuuagaaccuuuaaagggaacauggcccuguuagcaucuuaaucucugacuucuggcucugaacugugaaagaauaaauuccuauuguuuuaagcuagagaguuugugguaauuuguguggcacauucccccacccccaccuuuuuuuuuucuuuuuuaacaguuuccauuuugugauuaagaaugacuuucccuuuuauaauaacaaauauaauaaaaaaaacacacagaguuuuuaagcaaauaucacauauaucaaggguauucauuuggauuuccaaaauacugcuuugaauguuucaauagaucauaaaagaacuggcauuucuggaaauugcuagaugggccaauuuccaaacauuguuguacaacguuucguuucauacuuuacaccugggagcacccugguucccccagugaaauuaggaaaacauuucucuacccuaucugcuuguaucucuuccuaagcaucugcccuuuuccaaacaucuuguucuaaguguuuuuucucauguuggugcuagugagacuucuuuuugagauggggucuugcuauguuacucagcugcccuaaacuccugagcucaagcaguaucacccacccucaguauucuguuauauauagcaaugcaaaauggacuaagacaacuuagaagcagugucuggcaccuugggagcuaucaacaaaugucugucacugccauucaaaccuauguucacacacacuuugcauauguauuuauaaauuaacaaaggaaucaaccuucagcaagacucuacccagaucuuucacacaucaugaaauacccaccaacguccauguuaaagccaguuuucauuuuuagagaugauuaaacuucugcacuaaacaacacugggcaccaaguguuuugugacuggguaguuuuugaaguucaguaggcuucaugaacaugugacuguucaaaaaagcaguuuguugagugaaaaaauaggcuuucaucuagcaguuuuagaaggaugguuugggaugagcuaaaugagauggggcaccaaucacaacaauaucaagaguagguuucuaaaaagaauguugauuguuuuauggcauuaugauaaacuuccacuaguuaucacagacuugagcauuaaacagauaaauaaaugaggggcaggguggaaaaaguaagauuuaagaaagacauuaaguccagcugugaaaaaacaauaaauuuaugauguaaaaugguguguaacaucagagacaagauuaauauucuagaauauaaaaaugaaaaaguucugcaaaaugaaauauaucuuuaaaauagaauauagaaaaguaaauaauaaaaaacccauacaaaaguccuaagaaagauacaacuuuauagccaauaaaauaguuccucuuauuuaaaacuaaucaaaggagguacauauuuacacaugugaacaugauaguaccuguauauauagguguaguuaagaaauuaaggagaagagagccuuuugugugugugauuccaguuacugugucacuuagacauccaaguacaggggugguauaaaacacuggguauuucuuauaaccaaagguucaaagcccuuauguaaauggccagcaacaggagugaagguguugggguugcauucacucuccuaggcuaaagcucauguagacaaggccccauuuaacugcaacucagaacagaaauuucugcuaggggaccaauuaguuuuaagaaugucauagccuuuucccuuugggaucuguggguucagggaaagcacauuccucuucauuccuguggucacccacagaauugugauacauuucuccuguagacugcugcaugcuaaccucuugguuuuuagucacuugggcccuuuucauccucagucacaaauagugaauuuuauaacuauuagguuaagaaguuauucagugacccagcuuguuaagaggaaaggcaaagcuguuccacugcauuuuaugaucaaggaacuugcugcacucuccugucuaccuccccguaacaaguggaaagcaaucacugaacagaggaaaugaagccuucuuauggcaguagggacugaaaaaacauugguauuuuuccuaacucuuguaaaacugagauauuaauguuauaugcaaaauauugucuuggaguugacagcuguaaauguuggaaaacucagaaagaguugauaaaguuguuagacauuagggaggauuugguagaggaaagagauucuuucagcuuuguagcacagauuugggugucuagacuuccgucuuaauuggauaaauugaagaggaaguuugguuguccauauuuggggauggagacaaggucaggaauggacaguagggacaugauagcacuauuaaauauuacuggaugagaugggauauuacauuauugauuuccaaaacacacaaccaugauauacuuuaguguggaaaguaugcaaagggaaaaugugacauacuauuugucaguuuacugaagaaaaucaguugguuuugagaucuuuaugauugauugagaagggggucucccuguuuggaccaaucugguguccaacuccuggguucgagcaauuuuuuuugccuuagccucuugaauagcuggaauuacaggccugcgccaccugcacgugucucugauuuugagauuuuuuuuagacuacagaagagaaguuguuguuguuuuuaagcaaauauucauauaguucaugaaugaaaggagaaagaugcuguguuuuuguuguguguuaucuguaccucuaccuuuuaccuggaagauagcccaaagacuuugcuaaaaugaggugcccuucuuucuucacagcuacacugguucauccuaguggcucuguugggcuuucucagaaguuagcacucuguuuuacauugugccccuuaccuuccaucuagaguuucaaaaccauaacuggucauguuugucuaccuccuugccagucccauuuauuugugucuuauuuauuuauuuauuuauuuauuuauuuauuuugagacggagucucgcucugucgccaggcuggagugcaguggugugaucucggcucacugcaaccuccaccucccggguucaagcaauucccuggccucagccucccaaguagcugggagcacuacaggcgcgugccaccacgcccagcuaacuuuucauauuuuuaguagagacaggguuucaccauuuuggccaggauggucucgaucuccugaccuugugaucugcccaccuuggccucccaaagugcugggauuacaggcgugagccaccgcacucggucuauucaugucuucuaaaugcuuuucuugucaucuuaugguaaugucugaauugaauaccauagaaagaggauaguuuguagucagacugaccuggguuucugugacuuaggagugacuaaucuuggaugaguuauuuaacaucuuugagcucugguugucuugucuguaaaacgguaauauuguugaauucuuagcuuaugugaauaugaaaugggucucacauagugcuuaugcauaauagacauuugaaugguacauaguuauuuagugguuauuagugucacucaggcuuacuuaguggcucagaguucacuuuagauccuuaacuaagaaggcaccuauaaggagccucuagcuuuucauuuacugcccauccaccucaccuagcugggagcugcuggcugccucccagggcccugauggauccccuuaggucuaaaagacuuagacuaguaaucuuggcauucauuuugaguugccuauucuuaagugucauuuuaaguucauuuguuaugcuaaugccuuaacaaauaccguguuuccuaauuaguccauauguaauaaggcaugguaccuaccugcauacuugaauacaaaauuuucuaugcaaaaacccuuaguuccgcauugcacuaugggggggauuguugcagcacauggagaaaucuuuuuucuucugacgugaaugguagugacauauuacacuagagcagaucaugaaagcuagggauacgugguuguuggagucauuuaaaauugguuuggacagugugcuguugaacagaacaccuuuugaguaguucugguccuaaauacauguuuccuugacugcuguaacagccaguccuaacuggccuccuuauuuccaguuguucugcuucucuaauccaguuauauguauggcugcuacauuaauccugaacuacaccucugauucugccacucuccuuauucucaacuuuuaaaaaggaucucauuucguagagacaauggccauauucccaugguguggccuaagcuuccaaacauuucuuauaauggccuuuauauacuguuugcuccgauuuagaaugguucuuaacaaggggccuuuggaaauguguagagacguuucuaauaugcaggucacuggggacacuuaaugguugggggucaaaagugcuccauggaacaguccugccuacugcagauuugaccaaauggcauuggcacacccacugagcaauacacaaguucgccaaacuggauugugguuuuccauauaugcuucaugcgcucuguccuuuuugcuuuuccugauuugccuccugccuggauugcucuuucuuaucauuugugugcaaguguuacccacucucauuauucaaggagucgggaccaucucugugaggcuucucugguccuuugugucagaaguaaucucuuacugagcagccauaguacuuuauccaugucuuguuuuauggcguuguuuuucuaguuuugcacugugggcacaucucaucuccauuacuagacuuuuagcuccuuugaagguaggauucagguuugauucguuuuuguauccucagcaugcagaugguuccuugaagaucauagacacuuguuuugaguggaugaagagguccauuccuacccugaagcaauagcaauuucaggaauuguuguuuguuaccugaaaacccccaccaaugggacugaaucguuuauguuaguuuugguuucuuauguguuuuauauguuuuggaauaacuuucacaucacacugacuaaaguaugguagcuucuaguugugaaaucuagucaauguguaaaacaacuagaagaucucaugguaagugggaucuucuuuggaggaagcagugagaugggugccugaguuagaauuccuuucuucaguuagaauaauggaauaucaaaauugucauggccuuuuaaaguacuuauguccaguguccugauauuacagauaauguaugaggcccagugaggcuaacuuguccaagguauggaucccaucagaaauaauuucagcauuguuguauuucuguuuucuuugacaccuaagauuuggacuuagaaucaccugccucuucaaagagagcuuccuuuguaauuuuucuucuugacuuaaugaaagccugucccaguguucucuguuuaggguuuugcucacuaaucauaaugacgccauuguucuuuucucuuuugcuagaauugcuucagugccuuaacaggcaaauuagacaaugagaagaagaaauuuuuuauuuuagaucccuuuuuauccuauuuggucauuuagagcaccaggcagucuaucuccuaaagaaugaguuucacagugcacuggggauuuaguugccuaagguguccuauggcugaaaagugaauucuuuaugauuuuggcagcauuuagaauucuucugagcuacggaaaacucaaguuuuaugaccucuuuguuaggcugcauugcagagacacuguaauauugccuagucagugagaaagaugacuagguuuguucugcgggacaucaaagaauaaaaguaggaucagauauaugggaacauauuucugcucaaugugaagaaaauaacuuucuaagaaaagugucugguagaagagagugagcugcuucaggagaagguaggaacauggagaagauuuuacaguacaugggaagcugaacuuaaaagacuuugaaguucucauccaacccacagacccugugauccuaugaccuuauaaaaaugaagagaccaauuaguucaccauagaaguaauacguuauuauuaguauuuccacacauggcuugcaagugacuuagcugguucuuguugaagcugccuucacuauguggcaaucaucguuccuccccgcccccccuucauuauacuaauauauauaauugaacacagaauucaucgagaaaaauggaaaacugauuuuauugccuugugauauugacuuuucuuuauaauuguaacuccucccaguuaugccaaguugcuggggcagagacaauagcagugcuuuggcuccauaggaguuaagaaaggaagaagaaacuuuuuuguucauuugauuuuuuuuuuuccacuuggaauagaaauccgguucugaaccuuguuucaugguuugauuuauaaguccuuccuuuuagccaaggaauaucuuuuugcuaaccuuagagcaaauuagccagaugcuuauauauuugauagagcuuuuccuucuguuauuaauaauuaaaguaaaagcaaucauaaugaaaugucaauucaguaauaaugaaaauguuccaaagcauguucagauuuguaaucucauagaauacaugagaauaauuaccuggauuauucccaguaaucguuucauagaggggaagcccaagauacugaacuuugguauaauuauuugcaguacuuaguccagauuccccuuuuucacuuaagacaacaucccauaaaauuuucgcuuggguuauauacaauuaaucugaguggugaccaguuucuugaugaucaagcuguaauaucugauccuaguuagguugcauaucuuugaggaggcagagaauaguuucaugcccugccuggcuggauccucaguaacuauucuuaguccagugccuuauuuaccugucugacuuccuauuguuucuugauugucucucccaagcaggggagauuaaucuaaacacacugaccuccuuugugguuguugaggaugaucacaguugaggucugguuguuuuccaggcagaaaagggaaguuaauuuaauaggauccuaaucacaauagugguuucugugauauaugugcaugaguuugaaaagcaguccugggguccugcauucucacauuggccugcacugccuuuugccagggacucugauaagauaacuggucuucagaugaggaauguauuucuuuucauguuaaggcaucauuaaacagccuggggagcuuauuuuucuauuuaagccucauucugucauagguuacaauccuuuggggggcagagauguguuguuaguucgcugaaaguagaauuuaauuggcuauucuacagaauaaugauuuuuaauuuggcaagagagucaugaugcagucagccuuuuaggucuuuaaaguuguauggaaguuaaagaaaguaaccaaaccuuacuuggaacacuuggcuccucccucugcaaagcagggcuguagaccucugugugugauuguggguugggcacacuggagcuucuggccaucaugaguagcuguagugggggcagggagagugaggguugucugcuucaccacugaccuuuuccaguggccuggacugaguuuuucaacugcuguauguguauucguuauagaaaugcugaagacuacaacugcccagcaagugaagcauuaucuuccuccccauuuuccuaaauaggaaguagaccuauugcaacaccuaguguaguaauguauguggcagugauuuccucuuuaauucagcaaacaugcugcaggagaauggggacucaugguaagauucugcacauuggaaauuggggacagauaucaauucuggauauauuuccuuuaaaggguaguuaguuaucacaugccuucugaggauugcaugagucaccuucuaguguggcaccccuuuucauuuggguauguagagccaugguuacuguucaacagacguugaaccagaugugccugcuauuacagaagugaaaucugacagcuguuaccuaaacucuucaguggcucuuauucuaucuaccucagccuguuuugauuuuugaagccuuauuagauacaacaauuuuugcccauggggaacaggcuuucccuuuuuggugauugacaggauacuggucaguagacagugauaagcaggauucugugauucuuuuuccccugaugaauauuguguuaacagacuacagcagcuuugugcuacagcagauucguuugaugucauagggagauggauuuccuuccacuuuagcuuuuaucugcuuguauuaauaccuaugauuagagaggcugcaugcuguuaacacauugauaauuaagauugccauguuaaagugagugguuauaggucagacauacccacacauugcugaggaucccuguagcagcuguacuuggaguuuagcuugagguugucuuagcucuuuugcuucaugugaaauuuuaugagaaaaaaaaauucucuuuaaucaucaagcacuuauugagcaccuacuguacccagaucuuuuuaugcucugccuugaagacuuaaaaaauuuuauacuaguuugguggcaacuuuggucauguaugaaauaguaugguuuagacuuggauaauuaauguuccuuaagguggggaccuauaccaguuauuuuauauugacauuuucauuguguugauaggaaacauguuaaauggaaacccuugaguucuuagauauucauggauuaauguuaccacaucuaauggauauuccaagguauaaagaaaacgaagugaacaggaaauuacuaacuuuuguugaguuucuacauauggguuauauugugauaggugcuuuguauguauuaacugauuuaaacuucuggauauuaucucacaguucugccucccccuaccauugaagccuuuaccucuugucucauuuauuacacagcuuuuuggcucacuguuucaaguaugacuguucauuucuucuuuguaaaauucagaucacaucacuucccuuccuaaaaguuuucuucacuuuugcauucuacagguuaacgucucugccgggcaaacaaagcgaggcccuugcuaacuuguccccuggcucccucucuagcaugaccuccuccuguuguauuccuuuuugaacucuccauucuuuucuacugccuauccuucuuuccucccucuggaaaacucuaagucuuccuuuaaguuugaaagcuucagagaaguaccucuccccucuccuacuucugaaaucauuauuucuuaaagaacaacuaauucugaaacauggaaaagguauaauuucagaauaauggacaguccuucaaccuggaguaauuuacaguaaauucauccaagugcauucccaccacauuguucucccuuuuuucauuuugugagaacugggaaaaacuucacuauaagcucucccuuguucacaguccuguauuuuugagccucuuguguacguagugaaagugguagagaggcuggaauugggagaaugugagugaagcaggaaaaauauaaaaagguuuuauuuauugaaauauagaauauuuuggaagagaauaguuuuuagagaaaggcauggguaguaugagagcagaaaggcaugaagaaaccccaugaucaugaaagugggggcuggcuuaaaggaauguuuuuucuuguuuuguuuuguuuuguuuuuugagacagggucuugcucuuuugcacaagcuggagugcaguggcacaaucacggcuuacuguagccucuugaccuccucagcuccugccuugaccuccugccucagccucccaaguagcugggacuacagggacacagcaccacaccuuuucugguagagaugauaucucacuaugcugcucaggcugguugagaaguucuggccucaaguaauccuuccaccuuggccucccacagugcugggauuauaggaguaagccaccaugcccggccaggaaugcauuuagauugaccaguggaaggaaggaagggaagucaaaguagaaauuaauuggaagaugaacagcauagagaaacaagggcuagucaugaagcccuccuccaagauuuuuuaauaacugcuugaguuuugugggaugauuccugaguaugcagagacagaagugauauugauucaucuugugaauucugaugcaugcucuucacagaaggaaagagaaaaaucuuauaugaguuuauuaguggugagaugacauucuuuaagaaauaccauccuugauggccauuggggaacuugagccauuuaagccuuuuggccuaaaagugaucuaacaauucaauaucuuucugggugacuguaauugcuagauguucgauagucaugaaauuuaguuagcauucuugcuguugaauugauucuuaguguuuauuugcaaaaccucaaauguguaucuaaagucuugaaugcuuucucauaguuauucauuguauacucaguagauaugaaauaucaauuuuacaggcuaccaaaaugguauuuaaugguggcugacaggauaguguuuaaggacaauauguauuggauacuuaaauuuuucuauuaccugauucuuggcacagaucauugaauuuaaguuauacugagauugcagaagaucugccugccucaauaaccccagcuaugcugcauguuuauuuaguccugguuccuuccugugccuucugcuuucuaagcauguacagaagaaaauaaaacaauuauuugguuucuaccuuaacaucugcuugcaucaggaaagaugucuaaaaaaaauuugagggacauuuuugcggacacuuccugaagccuggaccaguuuuaugugauuuguugacauccuuuuuuuuuuucuuuacccuuuucuaaugccugcuucuucaauuauccuuaaagacccaggguuuuaccacacugcaacuuaaaauuugaggguaaauuugguaaaucuugagcuccuuaaaagaugaucuguuuuauacccauuucauuuuucucuugaauuucauuuuaaauugaucgcuauguauuuuaggcuuaugcauugcccuuuuaauggcuucuuggauaaaauacauuguucaguuagauaaguaaagaagucaucuggauuacugagcaugacucacuuaaaaucucauugggaacaauuucucugcccacuccuuguuaacuauguauucugcugguaugcagaacuuaacuguucuaaagaguuaaaauaagccauggagaucaggauuugggguaacagcccucccuucaagacaaggacuaugaguuucuuuacuccacuuuuuccuugacuggcucuugguuuuccuuaucccuuuugcuauagauuucuuugcugcauaguguuuuuuuguuuuguuuuguuuuguuuguuuguuuguuuguuuguuuuuugagacggaguuucgcucugucgcccaggcuggagugcaguggcgcgaucucgacucacugcuagcuccgccucccggguucacgccauucuccugccucagccucccguguagcugggacuacaggcgcgcgccaccaugcccggcuaauuuuuguauuuuuaguagagacgggguuucaccguguuagccaggauggucucgaucuccuaaccucgugauccgcccaucucggccucccaaagugcugggauuacaggcgugagccaccgcgcccggccuuguuuguuuuuaagaaagaaauuagcauaugaguuaaacuacaaggaaguuuggaaugauuaauggaugugauauccuguacauaacccauuuuuuaguggcucucugaauaagaaaucccuuugugacuggcccagauugcauauuugcuuguaguuucuaccccaucuccuugugagggaaccucugguacauacuuuaaacuucucaucauugucaucugcucauuggcacaccuuuucuucugucuuuuuaugcuuuuuguuuguugguuuuuauugauuuuccuuuguuuguuuguuuuugaggggggacagggccuugcucuguuacccagguuauaguacaguggcuguauccuagcucacugcagccucaaauugcugggcucaagcuauccuccugccucagccucccaaguaccugguucuacagcuguguacuaccaugccugccuaauauuuaaauuuucauuguaaagucaaggucucacuauguugcccaggcuggucuugaacucuuaggcucaaggcaguugccuuccaauuuuuaaggcuguguagcuuuccugauaauaaugggaaguugguuuuucauuugauccucugagaaucuguugauuuguguugauguuuuaaugugccacaaguauuuccuguuagcugccugcagauacagaggacuuuugaaauuuugcucuuuguuccuuuuccuucucucucuguucuuccuuuccuuccucccuggcucccaauuuggauuaaaacuuaaugaguaagaggccuaaaagacguaagacauuuacacaacuguagauuuauuaucuuugaauuuuugaaaaugaacuuuuaaaggcuucuuuucuauuuuuuaagguuuucaagucaugccagugucugugcagacugacaacuagcacugggggaggggaggggaagaaguugcauuuauccaaacauuuucugaagggaucuaacuuugauuuccuuucuaugaccugauuuaauggagacauuuccaccucaaaggaggauuucaggaaugcauauauucucacuaguaggcgaaacgggugcugcuuugauuucucacacccuugguugaauaugaauguuacaauguggcauguuuuccaggaaucauagggaauugacccauuuuauguaacauuuacaggccgaugggcauuuagaguuagaaggaacaucauuuagaucuagucaacccuuucucucucuuuuuuuaaacagagaaggaaaugaaaguccagagagauuaaguaauuuuauucaacaaauauuaauugaguguauaacaugugucagacucaguacuaggugcuggaggcuacagagaugaauaaguuugagucccuguuggagacaaauacaugguucccagaucauacaguuuguaauuagcagauuagagaauagaauauuuaugaaucauucauaauccagucuuucuguauugugacagaaaugcucucagcuguccuuuuuuguaccuuuuaauuuacucauuuaauaaagucgauuuucacuuuuuaaacaaaauaaaauccauguucucucuugacccaauacccuccuuuagcugccauucuuucuugaaagauucguguacauuaaucauguacauuugaucaacuaugcgacccacuaaaaucugacugaaacugcucuugcugaacuuccagugggcauguuuuggucuucagaaaucgcuuugaauguuuuaagucuguugucauaucuuccuucuucaaauucucuucucuuugggaucacuggugcccugauucuccuggcucuuuuccuuuuuuguuuucauuuuccuuagaguuucaccugcccacuucuuauuucuuaaaugggccauacuuuugcacauguccguagccaguggucguccauccuucaagacuuagcucaguaucaucucaugaagcauaucugaccuuuucaagcauuuaggcacuuccuucccucuguucuuauaguaccuuguauauauuuccucauccugcaagguuuuggucuauauguuaagcugugccuucuaauuuuucucucuugagaaccagcaucuccagugauuggcauguacauuuuaacaaauguaguuuuacccugaaagacuucacacuugcuuaggcaaauaugugugcaggacucucugccuacuaucuaccccuccacccugcccccagcagugagucucugucugccuccccaacucuacuggguucucugagcuaggccaguguaucguugcugccaagaaacagccugugaugauucacuguuaaugguagauuuauaguucuaucaauugucugucaguauauuaacccaguuaagaagcuuaaacauaacccuuaguuacacucaaaucgauugccaaaccuuuuuaaaaaauucauaaauuacacaugcauaaaugcgagccuagcccugucugauuaaaucugaguucauaauuaaugugagacaaauaauugaauuuuuuuauagcuaaaauuagggaauuucauguuucucacugcggaagagagacuauccuacauaauggcauuguuuccauauuuaaucguaagcuaaacauucauggucuucagcaugcugacagcacccaaacaggcaaaagacacgugucugcuuuuaaggaaauccagcauacugcaauaaaaaggcaugcagguugguuuucccuaaagccucaucuucaacuuguuacguggccaugauaguucuuucaggccugauagcaugcugauucauuugcugagguagaauguguuuucucuggauuccucauuuuguuuauguuguugauccuucauccuuugcugugcacuuuuacuggaucaaaauuagcugaauagaacuaaaucaagggaaaaagaggaguguccucaaaagaaauaguggccauguguuaccauuaaaccauucagaaagaaauauuuguauuuuuaaauuauagccuuuuauuucuaauuaguuccaauguuaaaccuccuaucuuuagaaguauagagguggugacguagauuguuaggcuggugguucugaauuguuuguuuguuuguuuguuuuucuuauaaccuccuggucuuggguuguguucaagucuguaagauuuauuaggugaacauucuguagcuagguggcaugauguucuggcuucucauuagcagugacccuggagagauuucuugcauucagcaacauuuguuuggagccgcccagcauccuugucaucgaguggugaggcagagcuuggguuugggugaggaggucaccuuguacauaccucuggaggagggaguggugcugugugggggaugcuuaggcucccuggcuucccuucuccuuaaacacgaucagcucuucuaggacaaggagcugagugcuuggaggagaggaaaaggacuguuuuucucuugcucaaagucuuaagccguuaaagaggaaucauaauauuguucgacgcccugugauagcauccauuggccauggaauuuggaauuaguuaaauuagaguucaccuuuugcuccugccauuuuuagugguguggccaagggucucucaauuucuuugagccucuuuuucuucauaaguaaaaauauagguaauacuugcugacucuuuugaauugcuuugaggguuaaaugagcauagugguaucaaaaaggugagcaagaugcuguuuuuaauuucagguagcuuguaaucaccuguaggauuacagaugcauaauacugaguuggguuagauguauuacgagaauacaggauauuuuauuagaaaauucacagacggcuuccuggagucgguaagcagcauuugagcaugucuugaagaauauuuggcaucugagucaacaaaauauuucacacugcuguggcagucacaucuaggcaggagaaacaacaucaaaagaggaccauaagauccauucguggagcuuguucagcaagcaguuuggaauauaguugucaggagcagaacugggcuagcaugcuugauuguuaaauaguaacuaaguaucuuugcaguuaaccaaagaucaggguuuuauacugaacauuuuuauauuaauguggaaauugaauuugauagcauuccugaugcuucucccagauuaaauaaaucagcagaguauugaaugaaaugagcuuuaccucuccuuuuuuuuuuuuuuuuuuuuuugaggcagggucucacucuguccccaggcuggcuggagugcaguggugcuaucuccacucacugggcuugcaaccuccuggacucaagcaguucuccuaccucagccucccagacagcuacaacuacaggcacaugccaccacacccaacuaauuucuguuuuuauuuuuuguagagacagggucucacucuguugccaaggcugguuucuaacucuugggcucaagugauucaccugccuuggcugcccaaacugcugggauuaaaggcaugagccaccaugcccaacguuacuuuuuuuuaauugugguaacacauauauaacauaaaauuuaccaucuucaccauuuuuauuuacagcucugaaauguuaaauauauucacuuuauugugaaacauaucuauagaacauuuucgucuuacacaacugaaacucuguccccauuaaacagugauuucccuuuuccccuucucuuagcccugguuaugcacccagcuccacuuauuuuugacagcuggcuuaagagaaguuccuagacuucauucagaaacauugcaugauaaaauaugugauaacaaaucugggauuuuuuucaucuugcuauaguagaaaaaugacauuuugcugguauuuugggccucccgugauuugccaucuccguuaacccuuacuuuauuuacaucccauuuuaugcaauauaguaaccacguugacacauuuaagcuaacuuuagucuuccauuucuaucaugauugcaauuuacaaagccaugaaugcagccuuccugugauugggcuuuaaaaccacaaaaugauucacuauccaugagaguguucaacagcauauuagguagaaaaaauuauagguuauuuuguucucuuauuguguaauuuuuauaucuugcacauuccauggauuagacacauacugugacuugaaagucuucucuuuacuuuguguuaccaauuguugaaucuugugagcauuucucggucaucacauauuuuaacuguggaagcucuuuauguguacuaguuccuuuuuuauuggaucuuuugugcauaucugcacaguggagguggucauggugugugggggcaggcagggugaagguggugguauggaauagguaagagggaauuuucucuguagaguguuguuuaucaagagagguggacugcugcuaucugauggucacuuuucuuuguccaauugugaccugcagagagggugcuuuuagcuacugugucaggauccaguaaggagacagaaagcacaccaguuacuuuaacagagaacauaauuuaagagaugauuagcuagauaugggaauacuaacaaggugaagaaaagaacccuaaggguagcauggagguaauaacuacaugaugcagcuccuacccucuaagguugggggaauaagaaaagaaaacauauaagaacauagaaauuuagagggagaccaugugaagcugggacauagacugcuguuaacugaugcuugugucucuaagcuuggagacuaggacugggacuccaaggucuugggacccagaccucccaggagugcugccaguugauugguucugaugaaucugaggaggugugauaaccuguuucugggaguguugggaagacagcaagcugaacucgcuugcugcugcuggaacaagcuaccauugcugggaggaagaaguagugcucuggagccacuggcaggaauaggaaagaucugccccuucuuccaguucuggcucucucuggcacccccuauuggcagagccuaaggaagccagguggcaaggcagaaaugggguuugcagguucccugccccagcaucaccaaggaaaaguuuagaaagaucaguuuugaaacugcaucacaguagcuucauaaugggcauaacuacuagauccaacuuuuuccaguuugaugaguuucccagggugggcaagcacgcauuauguguugaaauuaauugaccuuuucaggucuaggggacauuguguguggugagugaaaagccaguggguaaucugccaguucuugcuaccacagcaguugggaggcagacgauagaaacugucauagguucuggggcagacagaucuuugugggagcuuuuugcucugacauaugugauaucgggcguguuauuucucugggcaccuaacuucucaggucucucagugaaguaaagcuaucauaauuccagcuuuauuugcuauugcgaggauuagaauuaauauguuuaaugugcaagcagauagcaccacucaaagaguuagugguguuuguuuuguuuuuuaaugaauuguagaaauuuagaguggcgccaacccuuuguguuaagggaguuagguuagggugccagcaguaggaaagguaaggguuucauugucacaacgcaauggugauaggauugacauaaaaacauuguuaaacaggcaccauuucaguuauuuuauggcuggaaggacaaggguauuuagggugacauuacaugaaggaggauauaaaacuguguucucacagaucaaggcaccagucucacgucccaugucauuccccacagaugaaacagcugugaacagcuaccgcaguuauagagcgagaaguuccccauucuugcccuccuccccuccacccucaccugacuguccugugcacugugacuugccugccuguuuacuaggugcaaccaacuggagaaaagaaccccaacaaauuccugaguauggcuucaaguuuguuacggucccuucacacaguggggcaaggcaugcuauauauauauaaugaaauugcuaugccagcuggguacugcaucuacaugucugugcuguucauaguucuuuuaaguuuauuugcccguauuucuccaugauaguagugggugauaaauguugaaguuuucugauugaugucaaguagacuguaaaguaaaagaaagucaucuuccuucguuaagguuagacugauaucuguccugaaaagguacaggccucauuuuacugaauauuuaugcacaggcuuagaauacuuugaauuugguggauaaaauauguggcacuagaccuggcauccugauuuagaccuuggagggacgcagcaacuaaacagaaacccagugucuaaagggagaccuuucugugugcacuuacauaauucagucuuguguuuugaaaugcacaacaauucauugcacaaauuugacuggaaaucuggcucaguugaagguuccacuggcaccagcuaaauaauggugucauauccagccuuauuuucccuucuguguucuuccaggaagaaacuuuaauaauaauaauuauuuuuuaauauggugaagaaaggaagacauacacaaagaagcauuucucuaacaaaaugauauuauccucugaaugggcucacccgcuccuucugucuguuacagagaaaauugguuuccuguugucagagauuuauuuucuuuuccuccuguucuuuuccccucuucuguaacugugggaggguuuguggcacaucccugugcuggauggguuucaucuggcuuggugccuguacuuuaaguaacgggguugucucuucugagggcauuggcucuccauuuuuagccgggguaugaacaguaagaaaugugggagaagauuucuccauuacuagaaaacaugaucuggggccaacugguuaauuaugagcuuccaaugaaaaggaaaguagugccagaagggcauagccaguugugauauacugguccuugcugccaccgguuaccauacugguuuccauuaccuugaaaaccuuuagaccugcuuuugucuuugaaggcuucuuucucucugcucauuuuccucuacugcuuuuaaacucuggcuucuuauuuguagauuuuuuuaaauguccuuuccaaugaaggaaauuuccccuuuuuaauguugauucauguuucuaguugaucuucacaacuauuagcuagguagaaagaugcucuucugcagagacacuaauuauauuuuauuucuucucagcucuacuugcucauuuaaacagcacccaaagagauuucauucaccaaaacuucaugccuguauugcugcagaugagucuuuccagagcaaaggaagagcucuaugaucuuucacuacccuuuccuucuuuucuuccaauuuaaccucaaaauauaccaaccccagcaacuguguuuacuuaggguuaaucucaacuucaugaguuuuuuugaggaagcuaguucuuuugaaaauauuccucuuuauaugguaguuuacuaucauauuuauuuuagcguugaacugucacacauaaaauauuuuuaguguaucaguucagcuuuacuugaacucugaaugguauuauauguguucuguaaggauuucugcuaacuuagcuaauaauagacugaggguguguuuuuucaagaucauaaguaauauaauucauuaugucaaacuuguagguguagagagaauagaagauuguuuuaaagucuuaggucaaaagagagcauagugauuauuuggauuuuguaaauuuggauuuucucuaacauuagacgcaggcugccaagaguacuacuuuuucauuagcaauuacaaagggucuagguuuugcaguuguacaaugagauaucuaguuaaauguuuucuaaucuuuuauuuauuuauuuauuuauuuuauuuuauuuauuuuugagacacagucuugcucugucacccaggcuggagugcaguggcgugaucucgguucacugcaagcuccgccucccggguucacgccauuguccugccucagccucccuaguagcugggacuacgggcgcccaucaccacuaccagcuaauuuuuuauauuuuuaguggagacgggguuucaccauguuagccaggauggucucgaucuccugaccuugugauccgcccuccuuggccucccaaagugcugauguuuucuaaucuuuauugauuaauggacuuaucuaguauaguauaaaaucauauuuaguaauaguagccagaagguugaggaacaguuuguauucaacuaguauaguauaagcgccuucauucuaugaauuugcuaacaaugguauaaaguugcagugauacaacugcccccccuuuaaaguucacuuugagauuuacuaaccagauuuauuaaaucccauaaucacaagaaauagaguuuuaguugucaaaaauaaauuuuuuagauaggucuuucuauauuccccauuauauucccucaguauuuugauauuucuaggaauguggcacuaugcugggcacuuucuagguaccauaaacagcuuuuuuucucguucauagaucuucccucauguagucuggcagaggcaguaagaccuguauaaaguaauuaaauuacaauaauacaaggcagaaagugauuagugcuauaacuuuggcuuaucucgucuucugucccuugacauuuuugcucuuguuaacauccauguuagaugcuguaaaacuuaagcuaaguagcuuugcuucuuagcagcaguaaaaguauagaucugguuuucucacggaguuuauauuugccaaaauguuccuugagugugaacuuagacuugccuuaauucguacuaauuagcccauuucugauuuuuacaguuuugaaauaauuuugcuugguuuucaccacaaagucauaaguaaguccagauaauuuuuauuuuccugagucuuuuuuuuuuuuuuuuuuuugcuauugagucucucucugucacccaggcuggagugcaguggcaugaucucagcuaaacgcaaccuccaccuccuggguucaagcgauucuccuaucucagccucccgaguagcugggauuacaggugaacgccaccaugcugggcuaauuuuuguauuuuuaguggagacaggguuucaccaugcuggucaggccggucuugaacucuugaccucagguuauccacccaccucacccucccacagugcugggauuacaggugugagccgcugugcccgggcuauuuugcugauucuuaagaggaaaccgaggcaagccaccaaguaggaggccaguagguugggccacaaucacuguguagagcccagguuucuaguagaucagcaucaagcugccugcuacucuuggccauuuguuugccaugaaauauucagggaauguuugauuucaagguugagggcagcucuuuuccucauugccuucaggagaacugaacucaagccuuguucucuucaggaauugaugcccuuucugcuucauuaucccaggcuuacuggcugaguccucacuguuccucuaggaaaaguagcauagacuucauucccucuuggagcagauuuuuacuuucagagcacuucgggggugggaaauguuuguguccgguuacauguuggaagccaugccugcacagggaaaggaagauggggcagggccccagcaucuuuuuguuuucaauuuucuucagugggugugggagccacuuugcugcugguggcccaacuucuugugagccuucagguccuuucacauuuagguuugugaggggugauacuguucuuuuauuucaccuuuuuuccccccuugcaguaguauuuguagcuaagugaagggaccgcauaugguuugcuacuuggauaaugguuugggagccccuagagccuuuaagcuauuuaaaguccugacagggucuugggggaacaaagaccucaugcuuggcuccugcuauuuccuccccauccuucucucuguccucuucccucucucauccuuacugcgucugagcaauaaauagcaagugcuucugaaauacucuuaguuggcuaauguaauugaguagaagaacacucuuuagacgcagauuuuuuuucuuacaugauggucuugaaaaugguacuuuaauuucagggugugcagguaccuguggaauauaaucauaugcugugcacuggagauaacgggucaggcucuuuaaggacaugaggccgccuaaauuugcuuuacuucuucccucuuugguccugugaaacucuuguucuccuacuggcaagcugccaggggacauuuguaaucaagacuguuucuuggaauugccacugccucuucuuuucugcucucacuguggcuaguguggguccagaccccuggauggcuuugggggcuugggcaggaaaggagacaagacaugccuacucuugccauuccugucauggccagguugguuugcugucuuagauucucagaucccacacccaggcuuccaguagcuggaacuaaggaauauuuggaaauuuuguuuugucacuguuacuacaauguuuccuggugucuuauuuguauagaaguuggagggguauugaauucucccauuuuuauuaaccuacuuacuuuuuuuuuuaauugaacuauuuuggcauuaaucaaguucuccaguguggcuuucugcauuuaauaaaacucugacccccucuuuguuuuauugccuucgauuuaaaagucauggggccaagugccuaaaauauagacauuuuuguggccuggagaccuccuugcuacuuauuuaaaaauucacauggucagauacaguggcucaugccuauaauccuagcucuuugaaaggcugaggcgggaggaucacuugaacccaggaauuugauaucagcccugguaacauaacaagacccugucucuacagaaaauuaaaauaauuagcugggugugguggugcauaccuauaguccccagcuacucggcaggcugagguggaaggaucaugugagccuggaacgucaaggcuacagugagcccuugucaugccauugcaucaggagcaacaacauagcgagacuguguuaaagaacaaaaauuaaaaagcacguuugugggaaucacaccagaccuacugagucagauuaucuggugugggcuugguagucugcaugguuauaagcucccaggagauucuuaggcacacugaaaccugacaaccaccgacagguggugauugucuuuuggcaguaaaaaaccaagagcugcagugccuggcucacaagccaugagccucugggguaccugggaucaaaaucccagcuuugcuauuacuaguuaugugacaucaggcaaguuacuuaaacuguaagccucaguugccuucuaguaaaagggggaucaugauccuuaccagguaggacugcuaucagcauuaagccuauuugauaggguuaucuguaacuauuauuauucuuuaaguucuagugcuuuucacacaugcuaauagggccuuaaagaugggaucagcaggaucaaauaggguugucagaaagauugagaaauuggaggguccuacacaagccacaaugaaacacuuaagggagguaguuaucuucauaaucaccuccuucuaaccucacaccuguacauuuuaucacguagauuccaguuuuuaaaaaaguuggauuuuaguuucuauuguuuuccauuucgucuuugcuuccuggaagauaugcuaaauguauugcguugcugugaauuuggcacuugcucagaucaugucucuguuauagacuguauuuacuuuuaagagguauuuugaguggagagaaugaaauagagcugguuggaaauaaagcugcuuuuuccuugaaacaacucuugagguauuuggaucuaugaggcuucuguguaugguccuuuaggaauacuuagguaucuuaggaagauaaaagauaccuucuauucggccagguggucacaauuuuaaaccuuccuccugcugcuagcuuguagcuuucuaguuaucagaccugccuuuuauagaaaugugcuacuguauguguuaaggaccauaaaacaguggcuaucccuguguguucugucuccuggaugccaagggaauugaaagguccuuaauuguaaauaugcccagggcaugugguaaugcuccuauuuuaagucuauaauugaaauggaaauugcagccuuuguuuauuaaaauggcauguguggcagggcaacugggacugguccauuauuuacuguuugaaaucuuacccauuuuaaucugaucaugucuguaguucuuauuguaauucaacagucaguuuuaagaucaucauggaguauaauuccacuugggcacauuaauucauauauuauuguugaggcuccuuuuaaaaauaaaaaucaaacuuguuuuugacccuguuuauagaacuuuuguaguuaaauuuauuuccucugccucacagaaggauauaucuguagaagaguauccuuuuuuugaggaaauaaguggaauuuaauacauuucuuaugaggaaaagaauggccaguuauucugcugaagagaggaauaaaaguaugaaauauugggagaaaugggaaagggugaucaaagaagcuuuggagauuuucucucccucaacacuuuugucuuaaaaaagaaauauaaguuuauagaauaacauaacaaacaucuggguuccuuuuucagccuugauauucuucccugugugcuucagagccuuguuuuuuuccuuuuuacuguuguguauuacacacacaguugaaagucccuguguacuuguccucaaccccauuuugagguuuucucuuucucuccccacccauuccacaucaguaaccauugugcauuuuuauucuuuugcugcuuacauagcucuaugaauaauauacuauuguuuguaucuguuuuuagucugcauuuauauuggguuuuacuauaucagucuacaacuugcuuuuccagcucaauuuuguuuuuucagucuguccauuugcuauguugcucuaaaucagccaaacuacuguguauuccauugggugacuauaccauauccaguguuaauauggauguuguuauacuugucuugcacguaugagaauuuucuggggcauauaccuaccuguaaguagcauuucguaguuagagguauguguguuaccaccuuuaaccaaacagugccacauagcgccacaucaaagugccaaaguauuuaaccuuuuuauacucccaucagugguuaaggggcauuccuauuucuccacauucuuuaaaauauuugccaauauguuggagguacuguaucucaauuuacauuuuucugacaauuaucaaguuauacuuuuuugcauacuuaauguguccuuggacuucuucagugaaguaccuguuuauaucuuuugccaauucaucuauggguuuauuucucuuuuucuuaucaauuguccguuauuuacugaguaaaucaaaguaaucagaagagaaaccccaccaacucucaguaccacaucuauccacccaccuacuggaaucugcauccauacaccugcagaugaacuacuggugcucuguggaaagccauucuguccauggcauggacauugcuuuagcaguucucuucucucucuccuuugcucaccacuagaccauugccuguuauuucuccaaucugaaaucaaacccaaaaaccuuaucuucgcucugccgccuccuugccggggaaggugcacgccaccauagucucuucguacuccuucaugacacagcuuuugaaaggacuguauauacacuugacccuugaauagugugggguuuaggauugccagccuccgcguggucaaaaauucauguauagaacucuuuuuuuuugagacagagucuugcucugucgcccccgcuggagugcaguggcgcgaucucagcucacugcaagcuccaccuccagaguucacgccauucuccugccucagccucccgaguagcugggacuacaggcacccaccaccaugcuuggcuaaauuuuuuuuuguauuuuuaguagagaugggguuucacuguguuagccaggauggucuugaucuccugaccucaugauccaccuuccuuggccucccaaagugcugggauuacaggcgugaaccaccgcgcccagcucuagaacuuuuuacuccccccaaaauucaacuacuaauugccuacuguugaccagaacaggagagguuggucuugcugucacaggaauggcaggggcaggagaaaauccagauguaagugggccugcacaguuuaaacccaugucauucaagggucaacuguucuugcuguccucagguuuuuucuuaacauucucuugugcacccauuuguaguuucaaccaggcuuuuaccccuagugcucuaccaaaaguaugcucaucaaacuaccaaugacccacacuuagcuagauccaaagugcaaaucuuaguucccauuuugcuugccuuaguuuguggcauuugacacaguugaucauuccuucuuguccacucguuuucuuuucuugguuuccagaacacagcauucugguauuuuccuuccgcccugcuuacugguugcuccuucucagucuccuguugcauauucaugaccuuuuaauguuagaagauacuaccuauaugccaacaacucccaaacguauuuugcuggguccaaacuccauguuuguauacccaacugcccauucaacaucuccacucagguaucuaauagcugaagcuuagcaugucuccugaucuuacccuucuccguucgucuauucuacuggugaaucuucccgaucuuauuugauggaccccagccaucuuuacauuugcucagauaaaaaaggagucauucuugauuccuccuuuucuuucauuccuaacguuccauccgucuucuuucagaauguauccaguucugaccacuucuugccuuccucacugccgcugccuugauguaaucucuuaugauuuccugcccagauuacuaucauaaucuccuaauuuguuuccucugcuccauccuuuucuugucacagugucuguuuucaacacaaaaggcaaaauaauucuuucaaaugugaagucagcucugugucuucaucuccugcugccucccgcuccugcauucugcucuagcugcagugguggugccuuuguugcuaaugugcauuggcuguuaucuuugcuuuucuuccgaugacugggcaucccauaccucuuugaguuuuugauaaaaucaaucucagugcggccugcccugauauuacagcuguggcccugcaccccuguucccuuuccugcucuccauguucuuuuuuccauuucacuuaucccuacugucagugcuuucuuugacuuuucacuucauucaugaugucuuuucaguacagaacuuuuaaaauuuuaguggagccacacauuucaaccuuuuuuaaauauauaauuuguuacuauuaaaaaauuuuuauuuuuuacacuuuaaaaaaugagaucaaauauacauauaaaauuuaccaucuucaccauuuugaguguauaucaguggcaaucaauuuauauucuuuuuucugccuucauuucucccucauuuauaauaauccuacaguaucccaaggucauuuaguuuugggguacaauguuuaagaaugggcuagguaaaauuaggccugaauggggguugagaauaaggacuugauucaaguucucuuucauucccuccuaaugaacauuggccagacucccaauuuuggcaaccagccaaaaauaccuuccugaaaaaaugcuagcuguaucuucagaugcugagauguggauauugggccuccuucccaaacugaugagagguacagaugacugacguuaccucuuccaucucuaaugugagucauugcagggccuacaugcaaugucauuucucaggaugaacagugauuacagcacauauugguuuguguauuauccacccacgaguuuaugaagcaagcauuuuuuccuauuuuuauuuuuuaaaaaauauuuccauguaaauuagaaucuaaacuagacaguucuguuuaagcaggcaaaauucagcuaaaguccuguuuucugagaauugagaauacauuccauaccucacuugccucuuggagauuucaaaggcuuuuauauaccugguaauuugcaggaauugcuuuuauuuugugguuucucagggacuucuaauaucucucuuguaagauguuugcagaugucaauagcuacuagcucugagggguuagaguaacaagaucauucugugguaucuuguuuucugcuugugcuauuaguucuuuucuagcuucaugagagacauauaaucagacucugaaggugccuuguuuuuuauugggauguuuguugauacacuuuuuauuuuccuucauucuuuugaggguauuuuguccuguggagugucuuaaaagcaagauucuuauuuagacaaacauuuucaaacauuuaguuguaccucaacccauaaucuucauuugaaggcucauuggaacaguguuucuuaccuuuuauuccuaguuuuggaauuacagccaacugacauuccuuucuaccucugugcuguuucagaauauguggggagacagauguagcggugcaugcuuauaguccuagcuacucaggaggccgagaugggaggacugccugaagccaggaguucaagacuagccugagcaacauaguaagaccccauaucuuuaaaaaaaaaaaaauguagguaaguugcaggauuuuggguucugaggcaaaucauaaggcuauguaaggucagugucguuauuuuguucaauucauuuuucaaaauguucacuuagucuuuaguaaucacagagcuacccucagaaaauagaauguccacuguuguuuggugaauaugaguacgcugacacuucuuuauuccugagggcugguugugauaaccauugauuuugucuuuauuuaaaauccuguuuauuaccggcaccugguaucuucugucuggcaagcauucuuacguaugauugagcgccaucaccaacucugcuuuacagcuuauguuacacuuggcuccuuaagagaucucugauuuguaaucuauuuuuauaaaauauccauaauccuguacaucugucccuuguguuaaccaggauuccccuaacccaggcaauuucuaugcaucccauuuccuuuauuuucuauaagaaaaccucaauguuauuuuguuccucuaaagauuuucauguuuacggucauauccuucccauuagacagugaucaugacacaccugggccuugaucagagcucagccaccccagaggcuucuaucuggaguauguugauuuccacauaugaucugggagaaggagcuaccuuaaguuucuagaagagcacuggaaugaugaucauuaugcccucugcccccacuuuuuuuaacaggagguagaaaacagcugauuagugaauaugaaacucaaauuuccuugacacugaaaguguuaucugcauucucauaagagauuuucuuggucguagucaaugaauugaaauguuuguaugugcuagaggcauggaggcuuaguuugcaucgaggaggaagcaucuauuucauagauccccuuaaccauaauaucgaccuuaggaugauuuuuaaauggggcauugaaaugaugaaggcuguuuacuuaagaguagcggcuauuuaggaaaaaauguaauaucugcuuugaguacaguuuggacugcacagaggugucuuguuuugucaggugcauaauagguggcaaagguucggccagauuggauaagcauagaggauguggaaucaaugguguacaucuaggguagggguuaguccuugauuuucuccugucuuucuauacuuuuugcaaauauuuuccuggagguucucaagucugcaaagcaguccuguucuccuagcauacuugaucuuuguauaucagucugcauguuucuuuggagcuacuuaaaucuaacuguaguuauugaguauguacuaaugagggagguacuguacuuggcucuggggaguuaaagaaaaacaaaugggucuuuuuugucuuggaacuuauaggcuucugggagggaaacauuaaagugaaguauaccaacugguguagucaggaucucuuauuucuuauacaaagacaaaagucucuugacuuacgcaugucaucaugacuccacauuggauuccuacuccuuuauccucccuuucuacaccauugucaguucccguuaauucauuucuucaagugguucucaucaucucucgggcuccuguccuuuccuacuucuguuaccuucaucuagauagacccucuuauaucaucuaaaaauggcauugcuuagaauagccaccucuuuuaggagaagucuggggccuaugagauaaugaaguaaguguguauguguugacauacuauuucuuccugccucucuucuuuugguuuuucuguuuuuuccaacuuuaauuuuccuccuauuucuuuacuauccugcaaacucauauuaaaucugaccuugucaaugaaacauuuccugauuacuucuuuccacuucccugaacacuuauagcauuuagucccuagucuguaucacauguauuagcauagcacuuaaucaaaacacuuguccaggugugauggcucaggccuguaaucccagcacuuugggugggaggcagaggcagguggaucauuugaggucaggaguuugagaccagccuagccaauaggugaaaccccaucucuacuaaaaauacaaaaauuagcuggguguggugacacaugccuguaaucccagcuacuguggaggcugaggcacaagaguugcuugaacccaggaggcggagguugcagugagccaagaucaugccccugcacuccagccugggcaacagagcaagacucugucugaaaaaaaaggaagaaaaaaacugcuuuguguugcuauuucauaucuguaggauuucuguuauuacuauuuuaaguuucauaauuuuugaguccaggauuauauauguauuuacagaaugcuuuguauggaacuaacaguugguaggugcucaguaaagauuuuuugaguaauagaauuggauuuaaaauaucuauaaauauuugaaggguccuaauacuuaauugagcuucuucuguaauacaguuuaugccucuaugucuguguuaaagaccauuuguuuccaguuuggguaauuacaaacacuucauuucuuauuugugagccuguuaugugaaaaagguagcccuauucucaguaaagcauuucaaccaaauacuuuuaaucauuuauuaugugucuuaacacauuuaauauuugcgauacuaagagauaaccaauuucagacacauuccuauaucuugugcuguuguacauguucauuugauauuguucauuccugaugucauguuuuauuuuacuuuuaggauaagaacaagaaacugcguccccuguaugacauuccuuacauguuugaggcccgggaauuucuucgaaaaaagcuuauugggaagaagguaaguaauugaugacagaagcauauuugcaagugguugggcuuaagcuaaucuuuuggaggcaauuguuauaagcugggcccuuuaccagcagaugacacuucuccaucaagucaaauggaauuacuuugauaugaagagaggcguguuuaugugucagaaacgguacccgaugggagagguuuaaaauuggggcccugaccacaguuugauugccaauagucucacagcaggguccgggcucaacuccaguuuuaauaauugcauauugcccugagcuccauucaguuggcucucuuguucucuccagccaccuucauuaaauguccagggcuauggaauuuacuagcgagggaagguugcugcuuuuucaugcuuccccuacuucugagggauaggcuggcuauaaggggaagaggggaugaccuggacuaagagcacgccuauuguaaugcacuguggcaucaaugcucccucuauucuucuggcuggcagaauuuccuauacccugugggaguuuuuuuuuucaggaagggguguguggcuuccugauaguucaugugcagauuuuuguguagcuugauggcuucuuuuuuuuuuuuuuuuugagacaacaucucacucuguugccuagucuggagugcagaggugugaucucagcucacugcaaccucugcacccugaguucaagcauuucuaccaccucagccuccagaauagcugggacugcagguaugcaccaccacgccuggcuaauuuuuguauuuuuuuggucgagacggaguuucaccaugguggccaggcuggucuugaacuccugaccucaagugauccacccgccucagccucccaaagugcugggauuacaggcaugggccacugcacccggccuugugacagguuuaauaagccucugacuuuugaacuaauaccaaaaugguguauccuaauuauaaauacaaccauuuuuauuguauaccauagucacuaggaugauaauuauaguaagagauuuugaaguuggacauaagguaaaauugcuaauuuugaggaagagaaaccaaacuggauucucaaaaaugaguauucgaucuacucagguuucuucagagaauagguucaucugucauuguacaaaacuugacagcaugcuguauucauucaugagguggaguacgaaugauggcuuuaagcuucuuucaauuucuagaucuccuguuaucugaucuaaugucugacaucucuauuacaccaaguugauaucauuucgcucauuuacuggcuuauaaacaguugcuuacagauagccaaggaauuucuucacaaguguggguuucuauugaaauuuaucuaaaaucacauugaaaggaguggcagcacauaucugauucguguguagccaguuguguggcguguauuauggcauccaccugguuuauuugaauauugccuuaacccugauucuguuucaucccugggaccauagaucauagcuuauugcagcagcugcuaauggccuuggaagguuagaccaagguucugcucucaagaacuguaugccaggccauuguaaagugcucugucacaggauaaaaggacuaaccuccagugucagauauggagucaauucuuaaucaauuagguucccucuuggugagagaagccuccuuuauugguuccugugcaacagaguugauuguauucuauuugugcugagcucaaguuuuguuccccagagugacauuguauaaaugaugaauauuguaucccugaguagugaguaggaugcaacucagcucugcugggcuggaacauuccugaugcaaacugcuuuuccugacucaccaccugaaaccacuugccugucuucugggccugucacuugccacagugaacacccauguacucuggcgucugggagcaggcagggcaguugcugccucaggggaguggcuagcacaucauugcacauuucuaccaauucccuucagaccucugcagcuguucagcauggcacauggugauuaagaggcaccacgagggagcauguguaucuaugugccugugugcacgaaagcugauuagggcagccugucacagcuuaagaaagauaauggagguaaaaucaucuucucugccuagacuauuauuugaccuucucagggauuccauaauaugacaauuuugaggaguugcuagaaugcagagaaauaagacugaagguaaacugcuaagguguuuuguuggcuuugaugaccuccauccuaguuuuuggaaauggauucacuuccuggauuuaauucuggauuaaugccuuuaauuaaauuacccauacuucucuuggaggcuuuguuucguaauuugugaaccgggacuauuacuugcuuuccuucucucaugaaguugaguuaugagaauauaggaugaugguaguauuucauguuuguccagaugccaguaaaguauaugguuugauuuugcuuaauacuguuuuuauauagaaucuuucauagcccuacuuuuucaguuaugauauauuccugguucugagguuaugagaagugcaucagcgugcgacuaaucugacaucauaaggaguauuuuucccuuucuuuguugguucugcugacuuuauugccuuuucaacccauugcaugaauuccaguguuauuuaauuagaugugcaugagggcuuuagcuuucagaagaugaguaugugcuggugcuaaaggguguguauguguguguuucuaauugagagagugguagaagaauacuguguguauccuugaagcauuuuggaaacucccucaauugccauacugccuaguagaacucucuucccaucuccuguuuaccaucugcccucuuucacuaaaaucuugacuaaggaauauucacagcaaagaguuuuguguuaauuucuucacaggcucaucaugaaauggaauuuguaauaacuuuaacauguuuucugguuuuccagaaugauuuucucgcugugugaauacgauggugagacugguguccuuaggcuguggucuucuucugauagcaggagcaaucuuuuucuguguuuauaauuuauuucccuuaacgcuuagagaucaguuugcauugcccuagucauuuugcuuucaggagaauaagguaguaacugggaucuucauugggauuucccuccagcuaucuuauaaaauaucuaaaguugagacucaguaugguuuauccaugugauacaguuuuuuaaaaugacauaugagucauuucuauagcucuugucccuuaauugcagaauuucuaucaccaugggaaccauuguauuuaaacuugcaauuuguuuggacaacuggaguuucaaaaaugauggaaaagauggaauuguaagaagccagagugcauugaagcuucugugcugacaguagaugcucauuguaaacuguucuaucaucagagacuguccugaaaauauaugccuauugcuuuaaugucccuuuuacuauuucuuuugaugagcaaauauuggggaugagccucauuuguaaacuaacagcagccuuuuuguggcuuucaugccauugaaauuuguuaucugaacuaacccagcucuuuuuaggcacuuagaauugggcauuuuucuugaucagugcagacauuugggaaguuauggggcuauaaaucauuuagugaguuauuucaaauccagauugccuuagauuguuguucucuuuucaaaaucugucuuucuugagguauguacuuuuaggguguggagauggaaaugaucuccaugugcaccagacuuauaaauccagaauuuccaagacuaaucucuugaucuucugguggacaucuggcucuccuccgguguuaugggaguuaccccauuaucuauugcuaucagacaucuuugacacccuuauuccagucccucacccacuucugcuggauauguaucugaaugauuccuccuuuccagugcacggcgccuaccuugcuuauaucucgucuagccuggacuccuauguggccuuccuacugguuuugccacaagaaucaggguguuagacuaccuccucguaucaguaauccaaaaucaaucuggaaaugguuaauauauguaaugauauuaucucuauucuggguaaaugugcuucugugagcuagguuggcaacccaacuacuguuuauagacuuguuucuauaaaauaaaauaaaauauucuaaaugucuaagcagaguuuuggagauguggcucauuuguaauuugguggcuaccauuuuaugauuuucaugccauugaaauuucuucugugaaguagacuauuuuuuuugguaaagcauuugauagaaugccgauuauaucuucaaggguuaggacugcuguuuauuggguucucucuucauaguaagcacugaacucugagaacuuuguuuucacuuuuaauuuuugccuccacccugcaagaucuacauguuguucuggucuuuacaaguaaagaaacuggagcccacagaaaaguacuuuacucagaugccaaugcuuuuaauugcuaugcugaauuaaagacuuuuagaaauguuuacuucucuguuguguauacugagucagauauagacagggucgugguauuuuuggaauaaugucuguuccuguauauaauacauccuuuacaugcugcaagaaaguagauuucuucagguagucuguggcuaucaggaggugguaauagcacuguauaucugccuucagagugcuuuuagcccucuagacaguaucucauuagucuuugagaugucccugugaaguuguguuucaucaagucguucuucagagaaagcagugucagauuacauguucuucgccuaaauauacagacaaugugaaguccucgauaacauugcuaagccaauuuugaagcuugauuucucuuucucuucauucgcuuggcauaggugugacuucugggagcaucagggagaaaggaaggacagguguugcuuuuuuuuaucuuggcacagggucacggagaaguugaggggcacuguaggugcuuguuccacuguaugagaauagaucuccgaagguaccgggaguaacauugcuuagcaggaccaguuuuucacucugcuagugagagcucuucaagggcacacagcuuuccugaggaggacuccacccuucucccuggcuauuuaucaggguugugcuuuuccuuaaaaacacuuguguucugucuguugcaguguguuaccuaaucagcuguguuaaguacaaaaagcugggauucuggggauucuuguuccuaauuaccucuauuuaaguuuggauuuuauaaacauuucuuuugucaucuccacauuuuucaccucauauuaauuugauucauucaugcuauggaaaaguccuuuacauuaaugaucaaagcaggcccuaagguugugaaugcauugugauuuaaauugacagguuuauacaagguugcuuguccuugccuccucagugccagcuguucgguguggcuguaaauuuuuugaacaaaugacugaagauauuugccaaauugagagcuguuuugaaugacuuguaauuuccgaccaugcauuuuucuaggaagaguucucccacuuggaagugguaguaaugugucaacaugcauuggagaccauguuucauuuuagaugcucuuuacccuuuggguuuugggaaggauccuaaucuuuuaccccuugauucuugagcucucuuguaaagagaagguugauuaacagaaaugacuggaguugccuguuucuggaagcucagcaagguagcuuucuuccugcugccaccuaaauggucuuuucgauaaugaguuuuugguuguuuguuguuguuguuguuuucccugcagacucugaaaaguaccucuguucuuugaggacuaucaggguguugagcugagcacacauuucuuuggugaaguguguuauuuguuguuguuguuguuguuguuuucuugaaauggaguuuugcucuuguggcccaggcuggagugcaagcaauggcaggaucuuggcucacugcaacguccgccucccagguucaagugauucuccugccuuagccgcccaaguagcugggauuaugggcaccugccaccacaccuggcuaauuuuuuauauuuuuaguggagaugggguuucaccauguuggccaggcaggucucaaacuccugaccucaggugauccaccugccuuggccucccaaagugcugggauuacagguguaagccaccacgcucggccuugaaguguguuauuugugugauguauguuguaauauccucuuuaaaaagcaucucuaaguuaaaugaagaagcuagaguuuucaacugcguuccuggaaauuucuuccguaugcucaccugagggaaaugauuuauuagcuaccagaauccucgagauucucauaucucugggauauacucuuauauuaauuugcuuauuauuaaagacuuucuuacuuggacucccaaguugcucauauuuuucuggugaauguucccauauuuauaacaugauuuguggucggcuugucuuaagccacccacuccugaucuuuucagcuggguuucugaaaugucguccuuggggcuggaacuuuccaugcuuacucucugcaaaccaagauuuuauuuuaggggagauuugugcugaaucagcucagcuguguuuggggguagggagaggacaggcuuuuuuucccacuuuaaaaauaacccuuaugugccaaaaaacccuauaaaaugugcugaauugcaaaucuuccaacuuccuauaccuccugguuuacagagaauagauucuuuugagcuugggcuugaugauacugugcagaauaucuuauguuguagacgagugugaagugaggcuggaugcagaugugcucauuuggaaaggaaaccugacuauugcuaucuuuuuucaguauuuuuuucuccagcauacgaucaguuuuguccacuuacaaggaucuauguagggauacuagauauaaauuuucuaaugagaaaaacguuuucuuguguaucugcaaaauaacccauaucauucagaaagaguccaauuggaaagcaccaacauuccaggguuucuauguaaguggaucucuuuuuguuaugcucuguaaaguugggcuaauuguuuagguugcuugaauauuucuuucccaaggguauaaacaguuuguuugcgugugagaagguaggaugcacaagugucuguugguucuaagguugaaauuugucgacuuuuuauaguugggugauagaagugauauuuuaaaggcuacaucuucauaauuugggucauguaguuguaaguuaaaaaaugagccccuuguuuuaauguauuuaaaaucugagugauacuuuuugcucuuaugugaaagaaauuauuuuuauugacacccagaauuggcuuuuuuuuacuuuuaccugagcaguuaucuucuucuggcaaaacuuaagguaucccuaaaguguaacaguucuaucccaugaguauugcuagcuuggacaguccuuccugauguuuucaugaugauauguguagugggguugcacagcaucuccccagaauacccauccaucucgaaccuuagagugugaccuuauuuggaaauaaggucuuugcagauguaauuaguuaagguaaaauuaagugauacuggauuaugauggacccuaaauucauugaccaguauccuaauaagaagacgaucuauagccaggcgugguggacugcaccuguagucccagcuauuuggguggcugagauaggagaaucacuugagccuaggaguuggaggccgcagugaaccaugaucaugccacuggacucuagucugugcaacagagugagaccccaacucuagaagaagaaggaggaggaggaggggagaagaagagaaggaggaggaggacgaggaggaguauugggcacagagagaaagagaccaugugacaguggagguagaaauuggagugguuuuagcuacaagccaggaaaugccaacaauugccaggaugcaccagcuaggaagaggcaaggaaggauaccucccuggggccuuuagagguauaaugauccugccuacaccuugauuuucaacuuggagcuuuuggaauuuugaggggguaauuugcgguacuuuguuauggcagcccuaggaaagcaauuuagcuuguaucuggccacuugacucuuggccgaaccucuuguuucuggguuucuacuucaguaguuaguuucuuuaccaaguaaucugugagauaggguuugauaaugucagcauucuuucaucuccgauuucaugccuguuuugucuuacuuccuuuauuuguguuuauucuuucugugaauacuccuccugggugguaaugccuucccuccugcagaccagcugacaguugguguggaggaauugauacacccaagcacauuuccaguguuguccauaggcuuaccuccaaaccaguguccuguuuucuuuccuugaagcaugaacacugauguccacuuaagaaggcugcccugucucauggccaucccagucacagggccuccaucacuucuacuuaguaauuagcagcauuuugaaauaugacacacccugggagaaaucauuccuggcaggagcucuuggugagccgugcucaucccauucaagguugaugaauagaacauuaagaauaauuagcacaagacugucuacuggaacacuaucucuuuuacauagagcauuauguggcacugugcaggaauuuucuucaguaacuauaggaaucccagguguucuccuuaaccuggccuuuuuggauaagauauuuuuucugcagcuuugccuucucaccucuucuggcuucaacaagugggcugggcugaagagcaaguccucugaaagguauuugcucaauaguuggugugcuuauuuucuuuagaacucagucccugaagcuuuggucauguguaaacacuugcuauguuaagaaggccuuaauacguuaacaaguaaccuaguaacaccaauucauuucucaaacucuuuuuuuuuuuuuuuuuuuguaacagugucucgcucugucacccaggcuggagugcagugaugcgaucuuggcucacugcaacgucugccuccuggguucaagcaguucucaugccccagucuucugaguagcuggacuacaggcauguaccaccaagcccagcuaauuguuguauuuuuaguagggauaggguuucaccauguuggcuaggggucucgaacucccaaucucaggugaucugucugcuuuggccucccaaagugcuagaauuacagguaugagccacuccaccuagcuaguucauuuuuguuauucauucagcagauauuuuuuggacagcuacucugugccaaggcauuggggauagagccuauuuuuauaguacuaauauuuuagaaaacacacauaguuguuggguaccuuuguagaggugcaguaaggaugaauaaaauaucaucucuguugcaaguugcuugcagucuaacuggagugagaugacaucuguuguauaagaaguugaauaagaacagauuugaauaacugguaagacaacagaaauguaucacuugaugguauuugauaaauauuaaugcgaaguguacugauugugguuaucuuucacagauaggagaggucucaccugcugggugaccuuauguauuuaauggucucagcuuccagucauaacccugacucuuaggaauaggaauauuuccccuccuaacuucuuucucugcuuauagacuugcccuguuucuucugucuaugccaucuugcagauuacuaucacaauugcuuucaaaaugcguagaccugaccacgucaccaacucugcugauacccauuugccugcagaaaaaaaaucugauuccuuaaaugauuauauaauaaaaagcaaaggaaaggcagcuguauauaaaauauuguaacuucaagugagcaucuugcuuccauuuccagucugacuucuggcauugcuguccacauaauaugucacaaagaacuucucaccauuccauggacaugccaagccauuucacaacuucuuuccuucauacuuuuuuuuuuuuuuuuuuuuuuuuuuggucaggaaucuuaccucuguucuguauuccugguuccccauguaaagucugguguucuuuguccuccgauaauauuuuugugacccuuucuguuguaguaguucccaggucugaccuuccuccccaccccuauagggcaaagagccucucuugucuuuucaucagcucacaguuccuaagacugugcuugacauugacaaugacgucgagauccucaauagaucuuuacagaaggggugggauuuguccucugcuuugucauauggaagauuuggauauggagaaggccugucauauagcucugagcuggggaaaugguuuccuugucaccugcuuuuuaaauuuccucauacuguuauauaauaauauagacuuggagcccuaauucagggagacuuuagguauaaguacugucugguugaaauacaaaccaagaccuuaaaaauagguuggauaaauauguuuucuuuuguuuugcuaugugugaauugaaauuguuggauuauugcuccaucugauuggcagcaugcuuguugccuagugugaagucuucaugagggaagcugagcagucacuccuuaguacuguaggucugauuuggggcuuuucugugucuuuuucauuauugaaacugugcaucauuaaaaaucacagaaggauuuacucaacuaauaggcaauaaauacuauuuuuuggcuugaauucucuauuauuauuuuaaaguucuaaguaacuuaagguugauggaccuugacugaacccugcuguucccaucucccucucagccccuggcuugggauucuuaauguuccuauuccccaguaauagugcaaaugaguuggaagucaguacgucagugccuugcuccacucugcugugugugcguuguaugauggaccuuuuugccuggcagguugcugcugagcccagcuccucagagccuguccuaguagaauuugaugcacagggugggcagugaaacagcagaguuuccuccaccaggcucgguuuccaccaucuccaaacuuuuaaccaccauuuauuuaaaaaagacaccaaaagaaaagcaaggaaaggagaaguaaagaauggaagaaaggaagggagaaagucacagaggugaccuggucuuugauuagaaguuuaggugaccauguuuuggugagauggugucacgugcagcuagagagcuggggaggcuuuuuuagcuuucugauugaaucucucaacauuugagugagaaaaucauaauuugauggucucugcauuuaugacaccuccauuucuucauuuauaaaauggacaucauguuugacaccucuaauuccuuguguuuguaauaguauagggagagaauguaagcaaacagucacauuaggaguaaauuugagcagggcaaaauggaaggaacuguuuuauuucuucaggguggaacuauagaaguuaguacuucaaaugcagaccugcagccuuguccaaaauuugucaggcuacauaaaaaugaagagaugagacauuucagugaccucagagucaggaagauaugcaguugaagauuguguaucaucacauucuuacacuugggaugaauucauuucuuucauuguuccucauuuucuuaauuuggaauauccaaaggauacuuuuuucuacccucuaaaaagaugaucuuacuaagguauccagaaagacucaauuugucuuccugguauuucuaaucagauucugacuuaacaacauuuacuuuuaaaaauguaguuuuccuaguauugacucugaggagggccaccauaaagaggcagguggccccaccuuguaggaugggcuggagguagaaaaauucaggagucuggaguccuggccugaagugcaucuagucuuuguucaccucacccgcuuucuauuuuggcccuuaguuaaccccucucuaaaaacagaaggaaccagcaggccaccucugaagaucauuucauaaacccguuugaagauuuguugcccgguuuugcauugauuggacuacuuuuaggguuccaaaaguuuaaucuuuuugucaucaaagauuguuuuauuuuaaauaucagugaauuugaugaauacugaugugauggcuaugugucacacacaaaccccugaguccuguggccacugggugauucuuugaacuuacugugaacacugauuguuaaaggccuguuugcugagaaugcuauaauguaaaucucuacuguuucugugcagugacuuuaauuaucuuaaucacccauuaugcccgccuucucccaaccccuacaagcuaggagauugaauucauucuuucuccaccucugcuuauguuaccagguuagggucaaagcagaucuuuuuaucugaaauguuuaagugguuaggcugggguuacaauucaguuaguuacuggggaaaggaauuguuuccucuuuuucuaagaugugugguucccaaugguuuucucucauuugagggcugguggugguuuccuucugucauuugucaguucacuacauuuugaaauaauggcuuuaggaauccagugccaucagaaugauugacuucuugacauuagccaggugcuuuuucacauuuuucccuaguuucuccuauugcuagugguggaguuugcuugcugucggcaguuuggaagcaaagcagcauguaguuugaacuccacagcaugggagaguuuuugaagaucaaagacaaagaugagucauguugcuguucuucgguauuucugcuuugguguaguuaaucacagcuuuccaaggggcaaaugguaauaagaucacuaagucuagauagauuuaugaugucucaacauucagagacugaaaguagaauugauagucuuuuuuacgucacagacacaaacuuccccuuccuuucuuucucucuaaccucauuuucuuuugucccucucuaucuuuccuuuuucccccuuuccuucugccuuccauuuuccuuccuccuccucaaaguuucuuagaccuccaacaugaaauugucaaaaugcuaagcuuguaguagcacucacuuuccaauguguaugcuccaucugccuuuaugucugacuuggcuguuguaguggaucccugggaccuuucugaccuuagcaaggaaaaagugauuugcuaaaugccauuuuuucuuguuucuguucuucuuccagcagcaugaagcuugguugaguaccagaguugacagaguauuagcuuuucucugagccaggucugcuuaaguuuuugcuugaugguuccaguuuauuguuggccuuggauccucccgaaugaacacucagaauguucucagcgagaugauauuguguaguacauuuagaacucucugccuucuuuaacugucauuuuccauuguuuuuggaaaagagaaaacauggacaaggaaaauguugugccagucauuccucuuaguccagguuucccuuccugaggaauucuaguugaugggccaguguauguguguccuugcugggugcucuaaugaugcaguagccugaugcugccccaggcacaaguagcaugcggggugcuuggccauuguuucaguuagcaaaaaaauaccuguuuggauaacacugaccugcuucagaguauguuguuuuccuuggaugacccagcuuucuguaauucaccuuuggauuggauuguuuuuuccuggacuccaugucaucaucucugcucuccaacuguugucuccagguugauggguaccaguacaggauugauuucucuguguccuuguuuuuuucuguuucuuucagggauugcuuuuuacauugggaugauuucuguggucaggcaaagguacuuuucuuacaggauuuuuuuaaauuuaguuuuuaaacugccaggaagauauaauuuuuaaaaaauuuuuguuuuauguaacauaacuuguucuuuacauuuuaaaaauagauguagaaaggauguguuaaaaaaaaaauagcugcguagaaagcacauauauggauaaagcagugauuuuaaaaaauuuuucuucuaaagauuuuaaaagucaaaucaagaaaguaaaugaauuugguuguuuuauugccgaaacagacauuuugacgucauuuggcaggaaagccauuauggaaacagguuauuuuuugacaagcuauuauauaaaaugggcagacauuugaauuauuuaacaucccuuuuaucuuuuagacauuuuuauuuauggggaaaucaauaucauuuuaagguuuuucucuuauguauucauuuuuuauuuuaauuauuauuuugaguagauaaugcauuuaauugguuuaaaauucaaaugcuaauaaaggguauaaguuagagaccuuucuuuugcccuaguccuucacagguucauuuuaccacccaagaagcaauuaguauuacgauuuccuuguaaguccuuucaggguuauuuuaggccuacccgggaagauacguuuguggguagguauucucccuuuuuacacauauacuagcaucauaaauaaguuuaaauuucauacauaccaccaaaaauagugucuuugcauuuguguuucaauucuaugugcuuacaaguaguaaaggauuaucauauuugaucuguacaacuuagagaaagcuugcaacuuucccguaaaauuuuagucuaguuuucucuauggccauaauuuuccuacuugaaaaugcaacugugaauucuacuaauacuggugauauuguucauucugucuuuguuuaugauacugcauuuuuuuugcuguuuuguuuuaaauaacauuuacugcucauuuuuucaaucauaaaagcacuuguuuauucuaaaaauguuuuuugaaaaaaagagaagauaaagggaaaaaaccccuaccauucaggguagcaucuguuaauacuugaguguguauuacucuaauccuuuuuuaaaugcacuuguguuugcauaauuuucaacuuagcuaguaauuauauguuacuuacuguuuuguaaccugcaauaugaugguuucuccaugucauuaaauagucuucuacaugagguacuuuaucauuuaauaucauugaauguuuaaucaauauccuguuguuggcuauuuguagugguuuaguguauggacuuugaaaccaaauagacaugaguuugaaucucugggguagcauuaccuaaaucaguccugucaugaccauuaaaugagguaauauacguuaagcauuuagugcagugcuugggcacauuguaagagcguaaucgauaacagcaaacuacugagucaggguuuaggaaaauuaagaacagagagcaguacacaauaugacaaauaaaaugaacuaguucuggguccugauaaggcugagugagagacagaaggggaugagcaaagugagcagugugguugggggagauacagagugaguucuuaagaggaagaaggcagccagccuuauuucccuuaaacccccacaccuccuaguugcuuucaaaaccaguccagcaagauuacagucuauugcgugucccucuuuaggaagucuuuuucccucccaggugcuugguuccccugacuaggauguuaugagucugggaggaagugggaauggccuugggaagggggagcugggagagaacucaacaucuuauuuccuucuuuucugaguuucuugacacauuuuucacaaccagguaagguucccaugggaauuggcgggacaucucagggggacuuaauuuacugugacccaaaagaaacuaaagaaagggcaaaguaugcacccuaccagcagguuuuuuaaaauccaaguuucucugaaagucucagacuuacuaaagcucaaaauuaaagauucucaauccccugaauuuaccugucuaaccauaaguuuguuugaucaucaguuaggaacaaauguuggaugccuugccucucucaacauuuucgagcucugcaaaugaacgcucaauuaauuaauccagcauuacaaacuguucuuuuuuuuuucuauucacuuugacauauuugcuuuuaaaagucagacuuaauugaggagguauuggcgaauucagauauugaucaaauuuagauaauauuauaaagugaguuuauuucuaaucccauagguagcauauuuuguuuaaagugaccuugauauuuaaagugaaagagagauuuguugugauuuauguuauagagugaugcauuuuauuuacucauaucauagucaacacuuaagcaaugaaggauuugcgcugguauuaaauauugaguaugacgacaacaaaaugaagcagaaaugcugcuuuauuaaaaaauguaggcaaacuuuuuaaaaaaguaaauaacuacuuuuguaaaugcagugcuauauuuuuauacuauccuuuucccauggugguaucuuuaaguuuccacugauuuuaaauaauaccccuuucaaaauuaagugcauauugacugcacuaggugauagaaaaaaaucugauuuuauauacauccacagcaauaguguuauuugucaucucagaaaacuuaucuaccaguucuuuuaauucuucaaggaaaggcaguuggugcuuuguucuugggaaaguauugagguuuuauuuuguuuuuauaagccauauuccgugauguagaugaaaucuguuuucucuccuuguucauuggagacauaacaaguguucaaggccaccucugugguuuuccuucuugcuaccugauucuugauaaguuguuuauucuaaggacugaagcaauuagguuugggauccauuucagcucuguauagccuagaaugaaaauucugaucuuuauccauuuucauugucccaauuacuuuaucuuuucuucucuuccgucacuucagcaagaguagcagucccagugcuaaaaaaaagauggaguauuccuuuaauguuugcacauauaugagacuccucaugcauucuuuuuuuuuucagcuugcuuuaaaaaauacuugaugagcaguggaaugucaucauuuuuaguaguucuaaccauuuugcuguuguuuaccauccuguuuucuuaguuccugaccuuggaaagcuuuacaaaccucuaaucuucaucuucuuugugacuaaccccauugucuuccaccucagaugguguauuugccaaauuuuuggucuguuuucuggaauguauguacaacuauaauaguuuuguuacuugaaagggaguagaaacauguggacaccgaauaaaaauugguggguugauuacaagccagcuggagaauuauauguagggaaucuaaucucccuuauugacaguaauauaugugucacugcuuuuuagaaaugacaguuacuaauguuaccuuaaaacauauauuuuuuuuaaauaagagacagagccuugcucugucaccaaggcuggagugcaauggcgcgaugugggcucacugcaaucuccgccucccggguucaagugauucuccugccuuagucuccugaguagcugggacuacaggcgcaugccaccacaccuggcuaauuuuuguauuuuuaguagagaugggguuucaccauguuggccaggauggucucaaucuccugaccacaugauccaccugccuuggccucccaaagugcuggggugacaggcgugagccacugcuccuggccaccuuuuuuuuuuuuugaaacugaauuuuguucuuguugcccaggcugaaguguagugguaugaucuugguucacuacaaccucugccucccagguucaagcaauucuugugccucaaccucccgaguagcugggauuaauagugugugccaccaugcccagcuaauuuuuguacuuuaguagagacgggauuucgccauguuggccaggcuggucuugaacucccgacuucaggugauccgcccaccccggccucccaaagugugggauuacaggcgugagccaccgcaccuggccagaacauaccugaaccaugaauaucuuccaugucucuucuguauuuuuuucugauuauaaaagcaauauauguuuauuaugcuaaguuuggcaaguauaaaggaaaaauaaaaguaauucaaauaacauuuugguguauuuucuuucacuuauacauuuauauucuaaucugucuguguguccuuuuuuaaaauggacaauggaggccgggcgugguggcucaugccuguaaucccagcacuuugggaagccgaggcgguggaucaccugaggucaggaguuugagaccaccuggccaacauggcgaaacccccaucucuacuaaaaauacaaaaauuagcugggcaugguggcaggugcccauaaucccagcuacuugggaggcugaggcaggugaauuacuugaaccuaggagguggagguugcagugagccaagauugcgccaccacacuccagccugggccacaagagcgaaacucagucucaaaaauaaaauaaaguugacaguggauucugaacaucuccucacauccuuaaauaaacuuuuauguauugauuuuaauggcuuuauguuauuuuauuccaugaguauauaauuuauuuaacugguguauguucaucuuauuuuuuuuugaacuauggugaugugguuuuauuuuguuuuaauaaacaagccauacuguauauugguaucaacuagauucacuaagcccuacaaaauuauagucaucuagauuugagaggauguaaagauuagaagaguuaaagacaaaaaucuucuaugucuauuuauugacaguguugagcacuuucuuacauaggauuuggucauuuaagaagcuugauagauuuuucccauccuuuuauguccuuguauuuuaucucauugaaaaagucaacguuuuuuguuuccugggguuuuacuucucucauauuaaaccuuaauuucauucccuuuuuuaucuuaaauaccauuuagccuagguacuaaugauuaauuuaugauucccuuauuuuaaaacaacauagcaacaaauacucccuuuuuuaaauuuuuaaaauuuuugacgugcuuuuauauagaucagcaagagguauagcuguagaguggauaguuuuggagagagccagagucauuaacagaauuuggaggucucuguaugucagucuucuuguggaccacccucuuagccaucucccugugucauucauuucuuuuaaaggguagcuucuaaaaugacuccaacuuggaaggcccuugggcuggccuuuccagacugaaguucaauccaggcauaaaauagacuuucuuuauugaaaugauguugauacuauaccuuuuacgugguuuccuauccucgcacuucagauauuauucugauauuuaggaucuuaguuauaacucuuuuaguaacuagauguuuaaacuuggggaagccacauaacuucugaaucuguuuucucuuacaguguaugagugcucuaggugauaacuguggcccuuuucauucugauuuaaaguaaagcuuucauuuuaauuuaucccuuaaaagcucacuuaaccaauuaagaguuggaauuuaaaaugaaaucuuccaauaauuaaaucguuaaaaauuuaaauauugaucauuuuuuaaaauuaauuuuuccuaugcagauacauuuuguguuuacuguuuuauaaccuagccuaauugcaaauuaugacuuugcaauuuauauuucacaucucuuucaaaauaccccuuuucauaauuugggggcaaauuguuuagcuucugugaaugauuaauaacucuuguauugucauuguagauguuauugauguaucuuuccaccgcuccccagcccuauuaacuauggauuguuuuucuagacuuuuuagcccagacuuaucauuggauauuacuuaauuuauucuauucuuauguuuaucacgaugcauauucacaggaauuauagcagaugucacuaaucaaauacuuauuagaucugauauggcauuucauuuuauaaucuucugucaguuuuaaccauuuauuaugcggguuuuauuaauaaguaucauuuuauucucaacaugccuaugcaucuugguuugucuuuuacagagaaaaauaaaggaauaguauauuaugcaccuauuuuuaauauuucagauguaauuauacuagauauaauuaaccugaaauguaguuguuccuuaauacauuuauuugcauuacuuuucugggugguuucuuuaauaacauauauaguuagcauuuuucuuacuauuuuucuaauguagcaaguuuuuuuguuuguuugaggcagucucgcuguugcccaggcuggagugcaacggcauguucucggcucacugaagacucugccucacagguucaagugauucuucugccucagccucccaaguagcugggauuacaggcgcccaccaccaugcccggcuaauuuugguauuuuuaguagagacgggguuucaccacguuggccaggcuggucucaagcuccugaccucaggugaucugccugccucagccucccaaagugcugggauuacgggugugagccacugcgcccagccgcaaauuucauuucuauuuccuauaccuucugguuguucugauauauauauaucagaauauauauacauauucuuucagugguggggcuuuggaucauuccuuuacuuuuuuuugagauuguuugaccacccucauuuagagugauuucugugaagaucuuggacagcgauuacaguaaauuccugucuguaguuggaaaccucauuugaggauuuucuaguguuugaaaguugguacuuuuguauaaucuugguuauuguaucaugaugcuucuuuuacugccugggcauuuucucuggaacugcuagaaauuuuggcuuuguucuucuuucuuguagaguugucuaaaauuuucuggaaaaucuauagugucaaaauauuauuaaauaucaucacugcuuucuugggcuggucuuuugauaaucaggauaauaaauuuauagcucaaaauguuaccuccagagcaaacacaauucuucuauucuugagguauugacuuaucuccugggcuaaaagacccagagacuuuucuuuaauagcccaagaauaaaaauuauuuccauauuaaaucauggagcagagcucccugggucauuuuuguuuauugcuuuacuccugucuuguagaagaauuuaucauuaguuuuccaccugaccucuuagagguaggggcggaagaggagucagcuuagcugaucugaagagcaucacacaggaaagaccacaggugaugcaucagggagagauuuguugcuguguauacuagcgauacauucaaacaggguauguauuauuaacuaagauaggagaguccuuaaaacccgaauuacagucugguucguuugaaugaguaugugccaggaaucuuggaagcaaaugcagcagaugagggaaaagccuguagggauccugcccccugcccccucccccacauaguuuagaucugugucuucuuugcauccugaacaguggcuguacucuucaucuggagcaaaggaccugcugugaggcaguuucauuuccucugaggugauugguagguugguuuauuguuuggaccaucccuugagacacugaaagauuucuuccucauuaugagagacuuuuaauuuaaaaaaaauggauuugguugagguucucugaaguggacagauuaggagauuaaaagacuccuuuuauaugauuugacucugauagcuuaguuuguguuugucaaugaaaacucuucuccuuaggccacugacugcucucaacugauucucaacacacuuucucuuauuauuaaaaauauuauuacaagauuuuuuauuaaagugguucucagcauacuuucucuuauuauagcugcagucucaaaaguacaccguaguggauaaacaaaguaugguauauccuuacaaucaguacauucuguccuaaaaaggaaugaagucugcuguauacuucagcauagaugaaccuggaaaacuugucccaaguaaaagaauuuagacacaaaagacugcauauuauaugauuccauuuauacagaauuuuuauagggaucuauaggugguugaugguuuccaggggcuagagguaggggaaguugggaaaaagaagugacugcuucauggauauaguuucuuuucagugaauuggauaagcaugauguugcacagcauugugaauauacuaaaauccacugaacugguacaccuuaaaaugauugagaugguggauuucauguuacauaaauuugaucuuaauuaaauaguaaaucuguauguuaaugcugugguugcugaaucaagaaggccuugguggccgggugcgguggcucaugccuguaaucccaacacucugggaggccgagguggguggaucacaugaggucaggaguuagagaccagccugaccaacaaggugaaaccccaucucuacuaaaaauacaaaaauuagcugggcgugguggugggcgccuguagucccagcuacucagggggcugagacaggagaauugccugaacccaggaggcagagguugcagugagccgagauugugccaagaaggccuugguguuucuuggugcuaaugcugguuggcauuuuagccaauugguuaaguguuggugagaguggggagaggaaguaccuuauaauugcaccuuugaagauaagcccuucuacagugccaaguauguuccucuggauucuguuccauguuucccucacuuuucuuccccugguaggauuacaucauauuuaucauuguuuauuugcuuuucuauuuggacaucuuuccauagcagaauauauccuucucuuaaugauccuccucauuaagagaaguauauauguauccaaugaccuuuuaauucauggaaagugcuguuggauaaucaucuucacauucucauuaucaaugggaauaugagggguuugguuaaccugcuugacugauuccagucucuugugcauucaguaucuuuuaccuaaacucuacugaaacuguucuucccucccucuguucagaaacuagcuccuaguuugcugucuaggaguagauaacaagcccuauauuuauuuugagacucucugggauauauaguuauaaauguaugaguuagaguucuaguaaaaggggcaaauugggaggcaguuacaugaacccuauuuuuccauauuauauucucuucaucagaugaucugcugcucagagaaagggcuccaugaacaugaauucuugacuucugaugccacacccugugcuuaccucaguauuaaaguaaaaaacaaaacuccaugguuuuuauugacuguacuguguugguuaagggagacagaaugaauccaguuuguucuauugggaagucuggguuccuuuucuacucugcugaugagaaacaggaucagagggcacaagggggauggggcacagcccuucacauauuaccagcugucuuagaacuggcuggcuaacccacugcaaaguguugggucuuagugaauggucaguaggcaaagcauuauuuuauauccuucuuccacucuuuuccagcucucucugaagggcugcagcuagguauaacaaacaucaaccaguaguauuagauugucagugaucagcaugccaaaaugcaguuccuuguuacgugacaaguagagaaaacauauggcaggcagguggugguggcaggaucauuaucagcucagagugagauuggcaguucauuugcagagagugaugcccaccugccauggcaacaguacaccacugggcacccagaagcccucaugaucauguccuucuaacaguguuuagccugcccugcauaauccuuacugguuggcagacauuacugagcagugaccguggccucagugugggaacuauugugaugaaacagaugcucaaaggugaagacccugcuugugaggaggcuacuuuuuuguguuuuuugcuguuuuuuguuuuuaaaggcagauguuuucuuuauauauuuacuuagcucaccguauuguuucucuuaagacuuaaucaaauuuuuccccuuuccaaauguaauuuaaacauuuuaaucccuguggaaauguacgaugugaaaaauuggaaguaccuuauaauugcaccuuugaagauaagcccuucuacagugccaaguauguuccucuggauucuguuccauguuucccucacuuuuguuccccuaaaaggauuacaucauauuuaccauuguucauuugccuuucucuuuggacaucuuuccauagcagaauguguagcucccacguguucucagcagcuacaucauauuuauucaguauugguaauauguaggugaaaaagauaggcaagguuucugccaacuuauaacucaugagauuuaagauuacugaaaucucaacuuguaauuaugcauuuguguuaaacuacuaugaaugcaaaggacaccacauuuguacauacaucuuuguuucuguagauugaauuccuagaaguggaacugcuggguuaaaggacauccacauauuaaauguuaguagaauugccagccugaccuccaaugauguuauaauaauuuagacuccugccaacagugaaaaauaccacuuagagaagcauguggaaauuggaaguucauuggacaaaagcacagacaacagugauuaaauucagcaacuagagaaguagauaaaggugggaaaaugauggugaaugcacugaaaauucuguagaucugcacgugauagaucucuaaggcagacaauucuucauagaaaaauucugucacagcgcaggacaucaaaauuugucaauuuuauaggaagucagugagccauagacuauucuuaucucccuucuaugacugccucugagaaaugguaagaaaggcauauuuggguugacuugugguagacaugcagcuugugccuuagagcaaggguccccaagccccggacugcggaccgguacuggucccuggccuguuaggaagcaggcugcacagcaggacaugagcagcaggccagccagcgucacugccugagcucugccuccugucagaucagcagcagcauuagauucucauagaagugcaaagccuagugugaacuacacgugcgagggaucuaggucucaugcucuuuaugagaaucuaaugcuugaugaucugaaggugggacaguuucaucccgaaaucauccuccccaccauccauguaaaaauugucuucuacaaaaucggucccuggugccaaaaggguuggggaccacuuucuuagaguguugacucuuuucagaauguaagaaaauagccaaguguauuuuauauccugagaaagguggccuaaaagguagacuauuuuaucuuauaugacaaccggagacuucuguguccuuauuuagggguuauugaacaugacuucuaauuaugguuuugggaaaccauccguauauuuucuugggaaugugauugaacugucuuuuuuuuuuuuuuuuuuuuaaugagauggagucuugcucugucacccaggcuggagugcaguggcucgauguuggcucgccgcaaccucugccuccaagguucaagugauucucaugucucagccucccgagugcugggacuaaaggcacauaccaccaugccuggcuaauuuuuguauuuuugguagagacuggguuucgccauguuggucaggcuggucucgaacucuugaccucaaaugauccacccaccuuggccugccaaaauacugggauuacaggcaugagccaccacacccagccugaacugucuuauugaaguaaccaguagauucaggaguuagcuggguuuggguucagaguugccucgcuccugccgcuguuauuuacuaaugugugggcagaacagccugggggguugagagagagagagagagagaaaggcagauacauaaaauaaaauuuaccuucuuauucaauuuuaaguguacaauucagugacauuaagcacauucauucacauuguugugcaaccaucacuguccauccccagaacuuuuucuuuccucuugcacaaucgaaacucuauacccauuaaauaaaucucuccauccccugucaaccauguuccuauuuuuggucuaagaauuugacuacucuagguaccuuauuuaaauggaaucacacaguauucuuuuuuguaaguaaguuuuuuuuuugugacugacuuccuucacuuauaauguccucaagauaaugagaauuuccuuccuuuuuaaagcugaauaacauucuauuguauguaucuaccauauuuuguuuaucuacuuauccaacaauggguaugucaguugcuuccaccuuuggcuguuguaaauaaauucuucugugagccuggguauugagauaucucuuuaagauccugcuuccaauuccacugauguauaccuagaaguggaauugguggaucauauaguaauucuauuuuuaauuuuuuuggaaagcuaagcaauauuuuugcaucauauuucugauaauuuaggaguggaaacuggaacacuguggaacugagaaaugguuugaucuagaauuauccuccacugguaacugcccaguuugugaauguguguaauuguaggccaaggaguugguugugugccuguucacuguuuuccaaaacaaugacuguaaaucaagagaccugaauuugaagggagacgcagauacaaugcaggauggucuuugaucggugucugugacuuuaguugucauuguucuaugcacgccgugccuuugaucauggaaccuugcuucauuuaguaggccucuacuuugugaaauagagggauggugugguauguuuacaggaagaaaggcugauauugauaccugauuuucuuggaauguuuacuuagccacaaaacugacaauuuauauacacaagugcuauauccuuguguuauuuagucauuggcguguauuccuaaagaauuauuguguuuuuucuucaugauuuuccuuugacaucauuauauacauccuugaggucagcucaccauucuaacuuuggccuuuauuuaauuuaccuaaacauauauuuuccuugucugagugacuucuugaugccagcucaugggcaugcuggagaaaugggagugcucugaauuguagucaaugcaggauggcuuuuguguucugguuuugcucacccaagcaauaccuacuccccagggaaauaggaguuuauuggaacucuuggcagggugaauacuuuaguccccacuuuuauugauuagauuucccugguauuuuggugggugcaggcauucaaaaucuuuauagacagagcaaauguaauguaaccuuuuguuuucauccauuucuuaauaauauccccuuccccccacuaauuauucuuagaagccauuaagcaagucuccuuucuucauauucuuguuccucucaucauaguuucauuacugcuguuguuuuaaagauugggugacauuggguguauuugacauaaaggcagaaguaucuccauguaaaauuugugcugcuuguguggcuggaacuccuccagggagaguucuggaaaaagggauuuaauuucuccugacugcuggugaccuuggaaauuuuggccauagaugacugugauugacgcuuguauaauggagaaaaaagacccacccucaacuuucauccuuuagaggaaggcaaugggaguuggcagcucuggugaggaauaagaagggacauacaggcuacacaagggacaguuuccaguagugccucugaaaccuuuugacauuccuccuuagggacaagcagguuguauuaaaaguagguauuggugugaguuaugccugugauaaaauaaugaguaagauaauggagcauuagcacaaacacacauuauacuuuuuaaguauguuuguaggauuauaaauccuggagaaucgagauuuaaugaaacugcuggaagcugggaucacuauuuucaaauagugaucucugugucuuucucuaagguaccccucagauuuauuuaaaauauugucauuugucaaaauuugauguuuauaugugccuauuauuuacuuccguauagaaacugcuuggucaguauauuuucagaucauuuuauuauguuuguuuucagguuguuaucacuacuucuagaaaucuuugccauuuucuaauggccccuuaccuaaaauguuuuaauguuuuguggaucucgaguuuguguaugcuccuaauuaaauauuuaccgaagugaagguuuaucagggagcagugauguccacuuaaaugaaugcaugaugucagauagagacucuuaacaucuccauggacgccauauucagcuguauuuuaccuuuccccucaaaacagauaaaagcgucugcccaucccggggacagaggagugguugggauaggagacucauuuugucaaaaauguaucaaauaagaacacuuucuaaauguguuuauaaagguuuauaggcauuauagauuaaaauuccauugaugaaaaugaaauguagucaaaauaguuuugggguuuggggguaggauggugauuuuagaugggagagagcagcauaaauacaugugaagaaacaaccagccuaagcaccuaauuacaaugauuuggaaggggguguuagagaauacaucugggcuggauuggagaguuaggaagggagcauugguuuaugucuucuaaucuuuguagcauagaugagacaacaaaauguauaauuuuuucugaacguauuuauaaagguuguugcagagcucaaagauguccugauggaagagguaaauuucagcauuuuauaauuauaaaaauauauaaaaauaaguagguuacaucuaccaguuauuuguuuucuuuuuaauaauaucagcaauuaacagaagccuuaauuauuaacuacaaaaacaguuauuucuuaaccugaguuucuggccacagccaccaucuacccaccauccauccauuagaauaaacuucaaacacuaagguaaagaauucuagaaucauguugacaaaucaggaauuaauaaaauucagcuauugaauugguagaaggaacugaaaaauaccuucaccaaacuacugaauagaauauauuuuacauauauaguacagacuaagggauuuuucccucaguguauaaauuuauccucacaccugaaauucuuuuucugaacuaaaaauguauguggcuuaucuuuguaaucuagucagauaauagauuugaaaaagaaaaugaaggcuaaauauuuuauuuuugauaccaggguuuuuauaucauauuuuuuucauauuugguuuaagaauguuuacaaagauucauaaaacauacguucacagggaaaaauacagagagaaaucagaaccacagauaggauagaggaaugaggcuaagacuugugccuuaacugauacucuaggaaugcccacugaguuuuaagcauugcaguguggcugguccaaauugagauguuuguaaaguacacaccagauaguaaagauuuaauacaaaaaaagaucucaacacuuuuauaauauuuguuauauauugacacgauguuuuagaaauuuugcauuaaauaaaaaaucauauuaaaauuaauuucacuuguuucuuuuuaauguuucaacauggcuacuaggaaaaugugaacauacacaugugggucucauuugucacuuauuauauuuccauuacacaguacuugccuagaaggagguaaguuuaacauccucucuugagagaugagcaguuccacaacggcuaaugucugaauuagcuuggagguaagcucagagcaugcccagaggcaggaccaacaggcuccuuagcaauuuguuuugaagcucuuccuguaccucgaugaaugggugauugauguguguuuuaaaauguuuaaaaauauguaucacuuuuauaaguuuagaaugauaauauacuuuuaacagagaaaaauuauuaaaacuacauuauguaaauauuaaggagcacuuuguauggaagauccuguuguuauaaauaaauuuucagugcugcaagagaaguagcacucgaacauaaauuuaauuuucucagcaaggcaauuuuuacuucuauagaagggugcgacuccuggauggaguaauggugagagcacacuucaacaagggaggggaacaggcagguagccccuacugcuauguuguuccccuguuggcuaggguuggaccgcacagucuaagcuaauuccaauuggcuauuuuaaagagagcagggguacgagccugaguggcggaaugaguaguuuggugggaagggcuuacagaacaggugacucaagaugauucaguucagagcaggugaccaggggugacucaaaggacggagcaggugaccaggggaacagaugucaacuacugauuagaacugguggaaaagguuguuuacugaaacuaggggcaaggagaaugaggaaguuaaacuuuaaaauggagaacaaggaacaggggagcugaacauacugaugcacugguucuuuggagaggaucucagaacucaucguacuuaacaauuuacaggcuaaaaaccuuugaagagaaauuuauuauauccuacacuguuaagcccaaagcaaauggaaacuugguuacuauuugauguucacugucuuccuaauuuaguaaggcaagaaguauccugccccaaauauccauaguuaaccuauuauuugagaugguucacaacacugugcuucaauugucuuugguaaauaaaauauccaauaacugguagcugcaaaauuaauguuaaauaucuaaauaaauacuaguguaucauucuuuaaaauaauccuuacuuagcucuaaguugggaugaauauguaugaaguacuacauauuuuuguuugcuguggcucuuuaaagagaaaaguguauuuaauuuagucuuucugccugaugauuuccaaagucuaaugauuuaaaucaacauguaucugauuuaugcauguauguauuuguguauguguuuaucucauggauacuuauuuagcauuuaacucugugccagacacugcccuaagaaaauuaguacauguuuaucuaaaaauaacuggcacuuagauagaacguacaaugauucaagcacuguucuaaaugauacauauguaucuuccuacagcagugagauacgcacaguaaauguguuaaacauaagcagagaaguuaggucgcuuaucuaaguucacacagcuccuuucuagaauugcugggaaccagucacugcagccuggcuguucugaaguguccguguucuuaucgagccuaugugaaacauuccauuuuacuuacuuuuguuucuaggcagcauccgugggacucaggccaaauggugucgucuuuucaguauuaggggugcguagaggcuuuccauaaagucuggaaauucugucaugagagggguaauaaagggguuauuuugagagacaagguguuuauuuagcucuuugugaauuuaugaguggcuauguggaauagugggugggauuauguggcgauuaugccccaaagccuuacguaacagcucuaguuauauuaaaacuaagcucaggcuacaaccuggaaauguggcucugcaguuguuuuccuuccuaccuccucuaaccuuuuaugcuuagguaguucacuuuuuggcguuuuguuaucaucagcaucagucugugaaguucuuuggugguuugauacuguucuagucauacauuguaugaagaauauccagagagccugagaauucuguuguguggcccauagcuguucuauacuaaacuauuccagacuuuacaagcaauuaauauauaaauuuaguuugaaguuaccaucuuaguuccucugaagggucccugaaauugcuuucaaggaaaauucuauaaucuaauagacgaagguugccugcuacccucuuaccuuugagaaccucuuugaggaauaaauaauaugagaaaguauguauguuucauauuuggcuugcuucaucuuucaugguuguuugcgcuagagcuuuaucacaguuuuaaaauauugcuccucccccaguuccuccucccuauccuccacgguuuaaauaaauauauuuuuacuauauaaaacagcagaaugaucaacagcuugacaaaaugguccucaggaugcccugccuucccacuucaaggguauccuucauaauguuaugucugaaaagauuauugauuauauauuuacucaugcaacaaacauuuacagcguagucuccugccuuacaggcccaugccagcucuuugagugaauaagacauggucuccccacucuuggagcuuacaguugguguguuccaauaccauguaguaaauguaagguaggaaauacaaagauuuaagaaaacaguauauaguaccccaugucugacuaaauuaucuuuuagaauucuagagugaaaugaugcucugauguucuaaucuagugcucucguuuuuaaggucaagggaaacugagacccaaagauguuacgugccucauuuguaagggagcuucaaguagcaccaagcaagagcccagggcucuuuguggucacucauugcuauaaacagggaucagggucugagucaguuauauagcccuuggucauguauucguaaaauacuugcauacaaaacauuucaggaauaucuuaaaaaggagaacccaucuauauuaaucaguuucuucucucaugccguuuuauacauacuuacccacaaacacaaaauucagguuaucauuuauuuagacgaagauguugcuaagauuuacacugguuuuaauugaagcuguuaaaaccaugguucuuuuucaagugauugacaggucaguguugaauaucuugagaugaaaaauuccaggguagaggaagagaucucagaauccacaggggagggacacaaaugcuaauuacacauugacuuuaauuccugauuugucauagcugccugcagguguauaucuuggcugugggcuauucuccgggccucauuuguauuucagauuuucuuuaauaauguugcauccacaaauaacuguuuaaucucugacuuauuuacaguucuuauucucuugauaugggaaacaauuaauuggcaggugaauguaguuguuucuuuugguuauugaagauuaaaauuuuuuugucuucccacugauuucccuggaagacaguuuuggaacagcaccucacuuuggccuucuggccugagagauacacagguguucacuuuuguuuguuauuccuccuauuauuacucccacacauguggcauagugaauuagcccucuugaugaauuagcucucucucuggguugagagcuaauguuccucugugcuaaacagcugcugucccaccccugucugccuacugagaaggagauuuggcauugggaggcacaagguaaccuugagauuaacuuaguuuuuuuuuuuaagcagugcugauuuuuucccuagguaguagaauugagggcuugagcuuguuagauggauugggugaaaacacgaaagauacauggaccucguuccucauuuccacauauuuauuaacuucccagcgaaugcccccaaauuggaccauacccuguggccuuguccuauuuaaaaugggcccugagauacuuuacaugguauagccaccuucacugucuaccuucuguacacucgugauuuuuugccaugacuccagcuaucuuguuguuuuccucaccugcuucuauaagcuuguugugaggccuugucugaggagaguuccaggguguauuagcaucaagaccacuucuucccuucccugguucugaguuacucaggccugucugugugcagcccucucauuccuugcccuuuuuuuggccuauauuaacucuggccagcagcaugcagggaaaguauuaaaaaccuuuuuguuggagggcacuaguuguucaaucccccugucugaacacauuucucacauuuuuacucauuuccugaguuuuauaguaguuguuaagaccuugcaauaauuuaaagcuagguaucuaauuuuaggagucaucuuuauauuuucuuacuuucuguguuguugugcuaugaccauacuucucauaagaaugauuuaccuuaaccucagcccuuaauuggcuugggcucugauauggcuccauucugcugcuucuaaagcaugauucaauggaguguucaagugggugaucugacaguuggaauuuugaggcaucuauccuuuuccagauuuccauguucauuuucaagaugaguuuuugaagagaagacaguuugaaaggauuuuaacggugcucacuagcaguguggcugaacuccaugcuucugcaauaugcugucuuuaagcugaucagugagagcugaagauguauuuagaaaagggauuccagacuguggagaaggcuuccgucuccuugauccccaugcaccucuucaguguggguuuguaaaccuugguuuugacccaaaccaagccuacaacuucauucugugaagacuugcccuauauguuugcuacaggauacuauguuuaucuucaaaguuuucauaauaaaaaagcauuguuuaguguguucauauccauuuauuuaguguauucuaggguuaaaccauuuuugcauuuugugcgucuaacuuccugucugcaaaauuaauucaaaaucuaaggauucaucuaguccauucuaucuccccuaccugcacacugcuuaacucucaaguauguugguguugggcuuaauuagcuguaucuuuuugauuuacauacugugaaaccaauuccaagcaucuuuguaauuguuaucuuguuuguucuucuauguauuuauuuauuuauauuuuuuauuuuucagagagaugggggucuugcuuuguuucccagacuggucuugaacuccuggccucaagcaauucuucuaccugggccuuccaaagugcugcaguuauaggagcaagcuauugugcccaccuuguuuguuguucuuaauaacucuuaaucugguccuuaggaagcugugacagacagauuauauggaguuuuucuauggaggcaguucauauuuuuaaauacagguuuucaaaguagucugacccagaagagguuaaagcacugcuuuaucauaaugucuaggaguccaacaggaauguugcaaaccucuucucuguaaaguaaaauugcuguggggaccuauguguuuaguuguuugauuuacaucuuugguuaucagcuuuuuucuuucuuuuuaaaauggacuuuuuuuuuuagagcaguuuuggauuaacaggagaauugagcagaaguuacagagauuucccauauaccuucugcccccuacacacaaucuuccacaccagagugguauauuuauuacaauuguugagccuaccuuaacacaucauuaucacacaaaguccauaggguuugugcuugguguuauaucaucugugggcuuugauauauguauaguggcauguauucaccacuauagugucguacagaauaguuucauuacgcuaaaaauucccuauucucugccuauaacuccuggcaaaauuccuucucuccuucuaacuccuggcaaccacugauauuuuuauugucuuuguaguuuaaccuuuucuagaaugucguauaguuggaaucauacaguacaccuuuuaaagugucugcuuucacuuaguaauauaugucuaagcuuccuccaugucuuuucauggcuugauagcucauuucuuuuuaucacugaauaauauucugucaucuggauauaccacaauuuauccauucaccuacugaaggauauauggauuccuuccacauuuugacaguuaugaacaaagccacuguuaauauccaugggcagguuuuguguauguuuucaacuccucaaguaaauuucaaggagcuguauuccuggaucaaaugguaagaguacauguucaguucuauaagaaaugacuaaacuaucuuccaaaguggcuguaucauuuugcauuccuaccaucaaugaauuagaguuccuauugcuccacauccuugccugccuuugguguugucaguguucugaauuuugacuaugcuacaacgagcagugguaucucauuguuguuuaaguuggcaauuuucuaaucacauguaauguagaacaucuuuuccuguucuuauuugccacuuguauguauucuuuaguaagcuguuuggaucuuuugcauuuuaaaaucagguuguuuuauuauuguugaguuuuaagaguuuuuuguauauuuuagauaaauguucuuuauuaguuaugucuuuugccaacauuuucucccagucuguugcucagcuauuucuuuuaauugguuuuaaaaaucuuagauucagaaaaccaaacuggagugagcugaucuuucacaguugagcaggcacauguggcugcuagugagcuauguugcagacucucaacccuaauucccuugauucuuuguuuccaggucaaugugacgguggacuacauuagaccagccagcccagccacagagacagugccugccuuuucagagcguaccugugccacugucaccauuggaggaaugugaguguucuggcuggcauggacucagcugucaucucaaguagcuaagaguucuuugcucauuugaaucuuuccuuccuuucacucugcuuugcuuucuccugcucuuaacucagugguuuauaauuuugugccuguguagcacuuuauauuuguaaguacuuuauaaucacucauuagcuaaucguauacuuucauuauuguaguuauuuaagauuuauugggcucugugugccuggcacuaugaaguacacaucauuacuauuaauaaugccauuuauugaguaucaagcaggcccuagauacugucuaaaauggucucugcauauugguuuaggaagucuagguauagaauagcagguaacaaagagggaagaagaggagagguuaauuggacauuuucuuguauguaaucaguagacgaugaggucauccuauucugcuguacuggcuguaaccugguuagauuccaaggucuguuggcagccaggcugaggaagagucuuucaggggagauaucugauaggggaaggaggaagccugcugggcccugcuuccccaauaaauauuacaacagucagccaguccccaauagcaauucuuacuuugcauaaaauauaccaguaugguaauugucuccuuuuccauuuaacaaucuuauaugcuaguuguuaccaaacuguuauuuuucauuucuuuuaagugggcauauugauggggaagaaaauaauagguuugucaucaaaacaaggauuguguuacugaaaguacagugaagccacuuaggagaaguaccuccaagcuauugcaggccucugaaaggaauaagcauuuuguagcugcuuagcuucaugaaagucuccuaacaggagccucuuucaccucauucgugcuuucacauuuggaaaugacuauuuuuagccacugcuaccgauccuauauuuauuaauguuguuaauguucacacaacaauuggagguuucgucuuugccaggaggcgcucaguauaggcauuugauguuuaccuucacgccaucacagguuuuguuagaagcagguucuugacaaaucaaguaauauuuuugaacugggaaaaacuaggacauauuuuggucauuauucuaucuguauaaauuacaauaguuauuuguuaccaauuuguuaccacuucuuaggagucaguuguaugcuucccuguuguagagaccuggaaucuuaguauucuaucuaaauauuuuuacugccacagaaagccaucuccauagauacugcugcuuuuaaguacuggugaaaacaacuucacuguuguacaaaaccacgugucuuuauuuuuggcagguggccuccaccaguauuuaacauucuauuagaauggauuaucuccuuuaguuaccacugaagaauauuuaaaaaauaaguuuacacugcuuaaaaugagauauucagggaguauuuuauagcaaucuuuuuauuuuuaagauaauuugagacagauaauuuaaaauacuuuacagggcagaguguuguggccaugcuuugugccuuaaaaccuugagaucuccacuguguuuauuuuggcuuugacagagauuacucuuucagccuuccucucugcaaaugugggguagcugucuguucuagucuggguuucuauuacauucuugaguccuuguaagaaggugucaauucuguuggcuguuuaacaacacagguugguuggucuuaauugacaaccuacaauaucuauacuccagguuugugccagagauaaugaacuugaauuuucugcuucccaguucuuguaauuggauuguaugaaauauucuuuuuuuugugauuuaccaaaguaaaauuuuuuuuuuagaaguuuagaagcauguacaaguuuagaagaauuuuacaaguacucuucuagauacuuaaauugucuccuuggauuagaccagccuggcagguaccuggaaagcauuaugaguuucuucauaggguuuuucauccugaacuauaguuugugguuaaauggguaggcugcaaacaggagaaauguaaggaauuuacugauacugaaaccauccuucauuagacuguugugucccuaaagauagggaauuuugugucuuauucccuguuguagcccuaguaucuagcauaugguaggaaaucaaugaauuuguugagugauucauuaacuuuauugcaaacucuuccuuuaugaagcauaacuuggauguuaguagcaucuaaggcaugaccacagguuuguuuuuaucuaaucaguacuguaaaacuuauaacugauaauuuuauucuguuuuuuauuuuucuuuaucaggcggcccccagaaucacagcagauucagagagacucccagauaauuuuauucuuuuauuugaugauuggaagcucacugccaaagagaggccaucucuagcaaauagaccuagcugcacacuuucuguguucuaaucuuagucacugcuucuguuuguuuuccuuuuaucuugcuuuuguuuuuauuuauccuuuuuuuuucugaauuuucuauauuuuaaaaaaucuuggccaggcgcgauggcucaugccuguaaucccagcacuuugggaggccgaggcgguuggaucaccugagaucaggaguuugagaguagccuaaccaacauggugaaaccucgucucuacuaaaaauacaaaaaaaaauuagcugagucugguggcaggugccuguaaucuuagcuacuugggaggcugaggcaugagaauugcuugaaccccggaggcgggaguugcagugagccgagaucaugccacugcacuccagccugggcaauagagugagacuuugucucaaaaaacaaacaaacaaacaaaaaacuccauuaauauuauagaaaauuugagguauugauaauuaagaaucuccaaauacuuagcuuauuuucagaauuaaguuauacuacuaagagccuuuuaucuuacuuaauggugauuuauaaacacuagccagagaagaggcuuuuuaaaaaacacuacaucuuaaauauuuuauuuucauuuuaaacauaaaaauguguacauauuuuuaaaucuuugcugucugggcagcauggaccaccuauuugauaucuuguugaauuacauaacuuccuguuugaaaugaggacuugaaaaacacuaauuauagaaccuuauauuuuugugauuuacacccccucaucuguuacaguugucccacacauauuuauuuugcagcuacuuuaaagccuuuccucuuuauuaaauuuuuuaaagcauguguuauugagcaacgggcucacugcccgaagugcguagaugccaauaauauggcacugguuuuugggaaaagaaagggcuuuauugugaggucaacuggcaaggagacaggaggcaggacucaauucuguuuucucaaucuggguguuaggucaaacuuuuauggguuauggaggguuauuuggugugcagaagugcugggaggguagguuuaacuggaggacuuuaaacuuggccauuuaggauaagguauggaaugguggauuucagcaccagaucuuucuagauaacugacccuuuacuucuaaaaggauucugguacucagguuuuggucuuguccuggccuucuuguuuccauagggaggaaacauugguucugaguguuauaggaaguaaaaccuuuuucuguugcacaugcccugucuccaugauuugcaauuugugcucugcugcaucugcaagacaacuuaaacaaugcuuaaacaauagaggugaacuggguugagcugccccugugcuuaacacaugcgaauguuuuaguaaauacacacucuuugugugcuuguauuucaaugauauuuaaugaaguauguaauuaaaacaacaagcacaaccaguuuaaacuagauuuggggacaaaaacaaauggcucaucugguugggacagaagugcucagguguuguacaguggcucucagucacucucacuggcaucugccaguacccuaugcugaggacauagaaugugcaagucaguuaagggaaggguuaguaaagagagcuucuauggcuugcauagccucugaaaagugcacucuguucagucuugaagaaaugugaaauuaagaagaaaucuuaucuaaauuauguuuguuguaaucugucggcuuauauaccuacauuuaggccuucacagcaccuaguggcuuuccuguuauuaaagagaacagcagacuucuguaacuacagaagagcuucucugaaacuagugauuuuaggggacugagaagaaagaggcagaugagauggugucucuuaaaggguuauuucaaagccaaaguuuagaugcauuucacaugcagggagugugaauugucuguaucuucuauaggguuuagucuaauccuuuuuuccucucgauguaugggaaggagucgcaucacaggaugcuggcagggccuugcuggugugacauaggcuucagcuuccuaucuguuuccccuggggaaucaaugaaaacaagguucaucauuccucuaauagauuaaaauuuuuuucuugauuaacuucacuguggaguuggcaagaguuguuaucuguuaaucaaaacuguuuaaauaaaaaauaaaaagaucaaacuuugagucuuuucucauucucugguuccuggguugggaauuagcugaucguuuuaggccugguuugugacaugaggcugucaagauggcgcuuccuguuaauuacuuuuuauuguauuuaagacacuuaaauaacucuucuuaugauuuagucgucuauguaauuagcugcagugauuaaaaucuccuucuuucguucuugccagagccuucuugaagagugagauuuucugaggugaccuuucccugugcuggacuucccaauuacuuugagcuccaauuuggcaaacccuuagaaucuauuaacuccuugcuuaugccuuucugcauaucacguuuucaaagaaaaguguuagaagaaaauguguucacauuuagaaagggacaucuacaaaauauaacuaggguaagccacacagauacacacacucauucucaccaccaccucaccccucauccauggaaaacugucacauauacagaagauacagucacuaaggcacuucccuauuguuucccauuaugugaaguauuucaggaugauaggaaacaauacacauggcccauuuugugaaaguuaaagaauggcacagagauggaaccuugaaaggugagcaagugaaaauuccuguuuauuuucugcagaagaucacaucuuuuuagacaggugacuuuauuuuuucuguuuauuuuucucauauuuuccuucuguugcuucccugcauugcucuucuuucuugaugcaugcaucaccacugccaccugccuugauggcugucagagcaugagaccuugcuaucagagguauuguccaaguucugugggggcucgggacaucuuagauaauucuuucccaugcagcagcuucaaggccaucuuuaugaauauccuuucugucuguuuagagucuucguggauagcgcuuaccuuuaauguauuuguaugaaccagacuauuaaauuugcaaagaauaagacugccuuugcuuuugcuuuuucuuugguucuaauuugcagggauacuuuuuuucucccagcuguucuauuagugacugaaccauuagguuaggucuuauccuuacucugcuagaauaauccuuuuuuaauccuaguuugguuuuucucagucacaguaggaauaagugucauacagcccccagcuuuucugacuacaguuguauagcuuugagguuuuucacugucagccaaaccuccuaucucucagaguuuucaauucuuaaaacacauuacuaauaucugacuuucaagcuacacuugggcaaaagcagccucuugaaucgcucuuuucuggccuagucaucuuacccagagaggcccacaacauccugaaguuccuuuucagcacuugagaaaguaugguuacaguguuaauaauggcaguggcucugccgggagguagggucuguauuauagccaacccuuuuuccccacagauugaugacuuacgcuuuaaucauagucaaugaaaagaacugcugagcccccuuccugcccugcuuugaaggaacacaagacacuagaaugaggguuguuguuuuuuuccacuuaaaucaguaacaaaccacuaaccaacucaacccaaaccuuccgccuucccaaaaagagcaguuuagauuguuuucuggaaaucauaggcugcuggguuaauauaauugugcugcuucuccuguguugaguaguagaagugugccuauccauucugaggacaucagaaaccuauguggcauuuaguuaacaauacuugagaaagaaguaguugaauaacuaggccuguccucugccagcucaagcauagcaaucauuuuaagacacuugucccauaaaacacuauaagaaggaacuuggcuguugcacaggguucaggauuacagucaggaaaauauuguugaguuucagacaaaucugucucuuuuguucagauauuucguggcuggcuaucuauggcaaccucauacugccaagucuuauuuccuuaaaaaugugguuucagauuacuuuauuaccaucauuucuagauggaaguucaauuuagcuuuucauaauggcacccuugaauccuacaaaucagcaaaauccuuuacugaaguaugugagagcuucuucuuuuccccuuuuugcuuuuuauacugucaguugaguugagugccaagcuguggauggaugacuugaauauuuacugcacugauccuugggaagcucccccuugucaguuucccaaaguguaccauggagagcccaggagagaguaaggcuuuuccccaaaucuguuuauguuguaacuuuugcuucaugucucauuguaauguuucucuaaauauuuuaaaacuuccuuugcuuuuuuucuucuauauucaaggagaugucuucaacuugaucuuucagguuauaugcuuagcuagacagcuggccaaucaugcauauugacuuauuuucauucauccacacucucuuguuuauuuauucauaucacuuauucauuuagccacucacucauuaguucauuuaucaaguauuaguggaaugcuugguauguacuaaggacuguguuaggcaucaugaauauauugguaauucuaaaacugaaauuauuucuaugcuuauaaaauuuacagacuauucuuuuaaucuagcccauuuuauugauuuuucuuucagcauuuauauuuaaauuuuuguucuuuaauuguucugucuuaauagcacccuauucuuaguuuaugaauacaauuugucucuaauaucucugagaacauuuaaaacuaaaagaaauaacacgcuuggcugggcacgguggcucacgccuauaaucccagcacuuaaggagguggagguggguggaucacuucagcccaggaguucgaauccagccugggcaacauggcgaaaccccugucucaauuaaaaaugcaaaaaaauuagcugaguguagugaugcaugucuguuaucugagcuauucggaaggcugaggcaugagaaucacuugaacccuggagauggagguugcagugagcugagauugugccacugcacuccagccugggugguagagcaagacucagucuccaaaaaaauaaaauaaaauaaauaaaauaaaauaaaauaaauaaaaaaaauaauccugggcgagauggcucacgucuguaaucccagcacuuugggaggcugaggcaggcagaucauuugaggccaggaguucagaccagccuagccaauaugaugaaaccccaucucuacuaaaaauaggaaaauuagcagggugugggcaccuauaaucucagcuacuugggaggcugaggcaggagaaucgcuugaacccuggaggcagaaguugcugugagccaagaucgcaccacuguacuccauccagccugggugacaaagugagacucccucuaaaaaaaaaaaaaaaaagaaaaaagggagaaaaagaaagcugggugcaguggcucacgccuguaauccaagcacuuugggaggcugaggcgggcauaucaccugaggucaggaguucaagaccagccugcccaacauggugaaacuugaucucuacuaaaaaauacaaaaauuagcugggugugguggcgcacgccuauagucccagcugcucaagagguugaggugguauaaucacucaaacccaggaggcggagguugcagugagccgagaacacgccacugcacucuagccugggugacagagcgagacuuggucucaaaaaaaaaaagaagaaaaagaaauaacacccucuucuguugucugaauuaucuguuuccucuuagauuaaauguugccuuuauuuuguuccuuuucuuugauaaauccuuaaauauuuguaaacuuucaucugcauuuaugaaggaacaacuuuacuauuugggguaggcauggcauuucucugcaguuacguaggucuacuucucuuggacagcuucaucacaaaagcgaguagggaggcagguaguaucagaggcaggcuuccuugaaggcugcccaaaaguaucugguccugcagcagagaggaagcaagcaaauuauagaccccacugaaauugucgagggaaagaggcucucugguagagagcuuuaauguauuuuccaggauuauuuugcaagugggggcucgggguugacugggaugugcuuugcagaagcugucucaaaugcuguggccacacguccaucuaaacuucuucccguguuaaauuaagggacagcuuuaguaguauauagauaauagacuuuuaaagaaaaaucugaguaucuaauguugagaaaucugcaacaguaacuuccuuuaguguaagugugacuauuuuguggcuuugagaacuuuaaugcuuuccaccacguuacagguaagcuugguagcaagcugcaacaguaauuggaagaacugugaagacauccuuuaguauuaaaacaguggguuaaugaauggucucuguuagaagcaaaguccucuagcaccuccucuagaagaggagaaggcaugagggcccaggguuuaaugcugcccugcugguagagauuuuacugggcuuguauuuuuauuaggcuuguuuuuacuagugccugggcuucaaaguuccauaggguuuacuugaaugaucugcccauaacccuauuuuucucacaagcccuuuuuauuuaagguuuucugugcaguuuugugguaaauauaugauaccaguuaugccuguacuuuugccagguaucaaaaccuuuugcuccuagcuacucugugggcaucacagggaaguggagauucuggcuggcuggccaugcuuuucugagugugauuucuaauuaauuacuccgaugaugacccuaaagccuacucacugugguuuuuuguauuuauugauaaaggcccuuggagugcucuuacuucuuaguauuugugcuacuauuucuccacuagucugaccccaucugcuuucugccuuucaggguuugcaaacuuucugaugugcugcuaacacacauucuuguuuucuagcaucauuagggcuuuguucguuuuuuguucuguuuuguuuuguuuugagacacagucucacucuguugcccaggcuggagugcaggggugugaucucagcucacugcaaccucugccucccagguucaagcgauucucuugcugaguucagccucccaaguagcugggauuacagaugcccaccaccacgccuggcugauuuuugcauuuuuaguagagaugggguuuugccauguuggccaggcuggucuugaacuccugaccuuaagugaucugccuaccuugccucccaaagugcugggauuacaggugugagccaccacuccggccagggcuuuauucuuuuccauaucugucuuucucuuauuucauggggaccuuguaaaggaugguguuuggacauaaguucucaguagaucuugcugaccuccuacuagcauucuauuuauuuauuuauuuauuuauuuauuuauuuauuuauuuauuuagaauagugccaugaugugauaaggagaagggggcauucgacaugguuacuaauaagcauuauuuauuuauuuauuuagaauagugucauugaugugauaaggagagggggcauuugacaugguuaccaauaagcaaaacuuaugggucuuuucuaugccauuucucagcccccuucucuuuauaauuccuguggucagcacagcacuaaguguuaaggggaauaggaauggaguuuuuauaaauuuuuguaacucacaguagugauucugcuuaaaagggauuugcucccuuucauucugagugaucuuuuaaaaaguaauaaaaauuguaguaacauuuucaaaagaaaauaggggaaauugccuguuauuucauccugcuaauauaauagcuccuauuuugggggugcuucuuuugagugcugagugcuuuuuuuuuuuuuuaaagaauauaaaauuuagaagcagaaaaacuuggaccacucggcauaagguugagaugaagucuaaggcaaacuauuguugauauuaagauucuauggaauuuuuuuugagacagggucucacucugucacccauguuggagugcugugguacaaucauggcucacugcagccucaaucucugugggcucaggugauccucccaccucagccucccaaguagcuaggaccacagcugaaugccaccccaccuggcuaauuuuugaagagaccgagguuuagccauguugcucaggcuggucucgaacuccugggcucaagcaguucucccaccuuggccucccaaagugcugggauuauaucaugagccacugcacuggccuggguauuuuuuuaaauguagaguuuggaaguaaauaggucugagguaaaaaacucagcucuacuauuagauacuguguaaucaugggccuuaguuuuuuuuguuuuuuugauuuuuguuuuuccagcuguaaguuagagauaauaguauauaccucauaaggauauugugaggauuauaggugauacugcauuuuaaauguuuagcauagugacuaagacauaacaaucaaauacuaaagugagcccuaagcccuccagaggggagcugcuuaccauugaccuaauuuuaaaaucuaauaguuucuuccaucuuucucuguccucuuucccaccucucucucacauguccagcuauuucuuuaagcucaaacuugauuuuauauucuguucucuuuuucuucaucacacucccuguggccaacucauccacuaaugugauugcuacccaacagauucuuuuaaggaugaauuuaguaaguaguagcuacccaagguuuaauuuacaaaacaaaacaaaaugccucauuggauuaugguugaggacucugugguacuagggcauuuuauuguuccauuggaggcacuuugguuuguauuagucuccucacaucacuuuuucaguuuucaugacggcaauugcauucauuuucccccuaaguauugaauguauacuguuuccuuaagacaguaaugauugauaaguacuugcauacagguagaaguaauggauaugcaugaguaaugcuuaauguuucaggaagcuuaacacauauuuaccauuuaguaggcacacaauuuauucuuuaauaaaaacaguauauuggauaccuuucaaaucaagaggugugcuagccagcuacuucccuggguaugcuagcuaucuacuuuaccuguuuaucugaggugaugaaaaggcacagggcuaccaaauuaguguuuuuggaaauguuuuuacucuacccccaccugaaaaggcuuacucaaagccauaguccauggagcuuuuagaauggcccuuccugcugugaugccuuaguuaauuuuucugccuuuagugaaaauguguuuuaaacagggaaacaaaaggaacuuggaaggauuuagcaaauauugcgaucuuggaggugaguauguaugguaggauugggagauguuuaagagcauuagcuucauaaagggagguggacugccuucuaucagauuuccauuguugguuuuacauggagucuucugacuuucuaauauaucugcuuacauauaaacugggauucagcagacuguugcuuuaucuauuguguuuaaaaugugguuuauaagccaucacgcauuaggucaguagcaaugggaacuauauuacaguucucauaccaucccucuuccuucccaaugaaaaagggaucauuuuggcauugacuacaaaaucaccuuuucuuuuuuuuacaccaagaagcaacuaaacaauucauuuauuccugucaccacuuuuucagaaauuucccucugaaauguuuauauugcuucuugugucacuuagcacccucugcagcuguggaaagaucagaucauugagugaagguuaaccacagagucuuuguaguggcuuacugucuuucaaagcaagaaaccaaaaauaccccuuccuuuccaaagagaaggagagaauuucaaagcccuuaaacuuuugcuggaccuauuuauugcuuguacuagaacuaugaaucauuaaguuaaaaaauauucugguuuccaauucuuaggaaaaaugucaacacuuuuuuuuuuuuuuuuuuuuuuuuuuugagauggagucucacucuuccgcccaggcuggagugcagugguccuaucucagcucacugcaagcucugccucccagguucacaccauucuccugccucaaccucccgagcagcugggacuacaggcgcccgccaccgcccccggcuaauuuuuuuuuuuuuuuuuuuuuuuaaagcagagacgggguuucaccauguuggccaggauggucuccaucuccugaccucgugauccgcccgccucgcccucccaaagaacacuuuuuuaaaaauguauuuuuguuuucacuuaguuuuguaagugagguuucuuuuuuuuucuucguagcacaguuggggguguuuacuuggcaagcagaguccaggcagggaggccacgggaccccugacaggcaccuccaaggaggauuuucauaagagcaaacacucagggaccaaggcgaguccaaaggggcuguggagagguucccucgcuucuggccaucagcacagccaaggccccacaacuaaaggcuuuuauugggaaagggaaauugacugaaaaauggccuccaacuuccucacugccugagacacuuggaccuccuccacaaaguucaggaaagaagggcccaccaaacuagguccccagcagucucagguguagaggucaaagucaaugcguuuggaguuguagaacugaccacgaaggggguccagcuuccggcaguaaacaccaucaggaaaguagccuucgcucacccaggucugcaucuggucgcuggugaagggcccaugcagcucggcaucccccggguucucccacuuauauucccacaucacauccaccagaccaucuccuggcaacucugcuucuccucucuggguagggguuggggucuccaguucccccucugccacuuccucagcgaacaugucuagggagugugggggugugggauuguggggucccuagggccuggcaccccaaacccuucagccgcauggccaacuguucccucguuuccugguacaugccaagguuucccugggccaccaucuggucggccaauucggagagccgguccgggcacugcggggaacugggucacccaggccccuugcugcucccuuugccuccuccucgggcccccagaugccucagugcccuagccacugucucucuaggcaauaggagcuccaaaagucccuccaagaaggcuugggcacucacuggggucuggcccaagcuguccuccucuuccaagucugaggccuggcguggggucucauuucuagagcuuuuaccugcagaaguucuguacuuuguuuaugcagugcagaucuaaagcagcugccacaaucuggaccuuagcaacacugacauuggguuugguccaguugcuaauggacucuagggaacaaaaacaccacucuccugcuccugugaugccagcuggcuaguauguaggccauaaaccauaauggacagguaguggaauuccucuuccuggacgucuuuuuccuuucugaccaauaugaaauaaaacuuauuuugaccuucuacccuaaaaagcaacaugugcugaaacaaguaucuucugacaaauuuguucuuaucuagaaugauuagauuugguagaagaacguaguuauacuuccaguuagcaguggcgugguauuucucugaguagaaugauggucgucuagaaucuagacuauuacuucaguuucuuccucugaacaaaacguuguuuauguauaccugcauuuacauaaacuacaggggaugugaaaaugacucucuggggcugccucucuccauuuuggaccuuucuagaccucauugguuuggcugguucugcuuucacugucagagcagaucauuccagaugccauuauguaauuuucugucuugggauauguguuugcaugggggggugguuuuguuuuguuguuaagugauguuuaaugucaagccaauaauauggauauguaggcuugguuuugucauaauggccacaaguuagcuuauuuauccuuauuucccagagacacagagagccacccuuccccaccccuacuuaaugucuacguuuugcagggggcucuugucaucacagcugccuaggaaguacagcauggccaguuggcaguucuauucugcagagacaaagaggaggaaucuuuucucugguugcuaccacaacugauugguuggcuuccugugaccuaaauagaaccaauaggaaugaguuugcuguuccugaaauaauaccaaaguuugcucuauucccuucccagaauucucagggucguguucuuugggaaggccaggugauaugacacauuuaugauucuggggccuuagguuguguuacaucauucuuggcccuugauuucuugaggagaguaguauuagcugaaguuuucugucuggguaguuuuucauaaaacuugauagacucaccuggagcacuuacaaaaaauagugaugcccaaaauuaaaaucuaaguacugaugcuugguguuuuaucaguguaaaucuucaccccuagagguucuuguuuuauuugucugguguggggucuggcauuaguguuuuaaguggugauucugaugugcacccaauauugcuaaccacugagaaagggagucuaaaggaaacaggaggggccaaaaccaacaaucuucucugcucucagauuaggucugcagcauagauacagguaauaggaggaauaagaaagacauuacagauguuuauguucucagaucacuuuuacagcucuguuaauuucuucaauaccaucucuguuuggaagauguacaugauggcagagcgguggaggggccaauggggagaugguuauuucuagcucugccuccagguuaaagugugaccuugcaagucaguuaaccucuuuuccuaaggcccuuagcuggccuuuuuugaaaguggcauaaacaguacugucaacauuaugcuuccuuaaugugugucuucuugguaauguaaaauuccuucaaaccccuucucagguucuugguagaggggauuucaguggugggaauguuuaugggugagacaagcaguagcaaugaagccacaaguuuccuguuggcugaaacgucuaguuguagauuuucccuguagcucuuccuucccaggcucuugauuuuaagugauuaguuugcuuggaagucuggauuuacaaaagucugcuuaaggugcuuguucuucauuaauguaaucagacuuuacccaaauaguuaauucuuagugaucuccaccaguuaauucaguggccugauugccauuagccacugaugugaccuuaguugaauugcuugucugagagagcagugguguaguggaauggugguguagugaauuuggaccuguaagguuccuuuuaacccuauuuguaacugauuuucaaauucaucgauuuuaucuggcuagcgacuguuuauuauuacuguuguuuuaaaacacccuccuagaaggaauccuuaggcaguaaaagguguuaaucucuuuuguugccucucuuauugcuagcuaaccaaaacuguaucuccaaguaauaaauauuuguguaucucgaaguaauaaauauuuggggugaugaaauaaauucaaguauaaucauuuuucaggcucaaugucaguugguggguuuauaaagacugaagcccaaaauuaaauauccaagaagcccuagaguuuaugguguucuguuuugggggauagccuuacguauaugaaauuaauaauguguauuuugaugaccaaaguauaauuauuuggcaggcuuuaauccaaacuaauaugcuggagaagauuggcuguuuuaugcugaugcgcuucuagguauaaccccauuuaugacucuagcuguuuucuuucacaccuuucuaaaaggggcuuuuauucagccaguaaacacagguauaacaaaacuagccagugccauauguuaaauaucuugaauaucauccauguuuacaacauaauauuuuaagaauuauaucauuuggucuuagauaacccuucaagguugcuuuucagggagagauguaaaucauuguaucauggguuggcagagaagagagaaucaggacugccuguuuccauuuugguuuggauccuuugaauugggacuauuuucuauaccucaucuugcacuguugagguuuguguguuuaguguggcugagaaucauugcuuuugaagggaugcucucugcccgucuaccuggugucauucauuuguuucguuuuuguuuuuuguuuuuugagacagagucucacucuguugccuaggcuggaaugcaguggcgcugucuuggcucacugcaaccuccgacucccagguuuaagugauucuccugucucagccucccaaguagcugggauuacaggugcccaccaccacacccagcuaauuuuuacauuuuuuaguagagacaggguuucgccauguuggccaggcuagggauccugaccuuaggugauccacccgccucggccuccugaagugcugggauuacaggcgugagccaccgcuccuggccuuauuuguuuuuuaauuaguguaccauuccaugcuauaaccuaaaacaguaaguagaagucuggaggccgugauuuucacauccaggaacucaagggaagaauggaguguauaggcagagcauggccguguccaccugugccagguuuuuguuuuucacugugcuucaucuuuaacacauuuguugaagacuuuuugacauugauagacuaugucuagcaauaagacauuaguauucguuguggauuagaagguaauccccacauuauuccccucaccuucugcaguuuagcuuugauuucacuaccuaagaggucuuuuucuggaaaguacacuuuuuuaauguauggcagcuucaaaagcaggagcugaagaaugcauccaguuuuccuagucugcuaaaggcagggacuguggaaauagaaucagaaugucguuauucuacaacuuuucuaaaucaaauuuauuucccaagcaugaaguguuaacagcacccuacccacuggaauauuuugagggacaaaagaaauucugacuugauuaccaggacucucgucucccucuuaauaugucucuaagagguuuuuugcccuggaauccggugcccggugaucuuaggacaauuccccauuugcagcauaauuuauaaguuacccauucucucuuuccccuguaauaacaaaauugcugugauagccauccaaccaguuaaaaaaaauucagguaauucauuucuaaauuggaacuuguuucuuuuaaaucagccuuguaauguauuacagacaucacucucagcauuggcuacagaagugauuuaaugcugaguuuuuaaugauuccuucauuaauccugguauucugggauuuaacacucacuggccaaugaugaaaacuuugauuucaugcauaucagauaacgcugggcaguugcugaagccaugaaucuugccucuguaguggcauguaugauugagaguguugcggauggaugggugcucucccaggccgugcacugcugcugaagaggugaacacgauaucuuuaucagcucagggugaccucuucccagcacaguugcauuugaagcaagaauuugcacugacagcuucgucuccuagaucucuggacuugugaagucaagcuucaccuuuucaacuauuuccuaaaagaugcuuucuuugagaacaugucccuugaugucuauauuuugauuuuuuucuucuaauaaagucauauaauuuuuuaguagaaagacaucgauaggacuaucuaguccaccucccucauuuugcaaacaaggcagcggaguccacgaggagugacauaacuaggccaaugcuaauaauaaugaaaauuaauaacaacagcagugaccgccaacauauauaaugcuuacugugcgccaggcacuaucuaaauguaguaauucauuuuuuccccacaaaaccuucaggagguaacauugcacagcaaguccaguaucccacacagcuucuuucuguaccuccugcugcucuuaaaagcagagaagacaguguugguugcauuccuuacucuuaauggaagcauuacaaauguuccauggaagcgaggugccaguuuauuuacuguagagucuuauggccagaguguuaauauaccuugaaaaaaugccauguucuuucuucccucaaaaaaaaauuauugcuuagugaagaggaagucaccuuauccauagagucuucucagaggcugucauauuacagugugcugccuuaguuacuuuguuuugaacauaugaauuaaccagugcuauaugaaugucauauuggcagaaucguaaaacaauagcuaacuuuuuuuuacacagauacaguaauuauuccugugagugugacccccucauuacaagcaccauggaaaguaaccuguuaaagcucaccuugaagagcagugcucuaagguauaaguuggcaaacuuuucuucaaagggccagaugguaaauauuuucagcuuugagagucauauggucucccuugcagcuauucagcucugccuuuguagcgguaaagcagccauagaugaugugcaagcaaaugggugugguguccccauaaaacuuuaacuccaaaaacuggagaagaguuugccugccccuguccuagguuauguuguggagauaggaauauacgauauacuuauaagacaaaugauaaaauuucaaagugagagaaaaguaccucaagaagugucucuauugaugguguauacucugguguugaauacacccauaccgagugcagcuugagcagaacuuuucugaaauguauacuugaugauguauaaauguuauaaauaaauacuuuauuugauuaguuagauauuuaggauaaauaagaaacuucucccauuuuucuaagucuucccccaccccccaccccaggaaauuagguagcucuuuauaugcaagcauguuuucuugucaucuuuuucucuugagcccuaucaaaggcucaguuuaugaggaaauggcauguuuuggaaauuguuuucaauacaaucugauggcuucucacuuccuuccaauugagccaucucuacacuggucacuggggguagaacaguucaccacuucuguuuggugacaccagcaaccauccauccacuucuugcugauggugcucuucugguuauuugaaucugugagcauguccuuguuuuucugggugucugauucucauauuuuguucaaugcuaccuaagucuugcuaucuagaacaguucugaaucuguaaaacagcagagucuuuccuguuagaauuuuauuacuuugcugccaguuuaauuuucugauuucuuucuggugucuuucucccuuuuuucauucucgccaguucagugcugacuaacccuuuucuuuguauaccuugucaaaguuuuuaauaugaucuaauugaaggcacuucccugcacuauggauuuugcuggucuacuagagacaguuuuucuuuauuuucagcaugccccuuuucagaugcaucuggaauaacagcugcauucccacuccugaauaaaauggguuaggaaagcuucucauuggcaaagcaccuggauucuuuggcaagauuggagguaaacuccagaccagauccaucaccaggagaaugggaggaccaauuuuuauaggguggggguagaccauaugaaugaggaugugagugaacucauguuauagaagcaccauuuauaucuguuaaauguaagggauuagauaaucugucauuaugcuaauucuggguaacagaugguggagaguucugcaucucaacagcaguauucaccaugggggaaauuagcuugcacccagaucagcaguuaggcaggaauuccauugagagagaaacacuauugaugauuacauuaguguaucccucugagagcaucuacacauaugguggguuccuucaaauuaucuauaguugacauaugcuuggccauggcccuuacuaaguuacaggaccucuguccuucuaucuauaaagaauuugaaguucguuuaggaagaucaagauuggaaguagguuaggaaauguggcucagagcauuauuguaucauacaguuuuucuucaaagaaagaugccauacagaugucaaaaacauuguuugucugucuuuggaaaugaacuccagaaaugaaaugagaagcaggaacuggauguguucuuuguaagugccauaccuuaucuuugguacaagauuaaacaaacaaacaaacaaacaaaagauuuaauuaaguccuuuggcuucacauucucuaagggacugucuugauucuguaauuuuuuuuuucuccuuugugguuuuguuuuguuuguuucguuuuugagacaaggucuugcccuaucacucaggcuggaaugcagugacacaaucaugguuuauggcagccuugaccuccuggauccuccuacuucagcuucccaaguagcugagacuacaggcaugccaucaugcucagcuaauuuauuuaucuuuuuuuuuuuuuuaauagagacagggucuugcuauguugcccagacugugguauuuauuuuaugugguauuuuguuaaaucauaacuucaucuacccuuuguaugcugaugauuaucaacuuuuuauuucuccuuuuuuuuuuuuuuaccacauaccugcuuuucauuuccauuuguaucaucuuacucucauuucauagccaacaugcuuaacucuaaugcugauuaaaaugaagguuucaaacuccagugugcccaagaaucaccuguguaguuuauuaaaauacaaccuaagcagugggcuagacccagcuuuuuugguacucaacaaauuggagucuucuccugucagaugauucuauuccuuuucauaucggccagacauacugagcucgaagagaagccaagaaccuagacaacucauuuugaagagcuguccagguugauuggacaaccauuaaaauguaucaccacuuguacagggaauauuccagaugugcuuuaaguaggcauagucauucauauuuaaugaguuacuaaguuggauuaugagcuaugguucaagaagcauauagcauuuuggauugggaaaucuaaaagcuaggggcugcccaucaauaauagcuuugauucccaccaggagcugaaauaauuaaagguguuugaugcugccuagguguuccuugggguauugagagaaagcaauuucauuaggaagguagugauuuaguuauuuauauguuaaagaauucuguuaucaguucuuuccuucuacucuugccaucccuccacuccaugcacucaacaaggcagauccaagcauuucguaccugcagguuuucccccucuucaaaucuugcugcauaauacuccuggauuaauuuuccauaaaugcuguuuuaauggugcuauuucacuaccauggcuauuuuagacuuugaccgcuuuuguccaccaagccccccuacuuaacuauaucucuuccuaucacugucagcagucucaucucuuacuuuauggaguaaauauaggguuaucaggaagaugccuuuaacuucuuguucucucagcuuccaguuugccuuccuuguuaugcuugcuuucuuaccuccugccuucccaucuccguagacaguuucaccuucuucuuuccaaacuaauuguucugccuacaugcucuagauuccaguucuuuuguucuccuugggauuuugugcuauuggcuauucucuuuuuaacuaguguuauuuuuaauuguccuucagucuucuauccuauuauaucugcuuuucuucuucuugccuucucuucauagccaaguuaauuagaauaauuaaaagacauuuuaauucugucccguuugcuauucauuccuuucccuucuagcuuugaaccuuccccaucauucaccaaugcuucccugaaggacacuucucagucuuuacuuuuacuugaccucucuggaguauuuaauacuuaucuuuuaaaaucuuguuuucuucuaccuuuucaguauaccacacuuucguggauuuccuucuacaacucugauaacuuuuucucagucugcuuugaaugcuccuuaaauauuugugcuuccuaggcuucugucauugucccucuucuuaccacuauucagucucugggugaucugauggugaugcugcugacuucccuuucccugucucuagcaggcuucccaccuauauucaacugcuguuccuuuacucaaaugaucgcgucuuuugauggugucaccauuuacauagucuuuuagucuagagaucauguugucgucuuuaucuccuccuaacucccaguauguaauuaccuacugguauaucagguucauccuauccuggcucuccucacugccugguuuaugcugucaguguagaauaacucagcaguucuuuuuacuagccucucuauuucuagucuuacugcccuccaauccauuuucuacauuacugcuuuaauucucuuuuugaaacacacaucugauuuuuagaaucauuccauaaccuuaggaguggaguauacugagccaugaccuggccccucccuaccucuccauguuuauauuuacauucccugguucucauucaccauuccuuuaaaaaaaaaaaaauuaaaugcauuacuauuuaacuuaaucugcucucugccuggaacauacauuucaucugguuagcucuuacucauucuucagugcuucauuucucaggaaaguuuugcuguagguacuccgucuaaaaucugaauugugcaucuugugugugucuucccccaacacuuggugcuuacuuauaauaagacucauaguaggucaggcaugguggcucacgccuguaaucccagcacuuugagagaccaaggugggugaaucacuugagcccaagaguucagguccagcuugggcaacauggugaaacccuuucucuacuuaaaaaauagccagguguagcagcaugcgccuauagucccagguacucaggaggcugaggugggaggcucacuugagccaaggagguggagguugcagguaacugugauugcaccacugcacuccagccugggugacagaaccagacacugccaacaacaacaaaaagacucauagcacacacagcacuaggugacaaauaacuauuuuauucccaguauguaauaucuuuucugccuuauagaggguauuugacuuaacaaaugcucguguccuuuccauggcuccccaugggguaugucuuuauuucuaggcuuggcuaagguccgaaacacagaugaugccuucuguggcaucauuuagagcauuagcuuugucuaccacccuagagguccuucaggucaaguuaguccgcuugguaugauagaacagaaaauaugacuuaaaagguaaaugucuuucucaaguuucaucuuacuaaagccagacuuggaauuuaaaaucucauguuuccaaauguaaguaaaacucaaccucauuugcauguaaucuccaaauugcaccuguuuucuuaggccacaugaacauuauaugguuguuuuauuuuuuuuaacuuuaguuuguggguauuuuuuuuccuccaucucuagucaacagcuuauuuacugaguugaguacaugacguugccaggcgccaguucuuugcacuggggauagaucagugcauaugauagagagaucuauuuugugcggcacuuucguuccaaugggggcaaucagauaaagaagcaguaaagauauauaggugaugaaaagugcuauagagaaaacuaaagcuaugaaagaguugagggagguauuccaggguuacgagggggaaauuuuuuaguagggaagccagggaagagucagggaggccucaguggcaagguaucaggagcaaggaccugaaggauggcaaaaagcaaguggcagaaggcaaaggcaacacuagagacagaggucuuauggucaaguguccuggauagcaaagaaggcuuuaggguuggagcagagggagcaaagguggagguggugggagaugggguuagcgaaggagggaauggggacagcagaccuguaggcuguacauggccuuugcuuugagugagacaggagccacuacagaguuuggaguagagggauggugacaaguuuugucuacuuugaccuucagagauuuauucugguugagaacuauucugauuauucuaggugagaauggaguuuagagucauuaaugcuuuucuugucuccuuucaguaaguuaaaaucccauugacuuuuuuuuaaaaauaauuguagauucacugaaguggcaaggguaguagagagagggccaucccauguaccuuucacccaguuuccaccagugguuagaucucauauaauuauaguacaauaucaaaaccaggaaguuuacauugauacagugucuuuguauaguucuaugccauuuuaucaacugucgauucacauacaucacaaugaagguagaaaauuauucagucaucacaaaggucucccuagugccaccccuucuaccccuuucccuucccaucaucccucugacaacuguuuuccaucuccauaguuuugucauuucaugaacauuacauaaauggaaucauaauaugugauucugugagaugggcuuuuuaaauuuagcauaaugcccuugagauccauguaagucacuccuuauauaguuuguucugguugacuucuaaucugugugugaauguaggagacaggcugucaugguggaaggaugccuguuuuaugacuugagaccugaguucuagcccagguccaucacuaaauacuacuuacuaucucugggucucaguuuagccaccuauaaaaugaagaagaaauuacagucaagauucuuucaguaauaauuuuuuggugagaggacuguaguagucaccaacuccaucugccuuuuuaauacuuacugugcaguaaucuccuaugguccuuaguauauugucaagcucauucugaccacucaagaaacagcucauagugguuuuauugacauauugcugcuacuugucuuuuucgaguauaagcuugauaauaggccccuauacuacuuaacaagcuacagccaugcauuacuuaacaauugggauaccuucugagaaauguguccuuaggcaauuuggucaucguuggaacaucaugcaguguacucacaggaacccugauaguauagccuacuacacacagaggcuguaugguauagccuguuguuccuauacuaaaaacuguacaucauguugcuguacugaauacuauaggcaguuauauaacacaaugguaaguauuuguguauguaaacaucuaaacauagaaaagguacaguaaaauuagaguauaaaagguacuuaccgugaauggagcuggcaggaccggaaguugcuuugggugaaucauugaugaaauaggaagugaaugugaaagccuaggauguuacuguacgcuacuguagacuuuauaaacuguacgcuuaggcuacauuaaauugauuucaaaaaguuuucauuuucaauaauaaauuaaccuuagauuacuguaacuuuuauaaugcuuaauuuuuuuaaaagaaacuuugacuccuuuguaauaacacuuagcuuaaaacaaacauugcacagcuacaaaaauauuuuuuauaucauuauucuguaaacuuuuuucuauuuuuaaaauuuauuuauuuauuuuacuuuuuaaaacucguuuguugaaaaguaagacacaaacauacacauuagccuagaccuacacagucaggauaauccuuaucacugucuuccaccucuauaucuugucccacuggaagguuuucagggggcaauaauguaaauggagcugucaucuccuaugauaacaauaccuucuucuggauacccccugaaggaucuaccugaggcuguuuuacaguuaauuucuuuaaguggaaggcaugcacucuaaaauaacaauaauaaguaugauaguaaauacaugcaccauuaacauagucauuuauuauuguuauccauuaccauuacugccuguacauaauuguaugugcuauacauuuauaggauucacagugcgguagguuuauuuuuaccagcaucaccacaaacuugugaguaaugcauugugcugcaggcuaugacuacgcagucucuaggccauagcagauuuuuuuagcuccauuauaaucuuaugggauccaccugcguauaugugcuccaucauugaccaaaacaucauuauguagugcaugacuguauguaaaugugaagaugaguguuugguuuuucauuauuuucagugauaaguugcagaaaacuguaucuuaucacugaaaauaaugaaauuucuccugcugccauagcgcuccaaacuagaaauguguaagguaugcuuaaugcucauugaaaugauaaacaaucuuguuggccucaaacauuaucaucaagugucauuauaaagauauggauagaagugugaaucuacauugaacaugcacuacgugacuauuaauaaguagauccuaguucauguuaaaaauuauaggcugggaggagggacucacaccuguaaucccaacacuuugggaggccgaggcaggaagaacucuugaggucaggagugugagaccaaccugggcaacauagcgacaccccaucucugcaaaaaaauuuaaaagauuagccaggugugguggugcacgccuguagucuaauucaucaggaggcugaggcaggaggauugcuugagcccagaaguucgagucuguggugagcuaggauugugccacguacuccagccugggcaacaaagugagaccgugucucaaaaagaaaacucauuauaauaugucugagcuagaaguuauuuuguagagcauuuagaucuagcaucucauuuuauagguauggaaacuggcacaggcuuagcacauuuacaugaggugaagcagcuauagagagagcuggggugagaacccauauccucugcucuguguuccugcucugugccaugugggguuuugugaaacaggcucagaauugcuuucuggccugagagggcuggaggaagugcauaagaugacuuucaguacugaagaauaaauaccaaugcuguguguaacuucuuucuuuuguugguauggaugauggagaauuaauugaucaguguuuauucccagcauuucuguuuggccauauacauuuguuuuguugugcucuucucacucuucaccuauuuuuuauaauuuagaugaggauuuuuuuuuccuguuaaaguguugauaugacacaguaucuuacauuagaccuuuuuuaacacacacgcacacacacacacacacacacacacacacacacacacacacgacucugccacgcagugaaucuuuuuuagaauguugguuuccucuuuucuaagcuuuagaaaacaaacauaauaagcuaagcuaaaagcugaauauauuuuugguaccuacagaugugaaauuauuuuaacugguaagaaguuuacugucugcgaucgauuuuuuucuauugggaaaaugaauguaguuggggagucauauuugguuagaaauguaaagaaaauaacuaggagaauaucucuuugaccaacaacagaccuacaucacauuuaccuuguucauucauucuuaagagcaccuaaauugaucucuuugcuggaauauagugguaucuuugugaaaaccagagauugauauguucuugacuuuaagauacucaucucuuauauauuccacccuuuaauaugccguucacggauauuucuaaacuugauuuuauucuucacccaguggcaguauccuugaagccaccuucacuucaucaccagucuucucuugccuuucuccuuuuucugagcagggugacugaaacuguuggguuucagguggguuagggaaccucacaggaauuuauguguucagguagagaacacgucauuaaguuccuacucagcuaguggugaggugacagaguaagacagaguccuucccucuuacucuauccuaaguaccuaagcagaggauuaaagauuaaucacuacccagccaccuuuccuggacuccguaauuggagugggauuugcccaaccacccaccuuagacacugcagcuggaaugggaauuggguaauacagggcaagaccgagaagagaaaauccuguuguauguccuuaccugagccuucaagacuucuugaagccuaacugugucaccuaccucucacccugggccugggcuccgguguuuccuaguuuagaagaaagcauggccuaugcaacucaggcuuagggaccauuuauuuuuauuuuguuuuguuuuguguuuuuuaagagacaggcuguguugcccagacuggagugcaguggccauucuuaggcaugauuauagcauauugcuuccuugaaccccuagacucaaguguucuucccacaacagcaucccaaguaguugggacuauaggcacaugccaccacacccagcuggacuuuuuauuauucagcucuugaaaucgaaccucauaauguacuguuaagauccuucugguugcaagaaacaacaacaacucugacuauucuaaacaaaaggaagauguaugggacauuaugaagagcuaauagaacucacuggagcaucaggcuuggaaaauagauggagaacagggcuccugcaaagggccaagaagcaggaugcagauuuguugucuuaauuaggagcagucuggccaggacacccucccuuauggugucacaggggcaggacaccacuguaaaugaaauuugacucuucccucuauuuuguauuacucuccacgcagaagcauuuaauaggcagagacucugucaugugucucugccccaccugccagggacagggacaggguagucaucugaugauuuucaucuucugugguguacagcuuagcauugcauccuauuaagaguacaacagugugauauguuaaaagggagauaacaguugacuguuacauccauuguuuaacaugugaaaguugacuuucaaacacauauugaaagaccauauuaugcacaaaaguauguaaugacuguuaucauuuuuuguaucaggacccuuugagguuacugacuugaguccagagucuaggacagugguggaguagagaaaaguccccugagugacuacacaaacucucaauuccuacucccgccaucaaugacuugagagaagcugaggguguuuuuugauacuucuauucacacuccccauacugauauuuuuugugaaauuuuguuucucaaaggauagaggagcagaaaaaaaaauaaggaaugaaggaaacauaccuagaucuacaauaaacauuucuacuuuacguuggaauauauccugagaaaaaagaaggggucaucagacauuuucgaaucauuucucccauaccccucaaaaaaauccucugaauccccagaaggccugcaaauuauuguaauuaaauguuuaauauauaauuuagcuaacauauuagaacuagagugcucaaauuuacaauauguggauagauuauuuuuaauaugcuaauacauuuuuaauguauuaagggcaaccuagauaauucaugcacacaguauacuuauuucuauuuuacagaauuauaaaagcacagcaguguaauaaagggaaacaggcuaagaaucagaaggcucuuagaugcccauuaugcuggugucacucuguuuuucuuuuagacaacaacucauuaaaaaauuuccuugguuucucucuggaucugucuucaucugcguaugaaggcauuuggauuaguuucucucuauggagucuuuuugcucaaaaauucuaugacucagucaguuauuacuuuguuuucauccaacagcccacagaaccuccuaggaacucagugaguaaaaucaaucagcuagccaauaaauauuuauugagugccuacuaaguguuuugcucuucuuggaucuguagggaauaugaucuaguugggaagacaagauauguacccagaaaagauaauauacagcaauaaaagcugagugccagaugaguggugcagcuacaggcaccggcauggggagaaugccaggcuugguugguggcuaaggaguagccuguucaggcuaaagcagaaaguuggaagggauuuaauggaauagggucagagguaugaggguagauuguagaauaccuuuaauagucuguugcccuggaauuguggcacuguugagucaaaagaaaaccagguuugaaaucagaaaaccuggcuucuaaucauggcucugccacuuacaaaaugauuacauguggcaaggcugcaauguuuuucucuuuuuuggaagcaauauauacugccuuuguauucuguauuacuaggaugauuagguuaauguguguuuaaaugccuguuccaugguggacauccuguagauguucauuaugucugaaauauucuuuugaguaaaaauggaugagaguugugucaucagauguuuucagauuauagguuggacaaggucauuggcaauguccuuuuuaucacagaaacaccauguuucuaccuccagccugugugugccuccuugguucuuuuucacuuacaagcuuuguaaccuuucugugcuucagguuucucauuuguaaaauagggaauaauaauagucccuaucucaucagaauuuugugaagaucaaaugaguuaauaaauguacagcguuuagaauagugcucaguaaacuuuaggcuuccuccucuccccuaaccauuuccuuuuccugcuccccuuugccccucuccuucucuuuguccuuugcuccuucccccuucauugucauuauucagauaugaugcuaaugauugucuucguauuagaaaauuucuaaaaaaguuuucuguggugguugugguguguuuaagaaugaggauuacuugccaaccuaauccuuuaagaagauucagcugacaguguuuggaauuggucagcaucaccaggagaccagguaugggaggcuguaauagucccugugagaggcaguaggagccucaacugggguagagagagaaucgaaaagaaaauguucaugggaaaaacacuguagguuugaguucagagauuuuuauacaggaaugagagagaugucaggccuaggugcugagaguaugaugguccuccagauagggcuguugggaggaggagcugauuugguaagauucaaaaaagcuuuuaucuagggaagugaguuuuauuuuugaaaugcugaguuuuacacaaugaugaaucauacaaauucacauguccugcagauaguugaaaaugugaaugcauggcauauuuagcagugaguggaccaguuuaguuggauuggaaguucauguaguuuacuuucuucaagcuugauccaguauuugauuggucuaaucuuaauguuuuugaaguaucuauuuguuuccuucugggaaagaagcauguuuguuguauagcaggagugucacuuuggggacauuaccgcauguucugucccauuuagagagauucagacaagucuaugcaguuucuuucuauugaacagguuucuuuuucuuguuuuucuucucucauugugaugauugaagaucagggaaaauauuagauauuugaagauggacauuguuuuauuaccgcuuauauuuaauaugcccugcauacuucagccaacauucaucauguccuaacuucccuagauauuuugcugacauggaaaugcagugguauucagagaggagcuggcauaguggagucuaauaccaguuuuacuugucuuauaaagccauaaccaugauauugcugaauaaaugagacuaucaaauaagagguggcaacaagauuacaguacugcagaaauccugggggcagaauaaaauugucuauuuacuaagcauaacuauuugauauaacuguuugauguuaugccuucuuccuucuccuuugcuaaauugcuuuggcccauacuuuuaacacuguauucucuacuugccagcuuuauaaaguggguuaguuguugaauucuacugcuuccauguauauuucuaucuuaucuuccucugcccguuuguuguucuuuccugagaucucagguagaugcugaccaauuccaaauacugccuuccuggguaggaagggaauaaguagaaaugagguaauggguaugcuguuucucagagauaccuuggagcagaccaguagcucuuuuggcuaggggauuaugaagugacauuucucuaucauccuucuuauuuauuuauuuauaagaggugagguuuugccguguugcccaggcuggucucaaacuccugagcucaagggauccacccaccuaggcuucccaaagugcuaggauuacagacaugagcuaccgcguccagccgaucacccacuuuuaaaaccccagguaucuuugguuuuguuucuuuucuucccaaacugaagggagcuauugguacucagugagauguggccucugaagcuggagagguguuugucagggcucaaauguaagcugcuuauuaauaaugaaguuucaauggguaugugcuguagggauucaaggguguauuugucuacaaaaaagucuuguuuucauuuuauggaaugacuuuuuucuccccguucucucuccuccuucuucucuuuccccuucccuaccucccuuguuucuuucaugcagcauuucuaccaauguuguuuauggguguccuuugguuucauucuaaccaugcauccuuuugaguucuuaaaauaggacuaaguccauauaucaaucuucauuguuuucuuuccacuuccuccucccaugaggaagaaugauuaggauucauuaaugcacagucauuguucccacgaguucuugauuuuuguaucuccaguaucuagaaaaugcucucaacucucaguuguauuuacgaucacagaccuguacauacucugaaugcuccuuaaauaugaacuaaaacuuauuagagagauucauuuaggagaauauucuuuuugcuuuauuugcucuaaguuccauaccugcccauucaugagugugacuuuuuggggucaugccuuuauguugccauauaaccacagcugugcugguggguugucaaagguuauagacaauuggcucucacagccuggaguaaggaugcccugccccaaggcgcugcagcucuugacaacccuugguuuucccgucacuccacacuaguuaccaaagccuggcuagggaugucgaagcauuuguauuuuucuccguuuucaaucuguauuaugaauucugggaaagucuguagccacuguuuugauccucuggugguuuucuugguggcaggacuuguuaaacagagaaugggcuuuaaauuguuaaucaguguaaauggauuuaaaaaaucaauuucagucauuuuuagaacuacauaaguuuaagggggaagugaaaaauagugaagaaggugggagagagauuuaguaaaucuauaaagcaugugugccaccucaaauguuuccaauuaucgaggcuuccaaaacagaaucuccugucuacggaugcagcuugguuaugugagaaguaccuccuagauauauaugaagaacaaaaauggggacaaaaauaucgaugauccagauucacaggaauucaaccagugaagacuggagaauaaaaaacacugggugggaaggguguggugugacuccuugaagaugccaucacacuagcuuuuggaaguucccuguuaguuucuaugacuuuuuccuuguuggagaccugguuggaaaauaguaacuucauaaaagauauuugcacauugcccauugucucuagaucucucucaacuauaauuuuugcccuuacccuuuagagauuucuuuugucagcuuacagaagccaaaucugucucaagucugaaauggucagguuccugcuugaaagaacauggauguuagacaucuuagucugaacuuguagggaagaucugaagagagccuugcuuugggccuguucaccauugagcauuuuuccuacuugcuaacugucuuuugggauagguagcccacauccuccauauauaugagcaaaggaacuaauaaucugaagaaaauaguuuuucagucuucugagcuuuccacccuguuguugaauccuguggugaccuuccuuacucguuucuaaccuaguugcaaagaaagauaucagcacccuguagcuuuccuucuagaucagccccaugguaaaacauccccugcauagcugacgauaagugagaucagccaugugguauguuaggaaucaauaucggaacucugucgccuucagaccuccauccuggcucuucugagaaugccuguaauuguggggaaaguauagucaauguguaaagggaguagaggcaguuuuccagcauuaagacauuggaguuuuugagggucaugggugacagaggccuaggauacaugccugaugucucacaguaaacagccauaaggugccuuuugugcugaguuuauaagauuuuaucacagggccuugaaguuaccauaaagaauauguaauaaauauaugugugugcaugcaugcaggcaucugcaugagauauaugccucuacuaucagugaaguaguaguuccccuugaccugcaauuuuaguugcccaugaucaaccacagucugaaaauauuaaauggaaaauccuagaaauaaacaacgcauaaauuuuaaauugugugccuuucugaggagccccauucggugaagagauaucucaccuuccagcguaggcuaugaaucaucgcuuucuccacuguauccagauuguauacacuaccugcaucuuagucucuuaguagccaucucaguaauuagaucgacuggcuauggaugcuugcauauuguuauaauuguucuguuuuauuaguaguuauuguuguuaaucucuuacugugcuaaauuauagguuaaacuuuauuauagguauguauauauaggaaaaaauacagaguucaguacuaugugcaauuucaggcauuuacugggggucuuggagcauauauuucuugcggauaaggagggacuacuguauuauggauauacuacccuauuaauuauauuucauuucuuuccuuugcccaugacuaaaauauauugcaggcucucuucuuuauagguuuacuuuauucugaauaugugcccacauguguuuaccuuaaggaaaauauucggcuuuucugaucuccauggaugccucagagacugauaaaauguagauaguuuguaggugaaaaauguuaaguucaaagagcuagauaaagaucuaagaaacagagccacugaguuaucugcauccuuuucagcuggagaaugcagggguguguguguguguguguguguauaaugguguuauucccugugcccacuuucuugauacuguugaggcccagaacgugauaccccacagggugacauuuuuacaugcccagaggucucuuaauuuugucuaccucacccagcuacccaccgucucccacagcgcagggagggacucuuucuggaauuuccuauuugacuaagauagcuucuuuccaacagaaaugcaauugucuuaaauucccuuucuagagaucucaccagauaaucaggaaagauguaccacugcaguauaauagagagugggcaccaucaccaugcucagacuuuucaucuauaguucugagggcagcucugagggauuaaccugggagacuauuggcuuaauaagacaaccuuuguuucugugcagcuucacuucucaccuuccaguaaugucugccucccacucucuggguccauuuauucucccugaagauuuacugcuccucaaagaauuaccacauuccccaucucaccccuccccuaugaaaagggguacauaagcuucuguuccacccuagguuauuggauaaucauucuaugauucccuccaugcuaugcacauuaaaauuaaauuuuuuaugcucuuucuuuuguuaaucugccuuuugucagcugauuuuuagggaaccuccagagggcaaagggggaguuuacccucagccccuauaauauuuuuauucauuuaacccagguucuuuuuuaccaaguaguauauuccuuuuaaguuagcucuacuuaugggcaccaaauauucaaagucacagaaugcaugaaugagugagaaagaguauauauguauauggggaaaguuuuaucuuuauuguccccguugaaauaugcauuaccuuuggcuguaaauauaacuggacaggcaaaugcaaaacacacagucugguucucucauugaaaagcucgcucugccccuucaugguuugacucuauggaaaguuagcggugguugguguuuggugucaaauggaaacaauuuuuuuuguuuuugagacagucucacucugucaccgagucuggagugcagugaugugacacucugucacccagucuggagugcaguggugugaccauggcucacuguagccuugaucuccuggacgcaagagauccuccugccucgcccucccaaaguguuagaauuauaggcgugagccaccccaacagccaaaacaauucauucuuaaagcaguuggggcagaggcuggacgcaguggcucaugccuguaaucucagcacuuugggaggccaaggugagaggaucacuugggcccaggaguucacaaccauccugggcaauauagcaagccccugucucuacaguaaaaauucaaaaaugagccaagcaugguggcaugugccuguaguccuagcuacucagggggcugggguaggaggaucccuuaagcccaggaguuugaggcuguaguuacuaugaucauaccacugcacuguagccugggugacagggcaugacccugucccuuuuauauauguuaaaaaaaggaaaagcaauuaaggcagaucaaaggcauaugugcucagagggguagucuggcuuggggugucagagccccauaggaggggaaggaaggcaggcaggaagggagggaggaagggagggagggagggagggacggaggagaaaagaggagaggaggggaggggaggggaggggaagagaggggagaggagaggagaggaauuuaauuauuuuggaaauagagcacuggaacauuauuuuccuagccaaguuuucccagcauguaaucaaggacgauaacuuucugcaugcuuucccagcuuuugucuuccuccucucaauuaucugggacuucaauuuaaaaagagaaugaaagggagggagagaaaguggaauuagccuagauccauguacuugacugucucauucauuucuuuuggcugcuaaugaaaggucaggaaauuuuccccuggcuacagauggcucagaaccugacacuacugaguugaucaguugcccaguaagaaaagagaacauuaaauugugugccaugacauuaugcugcuuuagacaaauuuauaaauucugcuuucuugaguguaucaguaauucuacuccaauuacacaugucuggccugaauggauaauucacaaucggcauauaaaaagggaccuaacaaccuuggaagucuaacaguaagccaucacucuccaugucagcuagaaacaaaaagagaauuagugcuaggacugaaaugcuucuccaaacuaaaagagauguuuaggguucuacuaaaagucaacaguuuccauuaggcaugaucaggugguuccugauauaaacaaacacaggugacaugggucucacaggcagucuugcccaaaagauagacgagcaguugacaucuuccccucuaguuaauuuccaugcaagcagguuguaauauaagcucaaacuuagccacuauaagauaguagugaaaccgugggguccaauauuaugccaacauggagaaaauauguuccauacccauacaagagaacaggaauccuaggggguaaaauucaauuguaguaggccuuaauuguuugaucauauuuuugccugccuucccuaccucuaacaauauuggaaguaacaauauauugacaauugauaauuugucuaaaacuguccaguuuacuucacaauguguguuuguguuaauuuugaaaccacuuaagcuuauagaaaaguugcacauaacuguacaaagagcauaccuuucaacuauuuaagagcaacuggccgaucuauuguaccucuccucagauaauuuaucuugcauuuucuaugaggcaggacauuuuccugcauacucagaaaacauuagaacuuggauauuaacacauugcuaucaucuaauccacaaaccuacucaaauuuugccaacuguucuaauggaauacuucaagaaaacgaucuaguucagaaucagguguugcaguuagaggucaugucacucuagucuggaauaguucuucagucuuucuuugaccaucauggccuugacacuucugaagaguacaggucaguuauuuugguuugucugauguuucuucaugaccauaaaguuaagcacugauucaucauuuauugaugaugguagucuugaucauuugauuugagucgugucuaccaggcuucuccacuguaaagguacuauuuuacucuuucuaauuaauagauauuuugugaggagacacuuugaacuacauaguuuucaccucucauuaaacucccaaguuauuuauuuguuuauauuagaaugaauucauggaaucucauuuuauucaaacaguuauaauccacucaaauuguucccaauuuggccaguaggagccaggacuucuguguccuuuggacaugucuccuauuuuuuuuugagcacuuccuuguuuucugguacuacauguuccaggcuuaucuuguacugucuuccccagaucugaaauuagccauuuaucuaaggagcccacauuuccaucuauauuuauuuuuauauguuuauuucuaaaucuaucuauaucuauugaaaaccauguguggcagucaugaaaaugugccuccuggaucuccaacugcaggaaacauaauagacugacagcccagcugcugugcuuugaaaucaaucacugcuacuucagccaaggcuaugcuucccaccagcugcucccagccaauagcggagcgcaacagagauacuaaggcaggccuauugcugagggacauaggguuccucugacggacaauuuugacuucuuaucaagcuuugacgaaacucuuuggaacaggcccguagcucagauguucccuaucuaaccuuccuucauucccuccauucugcacagggguuugaccugcacugcagucuguuggcucuucccaggccuccugggguucccuucccaccuuccuugagaugaguuuucuccaauuaaucucuugcacaucuaauccuucuuggcacgugccucuuauagaaccugaaccaacauaccaugaguucacacaaauaccuaaaauuccaauccacugcuacaggguucauucuaguuuucuuccuuuccauauuuguauauaccuacucugacagugagaaaccuggcuuauccuuaguacuuucacugguaggguugauauuccuuaguguaaccaaucuuguaacacugaugucaccccucccaaguggacacucagucuuuaaugccuggcuauggagccaccuuccauguggauguuugcacccagguugaacucugauaccuuguaugagugaucauccuuaccuuccuauggggcucugacaccccaagccagacuagccuauacuuugugcaaaauacugugcuuggaacugggauauagagcaagaaaagcauggccccugcccucacaguguuuaucacucaccaaggaagauaaacaaugaaugaauaauugccauauauugugaugguguaucacauggggaacccaccaagaagagaacacaugugauucucauaugcauugcacguagugaaugcccaauggugaugguuguuaucauuucauguauuuuuacucuuguuaccgcuaagcaccagcaucacaacuguuccuccaggagaaaucuauaauuaggggauaagaagcuaagagaacauggcuuagaugcugagcuuuaaaggaaagagagaagaaaguuagugggcaggguguggagugauuugggaaucuaaggccucaggaacuccauauggcaggucuuaacugguuuguagacauuugcugauaggauaaagagggcagggacaaggaagaguagagaaagugcccuugguuuuucccggccaggcagguacucaguaauucuguguauugauuugagcagcauuaacugggguggaucauuaaacauuuguguuguuuuucuuuauauaucaaagcuuguuugugugaauuuuuccuugccugcucugccauucccacuuucuccuccaaaccccauguauuuacuguaaaaugucaaugcucaguaauucaaaaugcaguaacaaauauuucuuuguuuucuuggcauuuaaaacagccaggacaucucaaacuaucaaaaguggaguugucccccaugccacuccccagccuucuuacuagcucuuugauggguggagccucucuuguucccugcuagggccccuuagugacaaccuuaguuuaaauccucaccauguaucaacaucuacaucugcugauuugaggcuguugccuucuccaugcugccaaacacaacucugugauaaugacagcauuugccagcacgcuuauguggugacucaggagacaggguggccagcaaagcagccucuuugugggaguggauuuugagaagugcuaauuccguggcaguuuggagauauuaauaccgugcuggcaguagauaaacagacauccgaggggcauauaaugagaagauaaucagccacugcaucuuuuccuccuugcucuaccaacacauuuauuuuuucuucuuuaaaaaaaaaaaagcauguucuccuggguuuugacgaauagagcccuuaaauugcguaaacaugcacagauacugguugguucagcucccagcauccccacaguauaacuuucuaagaaccacugguguguuaggaguuaaccacauuuucaaacaauacucagucauagcauauggcacgguagccuauugcuuaccauagccucucccuaaagggcagcaaaccagaugguuugaguagggccuuugguguaauuaugacagacacaaagaaagacauaaccaccauucucccucaauaauaucaugcuucuuguuuuccaguauuugcuauaguuaauuauacuuaauuuuugaaaauuuguuuuugcaguuugauuguucauaacaaaguucccuuuccagguuggggaggaaccauucaaauauguaucauuaagugucugcauaucauuucccauucauccuucucuagcuaguagaugcaggccacauagaguggcaucucucauucccaagugugagcaauuuucuuauucuggcaaaaaaaaaaaaaaaaaaagauuuguugcauuugagaauuacuuugcauuagagucuaaccugagauuuuuuguagcucccauggaguauugcuccaaaacuggucaucucagauuuuauauuguuuacuuucuuuguuccccaucuugauuugcuuuuuucuuucuuuuuugagauagggccucauucuuuuacccaugcugcaguguaguggugugaucacagcucacagcaaccucaaacuccugauccuccucccucagcauuccaaguagcuggaacuacaggcaugcaccaccacacucggcuaauuuuuaaauuuuuauuauggagaugggggucucauuguguuguccaggcugcucacaaacuccugggcucaagugaucccagcgcccgggccucccaaaguguugggaucauaggcaugagccacagcacaaagaauuuccuuucuacuagaaugccucccuccugccugccucuucucucuucauucauagucuuaucuuuuccaagcccacuuuggguagaagaucuacucucaggaguucuuauaagagaaacacuucguuauguaaaaccaauguuucuaacguugccaaacuaaaagaagacauuuucugguuguucugucggcuagaaagauuuugagaaauuuaggucaugcuuuuauauguuccauuuuuuucucuaugugccuaauauuuuauagcagacuuuucuugagggcaguggcuuguuuauaacauucuguaaauagccuggugcaaugugggcuuuuuacagauuuuuuuuuuuuugcuaguuuuuaauauuuggauugauauagcaucugacuguacuaaccagaaaaaugcugagcuagggaacuuuguuauuuaaccuuuuauuuggauuucuagcuuagcaacucauaggucuugaaaccuuggcuucucucucccucugccagaaugcguuaagaccuccaggugcuaacuguuauuauuucuguugacugagccccauaugcacuucuagugcucacugaccuaucuuuucuguugcagaaacauugcugaggcucuugucagcaaaggucuagccacagugaucagauaccggcaggaugaugaccagagaucaucacacuacgaugaacugcuugcugcagaggccagguaagaccaaacauuacuaaacacauggggaacccacacccucacuuuuuucuuucccaguuuugugccuauaccugagcagaauguguuggaaaauaauaugcugagaaagcauguauuauuauucuagauuuuccccaugaaaagaaggacacacuuugaacuugcugucuaauuuuguuuaagugcacuuggucuuccauuuuaaaaaauauguaaaauagguauauauuagauaugaucucccuuuguagcuguauaaaagaaagcaugaaugagugcucuauaggagauauguuuaucaucauuccgggacuaacugugaagccgugcuuaugucuguaguacauuugccucuguuucuuaccuccaaaggccucuacuccuagccccucccguuuaccaccucuagaccuuuugucauguacaaaggaaagaaaacauuuauuaggaaaugaguuuuaguuucaaacacuucugacagcuggcaggagaccauuugagaagcccugugacauuuuacuuuuguccuucaucccuguggcugguugccccaaggacaugcaugcugcucagcaguauuucuggccauugucaucccucaaggcucuuacucagggagucuuuugucacuggguagugugguaguugagugauucccagacuuccugggaaacagagcaagaacugagcuacuuauugcugaacugacuuggauagcucagcagacugcuuggacucaaccaaaauauauccauuguuuaaacgugauuucagaggccugccucacucagcaguuuuuccauagccucuaggacccauuuaguucuaggaguuugguaauugucagguuauuuucuauaguuagaggaggaaugauucugggcacauguuaucuaaucucggcuucagauuuugucauugagaucacuucucuugcucuuuggcccauaacauugcccugauaugugacauuuaccucuaacaccgugucacauccugauggauagagcaucuguagaaugucacacagaaugucagccgagaaaucagucugucaggcugcuguggcuuuuggauucuuucuugugggcuuuucccaauagacccuguugaggaccucauucuuaaguacaaagaauccagugaaaauacucacaucuuugguuuuuuaaagcucauuaauggucauuuaaaauacguaguucgugauugguguuuucucauaaaccuccuuacuuucuucucucccuaccuauauuaucaguaagcaagacagucccaaagaacucaugaugagaaaugugaucaugauuucucaugaucuugguucuguuuuguuuuuuuuuuaauuuuuuuaauuuuacuuuuugugaguauauaacagauguauguauuuauggguuacauaagauguuuugauacaggcaugcaaugcguaauaaucacauuauguaaaaugggguaucuguccucucaaguauuuauccuucauguuacaaacaaucuaguuauacucuuuuaguuauuuugaaauguacaauuaaauuauuauugacuauagugacccugcuguguaaucaaauacuaggucuuauugauucuuucaagcuauuuuuuuuuuuguacccauuauccaucccuaccucuccuccaccuucucacuaccccucccagccuuugguaaccucucuacucuguguuuccaugaguucaauuguuuugauuuuuagaucucacauauaagucagaacaugcaguguuuuuucucucugugccuggcuuauuucacuuggcauuaugaccuccaguuccauccauguuguugcaaaugacaggaucucauucuuuuuuaauggcugaauaguacuccauuguguauaaguaccacaguuucuuuauccguucaucuguugauggacacuuagguuacuuccaaguuuuggcuguugugaacaggacuguagcaaacaugggaguacagauaucucuucgauauacuaauuucccuuuuuuaggcgguauauacccagcagugugauugcuggaucauaugguagcucuauuuuuaguuucuugaagauccuccaaacuuuuccccguagugguuguacuaauuuauauucccaccagcaguguacgagggcucccuuuucuccacauccuugccagaauuuauugccugucuuuuggauauaagccauuuuaacuggggugagaugauaccucauuguaguuuugauaugcauuucucugaugaucagugauguugagcaccuuuucacacgcccauuugcccuuuuuaugucuucuuuugagaaaugucuauucaaauauuuugccuauuauuuuaauuggauuauuagucuugguacuguuugaucauccagcuccaguaggaaauggaacaauuacuaaacuauccaugggauuugggggguugguccaugcugggcauauucagcccaaucugaugguaacuugaagaacagguuaugcauuuccagaguagcaggagcccucagcaauacaguggaauguauaguuauauuuuccaugcaggcuucacacugccaccagugaauauguuaauucugacaggcagguaagcauggaaauaauuugcagggcugcucuggaaagugaggccagaauaagcucucuuauuaugcuguuagaaauagccauguuuugcuauaauacuuaaugagcauucauagauagugaaauuuuuuaaguuuuagguuuuaaaaugaaaacagccuuuuuagucuagugcuuauuuugugcagaaguaauguaacaagaugcuugcuugcuaaggcagugagcugccuagagauaauuguguugagccauugcuuucagacugauggugagaaaauuggcuucagggucauugcacuguugcagguugaguaaacggagagaauuaaccacuucccuuugcccaugaggcauugccauaaggaaauacaggccccauaaagaauggggagaaauacucagcaugaacugugagugaauuuuuauuuggagcagucuugucagugagccccaggacucuaagccuggugccaucuucucgaugcuaacccccaggaaagugaagucagauucaagaaagaucagaaugcuugcuagauaggaauggugguuuuguagccauuaaaaaagauuuucagugcagaauccccauccucaugguuugguguuuuguuuugguggcugugguuguuuugagacagggcuuugcucuguguccaggcgggaaugcaguggcacaaucaugacucacugcagccucccuuucuugaaaaugguaaaguugaacacuuuucaagaccacuuauguccugacacuggcuuauuugaguuugccuuuaguuugaagcaccucguucuccuaugaacauuccccauguucccuuagcauucuucucaccucucucacguuacagcgugucagagcucuuucacugcugcuucugccccuuaucuggccagguauugaauauuaucugaguuuaggguuguuuuuuccuagauagauuagcuguauguuuucuaggugaacucugcuuugugauuuuaugccccugucaaugcauuuucucuaccucccagcuucguguccucugcagaucucauuagugaguuguuuacuccuuuucugggcccugaauaaaaccccuaaacaagaauggcuuugguguugaccccaagucucucacugcuugaacuaucacuuaacugucuuuuguuuaucauucuucagccacuuuuuaaucuucagcgauuguguacugaaccaagccaguuugaauuaauuucccaagcaaaauuucuuaagguacuguauuuaaugcuuuggcaaaagccaaauucauaacaucugccacauucauaucagucauucguucugacacucuuuagguaaauaauagacaggucagguggcaaggcaucauucugcucuguuccucccuaccaggguguugauuccaacagacuucuuugacccugguuauugcuggugauaucggcaguggugcagagugcucuucuguugacuuugcuuuccagugcacugcuuggccauuaguacuuucagagaaacauuguaagcuuuggggaaagggcagcccauuaaacuugucugacuuaggucagcacagcugccugccuagaaguugaugagcuuucucagggcucugcagccccuacuuccucugcaaagggauaugaucugccaaccuuucucauaucauuucaugggcgcucagggagugaugcgguaggcacucauugggagacuagaugagacagagggggaagaagaauaccaauuugcaguuugccuguugcuuucaagcauauccaccugccugcauagaaacaaacucuaccacaucagcagcucuguucaguucgcugacccuucagcgcuccuuuacucaggugccucucugcuucugggaaacccucauaaugucuuaaauacauggcccaucuagaggaagucacaucuuuuuuuguuuaaaggguaaauaaaccucacauucccaaaaggcggccuuucggccuucuggccuuccuuuccagcucuguugucuaucaucagcugaccccugccucauuaccuuauguccuagcaagauaagguuuuggcauuuucucauauacucucaggccuucuuuaucucauagacuucguugaaaagcccuugauguugucccacaguucugagaguuccaguguguguagccucuguuuuuugucccccccuccccaccccgaauuuaggugcagcugacccacaguucucugugacacuccugaacuuggucucccuuuuuagaagcaucauauggacuccuuagggagugugaaacauuauuucuguucugcauguuccuguuugauucccauauugacuuuccagcauuuccaguuccucuuuuuguuuuaguguuucucaguuagcuggccugcuacauaugccuagucuuggcgagccuuccaaacuuuaggcagagcuuuuaacuucuucagggaauauuccguauauccuucugcgguauuuccaagauagugagucauuaccgggacccuuuuuacuuucugaagugucauaaaaaucuuucauaugcucuauuuuauguauuugguguaacacauccaaguuuugauuuuggagaggccagaaugugaauuucgucaucaugcuagaugucuuccaaguggagcuuuuguugagcauguuauggacacugaauacaaguugguaauguuuagaguccgaucaaaacguggcugugugcuauguuuucuuuauacaugggggauaucaucuauguacaucuucugaugcuaccaguagcuuuauuuuaagaauuccuagaaauuguuagaaucuggcucuuugcaggaaaacacagaaguuauguuaguucagaaguuggggcuuuauuccuuuaagguaucuuuuaauucuaagauuugcaauuucaagaucggauguauauauucagaaaagaaauugaugcuccagccugacuguaggaaagcaauuguauugaacaaccuagugucugagcagauuuaaaugaauuuagauucagucuggucauacauaaugaaguuaggguuaucucaggagaagagaaaagggcaggcucucucuuaucuuuucauguguauucuauuucuugccuggcacacugcagauuuagaaaaccaugguggugucauccaucuuugagaggcaagugugaaccugcccucaucucagcaucgccuuggcuacuucucuuccugguccccugaaggacucauuuuucugauucagcaaacccucuuucuaaaaaacaaaaaacuagcacuccagccuugcuguguucuacaucuccaaucuccaaacuccaaaccccauaagcaccagucucuugcuuuuuuuagugagauuggcagugcccucauauuuuaggcuucuguguuugaaccuguaggaaaucugugcuggcauuucugucacagacuuuagucaaaaagcuauaaacauaucaauaacucuuucuuucuuaaaccaauaucccuggcuauuauuaagagggauucaguauuaauugcauaucucucuugguaacgcaguuaaugggggccacagugggcuuucuaaguuccauauguuuguagcagugacuuguaaauauauuuugcaauuccauugaaugaagagcuuccacugggaaggaaaugcucuuggucuuccacccuggacuuagcuagaggagcucucccuuuuuucugauuuauagggaaguuuuuccauaaaauuucaauaaauggaaaaaguaaugugugccuuaaaaaaaaaaaaaagaagaaagaaacuguugacugguccuucauaucugugucuucaguuuuacuagcauucacauacugguuaugaauggaaugugaagaguuacuugccaguauuuucuguugcuaaguuaaaagauagaauuuuaggacucugaaauggaagaggaguauauugguuugacacuauugugauuuguuaaauguuuugauaagaaaauuucauuucuauaccagucuguuuagacaguuggcauugaauuuauguguuuugaaacuuuaaaacugauauauccuaucacagaguguagauuaaauggguuaaucaguucuccaagaaagcauaucuuuccucugucagaaacaguggucaaggcuggucuguguugcaugugauggcuuugcauucauuucuucucuuuauuccuuuuuuuuuuuuuuucuuuuaaguguauccuggcuuccaggcaugggcgauaauagcggugaacaaaaaagauaauagacucaacccuuuacaaagcaugcaaucucagagggacaggcauuaaauaauuuuauuaguacugcuggauauugcuguuuuuccuauuucuucucuuuucuuaccuguuuucuuagcccucccucuuuccucccucuuuauuuuugacacugcuugccuuacaucuuuuuuaugccaucucucauuucuauuaaauuguccugugagaguauauuccugaaauucaucuucucuguccagccucuguucuuaucuucucaacaguuuaaugguauggcuuuuaaauaaaccaugauuucucaccuucaaucuaaugaccucaacaagggaaaauucuuuuugaauaaaaguagaaccuauugaauauggugaaaaacagagcucuuacuugaaguuuaaugguagauuccuguaacaccaggguacuguuggauuuuuagcucaagcaucauaggaagcgguaguucggugccuuacgacugcccucuucacccucugcauuacaucaugccaguacagguugaaagccagcacagaggaggagacuggccuuucucuuaaauguccuaauggcuuccguucuuuuuuaacuuuggaaaugcacaccccacccuacauuuugggguugcaguuaagugucacgaucaugagguugcuaacuggauucagcacgugucauuaugugucuguggaggguuucgcuguuggggaguagggaagauaaguuuuugcaaguggaugugauaacaggaaaaugcauuaaaagagcugguguugggaagugauuugacgaugcagcugaacguggggaaauuuagcuuuucccuuucuucagaaaagaugaugcacucaacauccaaauagcaguaaucaaucugcauuuaaggcagcacaaauggccacuucuggagagcuguaugaugucuccauuuccaaauaguuuucuccuucaggauauuaagaggaucuguucacucccuccaucccauccuucucuucccuccccaccccuaguuccuucugacauaacucaugcugugagacuuuucuuuaugauucaugaggggcugggguauagcugacgcccuuuagcuuuaucuccugucuugacuagcaagccguggguaguccugcagaucauggguggaugauuaacugcuggaaagcaguccuccuuggcucuguucuguaaucauuagucuacacugguuguauuccuucagagaggacauuguucuaggcuaaacuuccuacaugaauuagccaucaaugugucuucccccacccccauccgccaaaauagguucagcuaugaccacuuaucuguccagagccacuugucuauuuucuuccgucucacucuccucuuggcuaagaggcucuugcuucuuucacacaacccaaaauauuugauauguugggagguucuuguacugggaauauaauuucaauccaaaauaaauuguaacuauaaagugauaacacuugacccuugacuuucuugaaugucuuacaacuugcuucccuaaaccaguggcucucagaccaggcacaucacuaucgcucggaaacuuguuagaaaugugaauucucagcacccugcccccugcagucuaacacauucuuuaggugauucugaugcacacuaaaauuugagaagcacugcccuaaucaguuccugaucauuguaaaacaaaucaaaguguaugcccuuucauggaagauugaucauuuaaucuucauuguaauuggaauuacagucgugguuauaaguaacagagaacaaggcauggaauggaugagcuuuggauuucuauaguaugucccagcucuuuauuccccuugacuccugucucuuucccccuuccucagacucugaguucauggcuccuuaauucgauuccuucugaauagccuccaccagcucuuggcuaauuuaaugugaaaucaucucgaguguuacagugcuugcuugcuuuggcucaucugcagcgucagguggcugaguggauuggagagcugagucucuauuaggcauaucccuaucaugcuucugcucuaauccuuagaagucucucaggaggacuauaguucaaauaauuaaucacugauacaucaaugcacagaauuuuguagcugauugugaacgggaaauccgcuucauagcuucuuucauuugcaggauucuuuacaucuaaauuucuuguaaacuuccuugugcauuucuguuuuauccuaagcugcuucugacucugccucccgccagcacccuccaacuuugggcccagaaguugagaagaauuacuucccauugcucuugcuuuugcaucaaggccagagagccaaaucucugggcuauggcaaugaauuuuuuccaguaagucagaauaaauauagcucacauuggaaaaccauuuuccaaacugaacauugucacagaauuguugcuuuucacucagucaaaagacacauuaaaguuuucuguaacugauguguuuguguuauguaacaaguauuuuaucagguauuuuggggguaaaaacaaaaacacaggaucuaguggugauuucagugaacaaguaaauaauuacaaauauaguuacaaaaauggagaauauauguggguaguugggauucauagggaaaggagcacccagauugauggguuauccaccaauagaguccacaagagaaggcauguucuguuugguuugccuugguaaagggagauggaaagcaaaugccaauuucuugcccuaugacagcaguuccuuauccuaaggaaguaauuggcaaggugcuuagaaguuauuccucauggcauuaucuauaguaguagaacuauucacauaaauaucuagcaacaggggauugauuaaaauuuugaaccauacauccauauaugauggauuuccugugcaccuauuaaaagugguacuuaaacgguguuuuuuuucuugaaauaggauuaugagucauuguuuccugaaauuuuuuucugaugaacuuuguaaucagaacagcaaaaacuauaaaaucagugucauugaggcaguuuugaguaaucuaccuuccugaggcccuauccucucaagaagacuuuagacugcucauaaccacuacuacccagcucuaauaauccuuugauccuaaucugggauaguagaguuugcaacuguguuccccucaucucuagcauugaguugguuguucucugccuuggaguucauaaucccuuuccucccccuuaccugccacuguagauccauugucauacccagcacaauagcauguaucuucauuccuuccuuauauuagcuuuagacgagaugaugaccuagaguucuuuguuauuugcuucacugccucauaauaccuacugacucauuaguccgcccaccuccccuugacuguaggacucaauuuccucauuuccagucuaugcacucucaaucuuuucugucuuucucaucgguaauucucaauuacauugaaaaugcagcugcauaaucuuagugcccccaccuaccauucugcaccugcuccugcucuguaucuuauuuucugaguggugccacccugucgcuuccuccagcucccaaguaaccaggagaaaggccgaaggaauuguuuauugcuaccauguuucacugaugucuguauuugguucaugcugaaaaaccauauuccucaaugugaccugaaacacaaugagaagugcuucggaaguuuaccaaguuuuuuacucuuuguucugcuuuucaaccuuuucuguuggaauuaauuuuucuuccuacugagucauuuuuccuugauuauuuaauagguguuccuuacaauccugcuacuugguucuguuuuauuguuuacaguggucaagcuuugcucccacucacugccacuuagauucuugcccaucucuuguaguuccaggagacuugaugugggaugugaugcuuuuguucuggaugcuccucugcuucuguuucugcucagaggccagucuuuagcugcuucugcccuggagcauagaucaugaaacuguguaucugggaaagccaacaaaccucauuuuuuugcccuacagucacuuuggcauugucacugucuccaauuugaaauauuuucacuguuccgcauuaaucagucaguuaccaagcauuuguucagcuuuacuuggcacacuuuaauugaacuagauggcccugaauuuauaauuauggaaagauagcugucuguuaaaauacuauaauaaagauuaagggcagaauacuaacccucaagggaccuguagucuagauacagaaauaaagauuaacacaugaaacaauuugaaagucauauguugcaguuuauaauuacaugcugaacugagugauaccugcacacaacacacacacacacacacacacauuauacuaccauuucaaaggaguucaccuaggaccccagguuaaaaauuucuguucucccaacuauuuuacgauuguagugagguuguggcuacagauaggugauacucuuuucauuguaguguugaccuagaacaacaaguggaaucaaggggaaagcaaaagcccaggggacacacauaauuaauuacuggcauguagggggcaugaagaaaaugggccuaauuggauuaggaguaauguggaaaucauguggauauguaaacuggggccacauggucgagacccaugaaagccaagucugagaauuuccacuugauuucacaagcugguugguugucuuuguuuggaguauaaguaggggaggaaaaugaugaugucgauuuuuauugagaagugaugugggaguggugugcaauauucagucaaaguguguguagcuucaaaagggauugcaugaauuuaguuaagauaucccugauguuaucuugaaauaaauuggugagggccuagaccaagaggguuccaaaagggccaagugagcacaauuaugaaagaagaauguuggauguugggguaaagcaaaagcagagugaagagacaucauggaggcugcuuaccaggaaagcauuguuaaaaggaaguuacagaugaggagacguguucagggguccuaaucucucucagcucuguagccuccuuuccccgucaucucccugccaccuauugcaugccauuucugcuuucugucauuuuauuuucuuuagaucucuuucauguaugaaaguaguucuuuuuguaaaacucuguugaaagcuccugcucccucagaaaauucacagauacuuuaggguggaucagagauauuucuagcaucugagcugacgugcacuauguccccagguuaagaauuccugaugugauaacuauuuuaugauugugauaagguuggaucuagccauaaauccuuugaauuucuuuguaagcucacaaaaauauuuguucagaauaacaaucuacugucguugaauuggcaguaagauggaggccuguuuguuggcacgggagggacugugacugcggugcucagacauccagcuuggagagcauuggucuugagauuuucuggaugaacuagagacugcaaaccuaagagcagacucuuccuuggcaugaaaugugugcagauucuaaucuugugcugaggccauggagaugaucucccugcaaaaauguugucugccuuugcaaaguuguagguuuuuucuucuagaggaaaagcagcagcuaauaugugagaguuucgagcuuugcuguuuaaagaaagcagaguuuuccaguggucugaauagaguucaucuucccacacuguaguaccauacagcccuguggcuccuagaaacaaccuagaaagcuguguuuucaucuuucuguugcccugccacuccuuggcauguguguggauauauacuuucuuucccugacuggugaugauguuugucaguuauugacacugguagucuuugcugucuuuguacugcugcaucuuggagaagaaagcugcugagaggaguaggcuauguucugccccacuguuuccuuucugcuggcuggccugcacacuagccugccuuugugaggaagcggcuguuaagcagacacagcaggagaaguuuagaagucaggaguuucauuccuugccuaaugaaaagggaugcagacuuguggcugaggccaacagggaaaggcaguauggggagcaggaauuaguguuugcucuguggagcagauaagguggaagccagccugcggucugccuaccuucccaugucucaaagacagagcuccacaaaucuaucccagagaaacuggguuaugugagaugcagaggagaaccccacugagaagugguagcaaggcaguacaccuuguuuucagcagagccugggucuccaugucauguauccucauagccuggaauaaagaugguacucucccuuugcagauagugguggcaggccuccccucuuggaauuugcuccucuccucugugagauucauuccugaauuccuacuucccccagauacucuuucguggagaaucucuugcuguggcaucagacuugugacaagcagagggagguuuucuggaaauggcucacucagcaucguuccugcagcagugugggaaccagaagugaagaagccucugcacagggaaaggagaccugugcugccgcagguuauucugcucuuuucucacagaucccucccacuuugcagccugggucuagugugcuacuaagaggcuagagugcuuccugggugggcauauuugaauuuagugguuaacuaccuauuguuaacuuugaauuuugcuucucuuucaugaagaauuaacaaaauaagggcuacuucucaguuuacauaugcugguacagugcuacuuucuugcuuccucuugaaugugccagaaauugauaagaguuuaacaguaauauuuuaagugugaaaaaauugucuuugaacguuuucccaaaauuuaugccagaacacaaauaaguaucugauaauaugcuuuuuagaagcaggguagagcaugaauaauauuaauacuaagaccauuuuaaagaaucauuuugcuguuauuguuuuaaaugucauauguauacuauuauccacgucuuccaguuucugauguuaguuuuuuccucuuugguagcguauuuaguugugguuaaguccuagauuucugcuuauagcacagagcuacuuuguggucacagaaagaaagcagaauuauaguuucccaccucacugcuuuugccucgaggaucuuugcuuucuaacuuacugcucaggcccuguucuuuuuuucucauaguacaugagauguucuccagccccaggaaaggccacaauuucagcagugcucuaacuugaaccugucuguuuacagaacagaucuauuuauuuugguuguccuuguuguuaaaggauaaggcuguaggcauuuagugccccauaggaccugcagaaugcuuugcaggccuugccuugaaggaggugagguauggucagggugggaaggagcuugucuugcaucacagaagcuucagucuuacggcugcuccuuccaauuugcaguagcaaaauaaggagagccuguugguggcagaggagguuauagaaauaggacaugcaagauguaagcagggcuuuggggagguggaagaguuggauuguuaguuggcuucuagccaccaaccucuagucuuuuacugguagcuugcaaaucccaaagggugaguggcaaagcuugagaaucgccuugguugcugaccacuaccaggaucccugaaugauaaaucacuagaggaaauuguaaagggaaauauuuuuacccauuuacaauuucuuuuacuuuuuuuuuuugagacaaagucuugcucuuucgcccagguuagagugcaguggagugaucuuggcucacugcaaccuccaccuccugaguucaagcaguucugccucagccucccaaguagcuaggauuacaggugugugccaccacaccuggcugauuuauuuuauuuuauuuuuuuuugagauggagucucucucgcccaggcuggagugcaguugcgcaaucuuggcucacugcaaccuccaccucccggguucaaggaauucuccugccucagccucccgaguagcugggauuccagguaccugccaccacacccagcuaauuuuuuuguauuuuuaguagagacaggguuucaccauauuggccaggcuggucucaaacuccugaccuugugaucuaccuuccucggccucccaaagugcugagauuacaggcuugagcccccacacccagcccgauuuuuuuuuauuuuauuuuuuguagggacaggguuucgcauauuggccagacuggucucgaacuccugaccucaagugaucugcccgccuuggcuucccaaaguacugggauuacaggugugaaccacugcacccggccccauuugccauuucuaaagcugaagcccuugauucaaauucagaagaagccacgggauucaaggagcuuggaagugcugucuuucaguuagcauuucagauaagagugagagagaggguaugauuuuuauuuucuuguuaauucaguacuugcccucaucaaggaguagaaacuagauaguaggaaaacuuuuguuguuucugaaccagaagcauuucagaugaguugagugagggacacauccccugggaugaagcaagggggcucagguggaugauaaaagcccaagugugaaagaaauaagacuauucuaccuagcacugagcaaaacccacccaauuuggcuuaugaggguuuacuuuagaaagugaugacccugaaaguaaccccugcagaaguguguccucuaccucugcuccuugagugaguuccugaaagggaagagguggaaauguggcugacagugugagggucccugacauuuggcccugggcugggcagcuuucucaacacuuccucuggaauucaaaaacccuaaaaaguugagucuccauagacaagauuugugggaacauccccuaaucucuaguucucuaucucuaagcucagaacucuuaccugcugaugucugcaggcuggcaguacacaagaaggccuuauccaacaguguacagaccaaguaauucaccagucagcuuuuauucugugguccuucauuguuauaccagugaucguaccuagugaggcguaggcuucuguccccagagcuaccacucagaggacugggugauuagagcaaaccaacccauggcugagguuggcagagucccagaguucccuguuaaauccccucuuauuauagcuaagacugauugaaaaugagacuuaaugucaguuauguagcauuugcuaauuuuuuuuccuacuguuacaugacuuuucucuacaguauugcuccauucagggcaacuuaucuuuuuaccugggaggaacuuauuuccauuagaauuggaacacuagccacauauuuugcauuuaaaauguuucaugugauuaaacacggaaagaaauguuauuacuucuguuucuuaggccugugcuccucuaacugauucuucuuuugugccuggaacaaugccuuuaauuugaaaacaaguaaggcagcccucugauuacuaagcacacuguuaguggaaacuggcagccaagugcugguaacagggcuuaagagaagagcagcuuuauaauccccccuccaccaaauccucuugcacagacuggcuacucagcaguguacagugugacuuguguagucauacauccccacuuuaacaacccucgcuucucucuucauuuuugcacccuccuaccccuucccauugugauucuuguuuuaaucgguuuuucucuucuuccuuaacagagcuauuaagaauggcaaaggauugcauagcaagaaggaagugccuauccaccguguugcagauauaucuggggugagucgagucccugaaucaagcuguguggcucagaggcucaagagcgugucugcauauuugcugaaggacuucagcuuauguauuuucucuagcucgcuccuuuucaggcacugacugugacuuuuccccaccccggggcaucuacuuagguaucuauagggagccuguuuuauuaucuggaaaagcagaauuaacuucauucuuuuucuuuaccugaacuguuucuauguugcuuuuucauuuuuaauuacuguauuuugaguuuggaagguaguucuucuugguuguauuaaaauaaaauugccucuuuuuaaaaccccuguccaguucuugcugugagugggaagucuuaguagcaaaaggucaaguauagauuucaggagaaguauaugaauucaucaugauuuccucaugaccucuuguuccucugcuugccuguaagugggacagaauggagaaauguaugaacauccuuugagauaauuacauauagauaauaaagaagaaucaauggcaccaauauuuuagagcucccaauaggcuguguccaaauguuucuuuaacuguaaggacuuuaccuuugaauguuuagggucucuuuggcugcauagauccguuugauaguugagcuaguuuauucauuuagucaacaaguauuuguugagugccugcuguaugccaggaauugcucuaagcucugagaauauaacaaugaagaaaacuacugaagucccugcauucaaguuggaaagggaggcaguugcaaugucagguagcgaaaacuacugugaagagaaguaaaacuggccgaggggauagugagugguguaagugcugauuuugaucagguggccaggaaaggcacucucuguugccaagacacauaccauccauuucaacaccacagucacuaaugguuaaagagaggaucaggucugugccaugcauagggaagaugcccaggggagaugaagcccaggguagauggaaggaggaagagcugguaaaucuuagcuuaggcacucagggaauuugccuugggcccugagaagaaaauacuaguauaaacaaaagugcuagagcucagccuaggcugcaggagagaugaaucagaguguauuaucuuccuguuauguggugugcccaggccugguggaggcuuuuucuguugcuccuggugauugcuugcuacaaaugugucuggcaggcucccccuugccuagguguagugguuuccugcucaucuuaaacaaugggacucuguugagcuuuucuuucucuauaaccagucacugcagauuauagguuaaacaauguuaccuacaacauguuaacuggacuucagucuacagguuggggccucuguuaagugggugaaguaaagugauaugcacuuuuuguggcuuagaauccugagaagcccagaaaccuguagcuaauggccuuugagccacagguaacuaugguguaucugcuaauguucauuuuuaacagguguaacucauccagugcgauguuacuuggccuguuuucuguguagcuuacccagcugaguuauucuuugcauauauauugcuaauauuuuuauguaugugcauggcauucucaacaaugcuuuccuuaauauuugucuuuugguaaagcuguuauaguaauaaaagggcaaauuuuuggugguuccucagcaggagaaaaaaguuauaagugcuuuggaaaaugcaaugaaaacccgucuacacaaagggccaaauaugcccauccaaaaacuuauguggggcccauacuccagggccuuccagaagcugauuucaaccuuagggauaggcucucuccuugggcccaccugaguucauuucuaguucugauuuggcaccaacagugaggugaagcaacucuaaggagguuuugagguucaggcacaccagucucaggguuguccucuccacaccccucagugugguauccuaaagaucuuuauugcugucucugaaucuuaugcugccuccugccuugaugauuucugaugcuuuuuuuauuccuuuauuuccguugucauuagcagugggucuugugaaacuugucuucauuuauuuauuuacuuuuguuccuaccccaccaauucccccuuaaacucuagcucaguuucauaccaauuuuuauuaucuuuucugucucaguauuggaggauugguuugcucuuaaguuaaacauaaaugccaauuaaauuucucucagucaccacauaaauaaaagaguaaagcuugagcaagugggagacugaaagugaaaaagcugcucgauuuaaauggaugucagauaugaccuugucugccugaaucacaaauuauucaccuaagagugcaguuuuuuuggugcccucuuuaauagaggaguuuugucuuuucccaccuucuucccuucuuuccaucacaguguuaagucuguguguauguugggugcccuuguucaauuuaagugagauguauggguuuucugcuuccugaagcaugcuggcaauuuugcugucugugggacaggugugaggucagaugggcagacggcuuacagccagaugaaaaauaaacagggaaaaagacaauguaaugcacauauacguaaugguuucacagagguuucuuaauuguuuuuuaaucuuuaacuguguuaccuacugccccagauugaucccccucuuaguugcaggccaugauaaauggagguuuuuguugagcugacaguguaggcaauaucugccaaaauaauuuacaaugaacugguguuugugcauaauaucucucaccacccuccucuccaucccaguacacauuguuggugaggaaaaagacaugcuuaagugcacauucugucuccuaaacacucuuaagaaauguguuguauggaagagauuauaucauaaugguggagcaaauaaccuguaauuuuguucuaguguuaacugccuccauuuuagggguugaguuucuacuccuuuuccaugaucucuucucuugcuguuuaaaaaaugauuucacagaguaaaggucagagugcguuaaaaugcuuuuguaugaagaccuagcaaauacaagaccugcuuggcugauugcuuaugguuggaagugacucaucuaagcacaggagugugagguuuauggcuuagaacguaagauaccagccucuguaguggccaaauaagccggccuuuuuguuuguuauuacagauggguuuugaugucaaggucaacugaguuuugaguuguccauaagauggacagaacaucugcauauaacaccaacugaaugaacccccaguuugucuagggcuuugauaaaaaauuuggcccucuagaccgggcgugguggcucacaccuauaaucccagcacuuugggaggccgaggugggaggauugcuuaaggucaggaaugcaagaccaacuuggucuuguagucaguguagugagaccccaucucuaccaaaaaaaaaauaauaauaaaugugugugugugugugugugugugugugugugugugugugugcgugcguguugacccaucugcgucucuuacaccuauuuuuaggguaaccacuaaaggaagaaaauuacauacucccaagcugguaccuuagauccugaagaaguuacugguuuuuuguuauuuccaauuuuucacagaguaggaacugggcuauuagaaguaccagccacugcugccauuucuaucauagucuaguuuccuuucaagccaggguguuccagaguguguagaaccagcugagaauuugaccgacuugguacuaggucuuacuugauuugaaggaugguucuguggugacugacuucauacauacauguuuucauuauuaguugguuuuguuuuucauugauccugucugagcucccucccucaccagcauagaaaaaauuggaguaugugugucaguguucuuuaucucagguuucucagcuguucuuuaucuuagguuuauuauuguuuuugcuguagccugcuccguaauaaauacaaucuccugcagauacagaguguaaaacaggcaauaaaauggggcugguacauggcuuacuguuguucugguagaucagacaaaucaauuaugguucugagauuagagagagcuccccacuccucaaguugcagccagcccugcgagugcugauuuuaccauuuaccuuuaccuccacuucuccaucuuccucuuauaugggaguaggacucaaugagucauaguguauaucugaguuuucuucucuguccuuuuccuuuugugucuguccucugugcaugaggaguuacgauguuuguuugaugguacaagaagauagcauccucuucagucuuauuucugaaagucccagaauagggauugucuucuuuugaauauauucugccauuucauauuauguaguccugacagcuccucuguuaauuucacuauuacaguauuuacucucuuaauccaugggucuuuuuaaucuguuaacugcugcugugcuccuuuggacguuuaaucacaucauggcuugguuucaugcucaugucacauagcacuuuuuuauaaccaccuuucuccgugacugauuuuguuagaaauacguaguauuucugauuuuuuuuuuuuuuuuaaggauacggagucucacuuuaucaccaaggcuggacugaaaguacaguggcacagucauagcucacuguggccuuucacuccugggcucaagugauccuccugacucagccuccugaguaacugggucuacaggugcacaccaucacacccacaggaucuugcuauguuguccaggccaaucugaaaccccuggccucaagugauccucccacuuuggccucccaaaguauugcuauuauaggcaugagccaccacccuagccuaaaaauuaagccaugguuuggaaugauccagugacuagcuuuggggaaggugcagggcacaggggaagaaggucagacauuuggggcccuguuauucaugaaacgaagucuuacagaguugaccaguaggauucugacuugcuaaugugaaggauugaaguguuccuuuaaaacaguuagauaagauuaaaucaauagauaagaaauagauugguagacaggguuggauuuucuccagcaucugcuccugaccucugccuucaguuucugguuuucauugcccucuuaaacuuuaauagcacugucauccuuucuuugagguuucuguagguguuaccuuuccuuagcucuuuauuaauauuuaggccuugauggaagcauaagaaaaaaauuauuacucuuuuuggcuaaagagaguuuuaaaaagcccaggcacgguggcucacgccuguaaucccagcacuuugggaggcugaggugggcggaucuccugaggucaggaguucaagaccagccuggccaacauggcaaaaccccaucucuacuaaaaaauaccaaaaaaauuagccaggcguggucgcgggcaccuguaaucccagcuacuugggaggcugaggcagggagaauugcuugaaccugggaggcagagguugcagugagcuaagauagcaucacugcauuccagccugggugacagagugagacuccaucucaaaaaaaaagagagaauuaaaaaaagaaaaaagugguuugccugguaagucugaagaagguaaaaggagcaaaaucacccaggggcuuuaugaguuaggucuguguuaaauugcaguuuuucuuauauguuuucuggcccaccuaguuuagauuuauuuuucuuacccucauaugauucuaauguuccuuucagcuuucuguuuuuucuagucucugguauuugauggcacaaaugcucucugaguguauuuguuuuuuguuguuuuaaauagcccuucccuuuuuuaccccacuuggcuaaaaucauggcccuacaucauguucucacgucucucuugccaacugcagucuaaguuauuguacagauggcacaacaucaaggccuaugguucugccggguggguuucugugaccuggagggguugccuagcacuggagcuucauucacacaguagcugcuggcuccacugcugggcucugcauuugguauccgagaaaaucccaaaggaacucuggaagagccagcucacugucugcagaacuugcucuccagagcaggcaguguguccucucuaaauaugguuggccccuugccuggaagccaugguuggugggaguguuggguuauccugguggcuuccuugccucccuguuguguuucguagcucaaguugucacuaauuuaggaaaagcuauugcucuauuucuuucuucuucuuucuucaagcaaaguuuauugaacucuaguuggacuacaauguacaggugacuggcuuggauccucacugcacagaaacaugccaucaccucuguggcacacaaccucugaugccaaaguggcagccaccucguaaguuucucccagacuuuggaaaaaacuucaaacucuuucucuuucuuuucuuuucucuuauauuuucaauuuaauuuuuuauuucaaaaaaauagagauggggucucacuuuguuguccaggcuuggucucaaacuccugggcucaagugauccucccaccucagccuuccaaagugcugggauugcaggagugagcuaccauggcuggccucuuuucucucucucuuucucucuuuuguugagauggagucucccucuguugcccaggcuggagugcaguggcgccaucucagcucacugcaaccucugccucccagguucaagcaauucuccugccucagccuccugaguagcugggauuacagcuaguuuuuguauuuuuaguagagacgggguuucaccauguuggucaggcuggucuugaacuccugaccucaugaucugcccaccuuggccucccaaagugcuaggauuacaggcaugagccacugcauccggcccucuuuuuucuuuucaccucuucuaaagcaugucucugcuaagaguuggauguuacuaagaagaccuugaucuugauucugccagagaguugcuucagccaguugcccucacccuuaugauggaagacauagcuuuauuguguuggaguuuuuuuguacaugguuuguuucucucucucuuucuuuuauuucuuuuuuaagaugagaucuuacuauguugcucaggcuggacucgaacuccugggcucaagagauccuccugccucaaccucccaaguaacugggacuuacaggcauaagccacaacaccuggcugucuauaguuucuuuguucauaugacaaagugguucugugcaaccacuuucuguuuuuugaaacuccccuauucaaauuugccagaacuacagggccaucccucucuuaaauaaauuugaaagcauuuuugauuuacaugggaauuuuuuucaaaauuucauugcagcagguaccacaguuaaugaugguuguguuucauuaccuccuuuuguagaucuuaguccacuuuuugacugaguuguguuguuuuuggagggcacccaauuuaggacaugguuucucacuucucuuauuuagcuucauuuaguugggcuguuuugcaucuuuguaaauagagauguagaaauguaguccugaagagauacaauugauucccacccuguaagagaaaugauuucaaacuuuacauuuuuacucccuaguuugacucuguuuuugcgucuguagcaaauucaccucaguauuccuaguaacuuaucuauaucuguucuuuagucucuuugagccuuucugguucccucauuaauuagugggguuaaaaugaaauuuucuacaugaguuuauuuuauauuugaauaagagucaagacuuuaccuuauugaaaauuaucuuuuaacaggggaaacaauuguagaagcaagagaaauacaaaaccacauauauagugggcaauaaaggauuauagaauuauaugcuuugaaaaucuuaguuuuguugccuccucuguaccuggaaacaugaacaauaauuugguugugaaaguucuaaaaaaaagaaaaauuuagaaagugaauaugucucuuucaucugcaucaugucugguuccaagucuguaccuuacuugguuuaacuuuuuauucagaacagucuugucuuggaaaauucaggcaccagagcagauaaccuugagguagggagcuaggauuggacuuugaaagcagggcacagcuucuuguccuuugauaugaguguccuagcucugcaauucaacaccucagaaaauguuugcucaggugagcugcccagagguggagcacuguuaagagacagggcuucuuuauuuguucguucuuauauaacaaaaacaucuuccucccaguauaaucaguagcaugucacugucguggauucuauuaucaggaaacuuucugccauaaauuuuucuaguuuccuucugcuuccuuguuuaacugugccuucacaaacaggagugcaugcaaaugcacucagcauuugcaacaggguccuagcuuuuagugaaguguacugagcuauaaugauuuuugccuuucuucuuuguucaaagacaugagaaaggaaauugagggaguuaggaacauuuuuuccaaauaaaguagcauauuuuuccaaagagaguuccucuggccauagauuuggcuauagcugguccaugcucuucgguuguucucuuucccauucucuggguguauguagauaacacucuaugauucuauuucaugggucaaaauagguuaaaugagcccauuacagggaugauuguaaguauauuuuggcagcaguugacaaaauuucagauucccagguugaggugugugauuggauugucugaucugucccauggcugcugagugaugugauaaaauuugaaauauuucugcauagccccagauucacucuccacuuuaccaucauaacacuacuuagccuuggauugaacucauuguguccuguggcuauugcuuauauaaacauuucaaaguaaguaauuucacuaacauagacauucugcuuacuuguauuuuaagucuuuauuuagcaugcuuacaacauauucccuacagacuaugucguacagaauuuuggacacuccuugcaguguuaacauccagauauuuugaaauuagagcucaggguugcuuugaaaugcccuggucguuuucugccucaguuguucagcaaaugguguucucaggaagaaauuauagaauuccuaauacaguaucgaauuuggaaggggccugaaaauguaagcuauuacccagauuucuaaauuggaggaagaccuguguuauauugauuuguauuacugcaacauccccagauacuucacccgcaguagagcccauuuauuuucuuuagaucauauucaucuccuccacuacuuaagguccucaguugacugacucggacuucauuguuaauuagcauuuguugaaucacauuucuucuuuuugcaaugcugucucuucuccccugcuggccaugccuucuucccuggcauaugucucuucuuccagguaauuucucccuuuuuauccccauugccuucugaucaugcccuucuucaacauuuacauaaucauauuaccaugauuuugugcuuguugauaaauugauaauuucauaaguuguuuaauaugugugcauugguuuuccuuacuaguuucuaaacuccuaagaaggggaucuuuuuguaucucauuauagugcccaguuuacauucaguuugccaagugaugggcucaaacagcaugaacuuguauuuggagaaaagugccccauccuccaagguacaggauuggcuguacugguuaguaacuauaagcgggcugguuaguaaaagaacgcagcagaaagggugcaugucuucuagaauauaguggcaguauggggucaugauuauuagcacuggcucuaacauuagauuacugggguucaguugugccuccauugcuuauuaccuugacgccuuggggaaguuauuuuuucuuucuguaccucaguuuuccccugugggaaauggguaugauaauggcacuuaccucauuggauuguggugugauugaaugaauuaauaaauguagcuguuuuaaacaguugacguaagagcucaacagagagcagugguucacaugccgguguucauuauuuuuuuuugagacaggaucucagcucuauuucccaggcuggagugcaguggcgcaaucucagcucacugcaaccucugccucccaggcucaggugauccuccugcauuagccuccugaguagcuaacuacauguguaccacuacgccaggcuaauuuuuuauuuuuuuguagagaugggguuuugccauguugcccaugaugaucucgaacuccugggcucaagcgcgagccacugcacccagccugguguucauuauuauuaaauugcuuagcagucugccuagcacacagaaaguccucuguaaaugagagcugucauuaucauccucaguaauauuuacauugcaaacucuucauccaguucagguuccaaauccuaccgcucccucuccugaguucuuuuacugccucuuuaucucuuuuuugacauuuaacauaugccaucucugucuuguuuuuuaaaugcauuccucauguugaaucagugaaugaaugaucaaacaauaaguauuuaucaagagcuuuucauaugccagcaagaaugcugaguguugagaauauauuaaacaagacagcuauagucuuuacagggaauacacaauuuguuauauaauuacaauuguaaugggaguacagaguccugggagaguguauacugguggccacagcuuauucuaaguggucugauaaaguccuugaagugauuucaaagugagacccaaagaaggaguuagcagaagaucuuguucagggccaaaggauaaaauguuguauacaaagguccugagguggaagauuguuuguguucacaauggaagaccagucagcauugcugcaaugugaggauaguaaugggagaaugaauaacugaauaauuuggacguuauaguccuugaaaaggauuuugaauuuuaucugaagaacagugagaaaucuuugaaaugggaguagaauaauuagaacagcauauguguguguguguguguguguguguguguguguguguuuauguguguauauguauacauauauauauagagagagagagaguuagcuagguauauaucuauuaauuuuucuuuuuuuccauuguggcuuuuauuuggagauagacuugaaacaaugguuaggggagaauuugcaguucaccuggugauugcugaauaguggcuggaacuaggauuguggcaauggaggcggaaagauaaaugugagaucuauuuugguauaagaacugguagaacugagugguugauuggauuggggucaaggaagggaagugaaaucaagugucaugcaugagcuuuccaaaugucuggcacaaauaucugguugaugguggugcuccuugucugauauuguaaaugauggcagaguagauuugcaaggaaaauuaagacuuucugaacauguuaaaauugaggcacuaaugagccauuagugaccuaggcuucaugcaugaguuuaggacuauaggacaccuagaugugaguguaccaaauuguccagagaauauuaagagagaagagucccuagaccaagcccuuuauuucaagauuacguauggauggggaguguuugaacaaacagacuuuaaaacguugccgcccaagcugucggagauaaaucaggugaguauaauguacaaauuaauagagagagcuucacaaggcaagaauugagucuccagcuucaagguaaaguaagaugaaauugaaaacuauccaguggacagugcaauuccaugaguuacuggugaccauagagcaguauuuguggaaugaaggaaagcaggggggcagcaaaagcuagauaucuucccaccugaguugucagcagaaacugugucuuaucucuagaucuguaguuuuuaggaguuucguaacaauaggaaaugcauacauguacauaaugauggcgucuauguaguuuugaaugagugaggaaucuugagggcauccaucagcaagugugcacugauggagaaagaaaugacaaugaugugagauccuuaacugaacaaacuaacuuauguuaucuucaccaaagcuaucucaauucucugccaucacuuacgcacucugugguacaucauuuuccacugauagacaagguccuuagagucucaauucuagaaccccaauauaauauccacaugugguuacaucauaacaaaguuguaaagccacugggugggguaagauuaauucuauauuuuccuuaagaagaauuagaauucccaaauacaccgaaagcacuaacuauauuucuaacuacuuuagaaguaucauucuguaaaaguaguuucauuauuguuuaagcuuguuuucacguauuuguaugcaugcauguauaugcuuuauuaaaucuauuucugagccugacuguugggcuuuuacaaguugcucucuuuacuaggaacaaauuuuuauucucacaucauauuaaugugugguuuuuguuuguuuucuacccauuguccacacucuuuuuugcgcggguagcugugacuucaggcacacuaccacaccuggcuaauuuuuaaaauuuuuuuuguagagagagaaucucuauccuauacugauaggaucugcuauguugccagagcugauuuagaacuccugagcucaagugauucucccaccugggccucccaaagugcugggaacacaggugugagccacugcacgcagccacauuaaacucuuaguccuuagaaacaggcuacuuaguuuggugucguuaguaccauaaaacacugugcuuaaaucuguuuuugauggaaucacagagcaaauuucacaugcagcuucaggucaaacuguuuccacaucaguuuacagacuuuauuauagcaucaauaauauuuauuuguuucaaaauauguagaacaauuaauuauaagaacuaauucacugcagugaauguugaaugcugacacuuacaaacuaaagggacaauuaguuaucugaccuuuaauaauuuacaaguuuaucuaggcaaagcuuaaucggccauagauuuuuucuuuuuuuuuuuuucuuuuucuuuuuuagacagagucugacuuuguagcccaggcuggagugcaguggcgcaaucccagcucacugcaaccucugccucccacaaguucaagugauucucaugucucccgagaaggugggauuauaagugccugccaccauagccggcuaauuuuuguauuuuuuuuuuucaguagagaagggcuuucaccguguuggccaggcuggucucgaacuccugaccucaagugauccacucgccucagccucccaaaguucugagauuacaggcgugagucaccgcccccagaugacuuuuuuucuuuuagaaacaaaaccuuaggcauauuuuucuuuauucgaauuuuuugucaaaguuucuguuuuuaaaugcaucaaauauaagugagugaaaaggauagaaauuaucuguacuacuaacucuucuauucaccacaauguggguuuccuuauuuauuucuuuuucuuuuaaguauuguaagcucuuuucaggaugggaggccuuacuguguuauucuuaacuauacagucagguccuagaagaguauauggcaccaaguaggugcuuagcagauauuguuggaugaaugaacgcuguaaauaguucuacuagaauugauuuaaucagccuucuauuguuggauguugggguuguuuuauuguuuuuucuucucauaaacauuuguuccuucagauaaaucacagucuauaauuauuuucucagaacauguccauaaaguagaaaccuaggccaaagaauagcauauauuuuuuaacaacaucauccuauaaaucuuuauugaguaaaaugauuggguuuuuaauuggaugcauuuguuguucuucaaaauauugaccacuuucuguuuuaauuaguaauaaauuucuaucauaauuguugccauuuuucuccauguuagaaaaaacuggaacuuucucuucugaauuguauaauuaucuauuuuuauuaaugcuuuaaaaauguaaggcuuuuaaaagacuaauuagacauaaaaauaaaacuuucacuuaagguuuauugaaccuauacugguaugucugcaggcaaaaaugaauguucaaaguacuuuuaggaaguaugaaaaguguuuuagccauuuagccuuuacuaacauuuauuuugauuuuaagguaauuuuuauauuauagguuacuugcugacuuuuuuucuucucuguucuuuucugaaguugcauucuuguguugggugggacacaguuaagugugacaugaauuuccuugccccaaguucuugauuugcccaugaaaugaagacuugugccucaucagaugucuuuuaaauuuuuuacucugcacauuuuauuuuaauuaucucugaaggcauuuucugguucuguaauaaguucuuaccucuugccuauagagacuuuggaagugauaaaaauugaucuaaaacuguuaaagaaaaaaauaguauuuuaaaccuguuaaguuauuguuuaauccuagccuuguaauugaugugcacaguuguagauggugguugauuugcuuuauuuuguauucucaaugccauauaccauguguaagcuauguuuuuagcccggucucaugucucaauucugaaaauguggaagauguuuauuguaguauuccuauaaaaauucauuaucauuuaauucuuagaaaaguaacucuagaguuguuaaaagucuaaauggccuuuuucuguguuuaucuuuaccaguucaaaauagaaaugcuacuuuuaacuauuacaauuuaaugguguauuugauauaaauuggauguuuacgauuugaguaaaguaccugcuuucguagaauauuuuagcugaaaauaauuggaagguauaccucccaguguuaaacucuccuauaaacauuuucuucuuacaaauugguauuucugaaccacuaucucuuauuccuguguuugaguagauacaauuaaguuucauacuaaaauaaauuuucuucacaucauuacuaaagcauucaguuauuucaaaaauauaguacauuacuauacugaugaauaauggaagaaguuugucuguugauucaacauauucaagaguaggauaguuuuucuccugaauaaaacuacaaaaucaauaguggauuuacuuacuugaccucaaagagauaagacauuuugucuaugaaauaguuuauaguuuuuuguuuguuuguuaaacaaaaaugaagggaaauaaaccaauaaagcagaaggcauggauugaggaagcaaucugggaaagguugugaaaagaauugccagagucuuggucaaggggaauccuagcaagccacccugcagaggucgcaggaggauggaagaacucuugggaggaagcucucuaacuggagggcuaucauuuacaaagccaugauacuauaaacacugaguauugaguuaacaaaaaauuguaagacuaguguguugagaaguuagaguauggaaaaaaggggaaaagggacaguuugggaugagguagggaggcagauuuauucauggaagcuuuucuauacagcaagaauuaugagccauaccuuucagauaguucuguggguuggcagcccucaucaccuggcaccuuuggcacugccuugauagcugccucucacccaaguuagagaaagaggauugaagacaggaagaaagcaagcuuaugugcuugauacuuuauccuaacuagguauauucuuauuuccgcccuuuuuacuugaggcacagauacaccaucaucugcacuuucugugccuaacuuaucuuaacaaaaaaaaaaaaaaaagcauucucuagaauaagccaagggcauuguauuuucugucgaugauaaaaugcagauuuuuaccacuaaaaggcaaugacuucauuucuaaagguuaaauugaaugguucucacagcauaauuucauaugguuaaauuugggaaacugaaagucauucaguaagagaacaaucucugagcuuguauagaauuuguauuugauugagaauuggguauuacuuuauucacauuaagcuguaucacaugauuuuauuucaagguagaaaagaaaugucaguaggcauaaguacuuaguagaacuuuuuucuuuauuugaacaaaauguguccucuuuauggccugugaggaugaccucaugcuccaucugaugcuuucuuuuagcuauugcccaagaguuuagacuuucuuaagcugcuuuuguggaaccagugagacuuuuuuucugugcuuuucuaaccccuugcuuucucaucuaaaccauuuucuuuuuaaauuuuuuaaguauuuuaauacacuaguauucaaaguagugaucaaaguagaugauuuaaaacauaaugaaugggugguuaauuuugaacuugauauucucuccaaacuacuuacagauuaguuaggggaaaaguuuucuugaguuaaaaauuaaaauauuguauauucuuccugugcacguuguuuuuauuguguuguuguauauucuuaaagguauaauuuauauacaguaaaauguucucauuuuuagcauauaauucugugaguuuuggcaaaugugcauuuugagaaacguauauuuaugaaaucaucaccauagucaagauauuagagcuguuccauugucccaauuccuccauuccuuuuagagucaacuucuagucccuggcaaccacucauguuuuucuguuuaacuauaguuuaaccuuugucagaaugucauacaaaugcaaucauguauuugagauucauacguguuguugcccaugucuuuuuuagcguagaguaguauuccauugugugguguacuauaauuuauacccaguugagggauauuuagguuauuuccaauuuuagugauuaugaauaacguccagaccauuaucuuugcuuugccuugcuuuguuuuuuuuaaagaaugagacagggucuuacucugucauccaggcugggagugcaguggugcgccaucacugcucacuguagccucgaccucccaggcuuaagcuauccucccacaucagccuccugaguagauaagacuacaggugugcagcaccaugcccagcugauuuucuuuuuuucuuuccuuuuuuuuuuuuuuuuuuuuuuuuuuuuguuuugugaggcaagaucccacugugauggccaggcuggucucuaacucccgggcucaagcaauguuuuugccucaggcaaaacauuacaggcaugaggccaccgugccuggcucagaccauuuucugagggucccuaaucuauuccucuaacauuauuucacuuuaucuuagugaacugcggugauuguccgaauggugcuuugcauguuuucauucuaaacauagagaugugucuucucuuccuaaguauuugccaaguucugguuucauuucucaguauuguacacuguggaaaggaagaaauaaaugguggguaggaccaaccaaauaaaaguguuuguagaugucugacuuucuuagggcuccuuaaacucuuagaugauuuaguuccuugcaagucugauuggagaguaauuguuuucuuccauauguuggagugcuauccuugcacuacuuugcccuguggcuuccuucuucuaguugggcaagcauaccauuccugcccccuuuggaaacuuugcuuagccaggauauuucuuuuaauaauuguaauacucucuguugagggcaucacugauuggaaugauacauccuaagcucagggcuuucuuccagcuuaaugcuccuacagauguccaaauguccucuugacucaugcucccagaacuggagcucagagccugggcugcgguuucuccuauguucaacauggugcaggccugagugaggugcuuuaccaaccaaguaaacagugugagaaucuguaaaccacagacaacacuuaaugauuuuccauuuuuuaagagacaaggcuagagugucacccaggguagaguguuguggcaugauuauagcucucggcagccucaaacuccugggcugaagcaauccucuugccuuagccucccaagcagcugggacuacaggcccgcaccaccaugcuuggcuaauuuuuaaauuuuuuguagagaugggguauugaacuccuagccucaugugauacucccaucucagccucucagagcgcuaggauuacaggcaugcgccacccugcccaauuauugaaagauaauugauggccuagcuuuagcaccuuuuuuuucuguuguaauuuuuuuguuuggggguuuguuuuugucaguguucuccucuguguucacuucauuccuguuaaacuugcaauucacugaaguuuacgcccucccuggucucucuaguacacaucucaccacaaagcauugauaaccagccagggaagagcaguuucaaauuugaaagugcuuuaugguaacacaggagcucgagggcauucucagaguauccuccccccgcaggguuccauguauuucaagagaugaucaugcuguauaacuggcucuucaucgaaucauaaacucauucugugaauuaaaauggcacuuggggccauagcgcccaagauguggaaaggaggaagaguguggagcgauaggugaugguuuugccuugcugauaggagauguaguugugauuugucuuccauauagccacaaaaguaauucuccuggucugcacaacccagaaaaacauagauaacgauggcagugaaugaucaccauacaccauacaccauacacaauacacuuaaaaugagagagcacauuugcuucaguauccuuaacgauuuguucugaucuccacacucuuuuuuuuccugugucuguccucuuguucacaaggauuuugcugcuuuagagcacauuugcuucaguauccuuaacgauucguucugaucuccacacuuuuuuuuuuuuccugugucuguccucuuguucacaaggauuuugcuacuuuagaguuaagauugguuagacccagacagcacugugcccuggaguccuuuacccucaggucagcccuggugggaccaagcaguacagagagcuucauaggaagaaacauccugggaugggcaguagagcauaugcuugcaccuccagggaggcccaucaggauugaugggcuucuuucuagcuguuucucaagugcugguagaguauacuuccccaguaauaaguucugcauguauuuguuuguaguucauuuuccugugauguuaaucaaagauugugaugaugagaacuaauucgugaucuucauuauuaacaauuuccauuugagucuugcauaugauaauccugagugguuaauuguuaacuaauagguuuagucuauucccauuuucccaugcuguuuucugugcuguuauguuuaccucucaccagcccuuucuaguuucaugccuacuauuuggggacuuucauuggagaaaucaugggaaucacuuugcauacaucuagugcacaccgacauccuaaacccuguuccagaauucacagaauugugauuucuguaguucagguccucuaggaagcaggugaccuggcugucuggggugguggucuuucagacacuucuauccugugccugcuguacaaggauucugcuucgucugcucucccaccuacccacccaaaucucccauucucccaagccugggaauucaucauacuaaauuauuuuaaacauauauuuguauacacagcaagguacuuuauagagauaaguuccaaucuaacugcugaaggggauaucuuauagccauagauagauguacccacauuuggaagagauguagccugacaagccagaagucagggcagagugagaguuuauaauuaagguguuuuuauaaccuuugcuucucugcuucucucuaagggucauccugccauucuggagggucauucagaacccuguuccucuaaguuugagauauagauacuaacauccuuugaaaugaagucaccccaggcacauuuguugcaucauuacuuucucaauuucaaggugcauugaggaggcagaaacauuucuuaaagagaugccauccacaauagcagguuaaauguagcuaaugcaaucuuaaauuagcuuuucuaagaguacaggaaaauacuuauguauaguuugcuguagagcacagguaaugugaaaacuaccagugcaacaacaacaaaaaaagacuucucuugucagaaauccaguugcuuccugauuauuuacaccaguggaggggaauauugguguagauaacagaaaaccacaacuaauuuauuuacuugauuucucaaagcuaugagccaacauaguggcagaaaacuggcaaauagaaucccagaccuuauguaaggaagcaauagcaaugaaaacugagagugaaagccuuagcauauagauacauaagcagaaauauuugauauuaccuugaaaugagcauucuguguaacaaguccuguaguuguuaucucuuuaaaucuaaggucuuaaaucuuuauuuauauauaugguuguggguguuucuuuuuuuuuuuuuugaaauggaguuucacuuuugucacccaggcuugagugcaauggcaugauugggcucacugcaaccuccgccucccagguucaagcgauucuccugccucagccucccaaguagcugggauuacaggcacacccugcuauacccaacuaauuuuuguauuuuuaggguuucaccauguuggccaggcuggucucgaacucgugaucucagaugauccuccugccuccgcgucccaaagugcugggauuacagccgugagccaucgcgcccggccaggucuuuuuuucuuuuuucuuuuuuuuuuuaagagagaaaaucucugucucccggcucuuauuaacccuggaaaugugucuaagagacugaagcacauugcuacuugcacucucucuuuggaaggcaaauuacuuaacugaauucugucaauuuuauauuguuauaaucagaauuucuaaaauaaauaauuuccauaacuaaauuaccagggaggauuuauagcuacaucgccugaggaaacgugccagucuuccuaaccaguguuuucauuugagccacugaaacaaauauuaaagauuucaagaauguuugaaaaggaacaugccaagcaaaaaaaugcuugagaugacaaggaaagacauacacuuuuguguggcugugacugagauuugaaagugccgacaucuuuggguucuuauaaucaauuuaauugacuuuauaagaacuuaauauucugucagcuuggaugaaauauccaucuuuccacuuagugacugguccacaggcauaucaccucauccaagccuucgaaauacuugccucaagaauauggggaacuccauguucuuaccuuauaauuuuuaucuggaaauaaacauggccaguucugaugagguuuuaaaauuugcuguaugccuuugauuuucuuuuucuuuuuuuuuuuuuuuuuuuuuuugucggagucucgcucuaucacccaggcuggagugcaguggcacaaucuuggcucacugcaagcuccgccucucagguucauaccauucuccugccucagcuucccaaguagcugggacuacaggugcccaccaccacacccggcuauuuuguuguuguuguuguuguuguuguuguuguuguuguuguuguuguacuuuuaguagagacgggguuucaccguguuagccaggauacucucgaucuccugaccucgugauuugccugccucagccucccaaagugcugagauuacaggcaugagccaccacgcccagccugauuuucauaguuggcuuucacuucugaucuuugccauaaucaaugacaugucauccucuuggcuaucuucccauuugucauuucuggaauagagcuguugaguugugcauugagacuuaggaggagucaggaacauguauugauuuuuaugacauggguagcacuaaggucccuuugaggcuccuugauuauucucagucugaguagguuucucucuuuauaaaguagguaagaguuuagcaaaaaaggaagagagggugcugcaaccuccuuguuaguuuaaacaugaaaggcaugccugugugugugccauuguuauuccuauaagcauuuuuuccagauaacuacauccaaaggauagugaugaguagaagucuauuucugaaaaauguaauuugcucugaucuugaggaaaaagaccuucucuucugagauguuagguugccucaugauuugcgauaaucaauuugauaauuguuguugacuuacugguucagcucaugaauagugucccagauuuagacuaguauggcacaaggauuuuaaucaaguagugcuuucuuucccauggagcauuuaucuuguuugacuguucuggacuucagccagcugccagacaggcauuuuucauguguauauguguaggagaauguguugcuuaaguguucaauggggaaguuuccaacccccuaaagcucaugguuaccuugccuuuuaccacuguacuguuagagacacugagaauggaucgcugucucucuuuuucucuaagaauccguuugaugggaagcaugaaucuuaguuacuaugaauacuguuuucaucccagccuaccucacugcuucugaaugagaggagccccuuuggcugcucugaaaacucuugaaauacuugauggcuuguuauguuuucauuaucuaaugugcauuaauuuaaauaaaauagcucuguuguuagaagaagagucaaaaaggaaaagcuuggcugggugcagacugcuugugucacagaagucaggaaaguuugcagaacuugguguccucagagggaguuuucaguucugcuggcugggcugaaaaccugaaacucuaaaauccagugacuauuccccuagcauauacgaugugauauuuugaugcucacuuacucuaucaccuguuuaauuagcuugagagacugaaaggauuugaaggcccuucgcaucuaugugacugaguucugagagucgaaauguccaugauuuggcacucuggaggauagagcacacagacuuuguguugaugcaccaaaaaagguuuuuaaacugcuauuccguuuuauguguuuuuauuauuucuauaaugauuccugcugacaugaaguaguauuugucuccauugaccacauccugcuguucuagauuucccuggguaggaacaguaugccccagguaucaucucauccccaaaaugaacauagagcaggaguugcuguacuagugccuggagaaggcuggccacuucucaagguuaagaaacugugagcucugaaucuuacauaaccuauuuaaagauaaacuacuuuuggcuuccugggacaggguuauagggacuaugugagauagccuaggcgucgcuuuuuuuuuuuuuuuuaaugaauauuaaagguuaaauggaagguuaguacuggucuucuuaccucaacuuuuuuuucuuucuuucuuucuuuuuuuugagaaagaguuucgcucuuguugcccagguuggagugcaaauggcacgauuucagcucacugcaaccuccaccucccagguucaagcgauucuccugccucagccucccaaguagcugggauuacaggcaugugccaccaugcccggcuaauuuuuuucuauuuuuaguagagacaggguuuugccauguuggccaggaugguuucaaaccccugaccucaggugauccacccgccucagccucccaaagugcugggauugcaggcgugagccacugcgccuggcaccucaauuuuguguuaaaggaagaugagcucuucuugccccagagaacucuggugugaaagucucauuuuccaagcacccuuuuaacugaguauuuaaguuaaucuggaaacugucgauuaacuauauuucuucuacugaggccucauggguaucaugucuaugucuugguuucagaaaugucuauaaauaggguuauuugcuuagcuuccugccaaacuuuuuguccuagacuauaaagaaagaaacguuggguuuuauuacuuuccaguuacucuuuuccucuuuucuccaucaggauacccaaaaagcaaagcaguuccugccuuuucuucagcgggcaggucguucugaagcugugguggaauacgucuucagugguucucgucucaaacucuauuugccaaaggaaacuugccuuaucaccuucuugcuugcagguaagucuuauguguuacauguuacucugagcucagaagucaucccuggaaaccacauacccuccuuucccccuguguucuagauaggcccuagagcccaccagcaugcucuuccucucugguugggauaugcaaacacaguuucuagauuggauccuccugugccugcagacccagcacugcacccccuuucugcuccucauuucuaccaagcacaggauguaggaguagagcaacuugcaagcacgcagcccuuauagagcuagagcaaaggaaguuccagacuaggaaaauaccagccauggaauucucagaguuggccuucauuacccacuugaaacagacugcccaugcuauguuaguuguggggaggccucagaggagccaagacacucuuccccuguagcuccccaagcagugcccuuugucucccuuucauucuuuucaaaugccauuaagaucccaguccuuuaugaaaccccagccaugacguugcuuucacacgcucuucccacaucgauaguauuucuuguugugcuaagguugacgugcuaaggcaaagaugcuccuuucuuugcugacuuaaugugugucuuacccuaucuuuucugguagcuuaauauuucacaagccagaaggcuauguauaaacugugcucuuugagcaauuuacauuuaugcauucaaggaacaaacugcuucauuucuuugcugcuggcaaauaauaguuauuuauuuccaguugguacuucacagagacugcagucuuugagggaaagcugucauuuuacuuccaccaccacccccaccccgcccagccacccuugcacacacaaauauucauucacuugcaaaagacauaucccgccgugguccccagaugcacaugguccccaccuugccuuuuuugcuaguguccuguugucucagcacuucuuacauugaauuacugaauagaauuugcuauggggaaagagaaacgggagucaugcuugcugccuccugccagaucgccuuggccuccuuuuccuagaaggcacagguaguuucuugucuggauaagggucucccucaggccccaacuaaauggauugaguuaugagagauaaaucacucccugaacacaugaccauggagcucacugcugcugcuuggcugucacuucucauuguggcucuuguacauacucuuaugaacuugaucacugcacagcucugcaggccuucugaagggacucauugaagugugacaccaagcucagggcagcuacgcaaaagaagagaugcaaaaaaauucauaccuuauuggagggcugugguuuuauuuuugcuaaugugaguuaugguaaacugaaaggcaguguggcaguugugugagagaguccuuuuaugcagccauuuguaccuuuuuaccaagguuucuauacccaugaaguuucuugguagugaacuuuugcuagagaguuggaggcacaggcauauccagguuuauugcacuucuuuuuauugugcuucagauauugcauuuuuuuuauagauaggaggauugugacaaccuguguuaagcaaguaugucagugccauuucuccagcagcaugugucuaucacauuugguaauuuucacauuucaaacuuuauuauuauuauaucuguuauggugaucugugaccagugauguuugauguuauuauuucaauuguuucgggucgccaugaaccacagucauauaagaugguaaacuuaauugauaaauguuguauguguucugacugcuccacccauugaaugauaagaaaaccaaacaaagcuuggugcaguggugcaugccuguacucccagcuacucagcaggcugagcccaggaguugcagaucagccugggcaacauaaugagacccugucucaaaauagaaaagaaauugaagcagccuuauugcuuauauggaaaaauuuuaguggucuggauagaagaucaaaccagucacaauauuuccuuaagccaaagucuaauccagagaaagaccucuggauuugacucuccucaauucugugaacacugagagguaaagaagcugcagaagaaaaauuugaagcuguuagagguugguucaugagguuuaaggagagaagccaucuucauaacauaaaaguacagggugaagcagcaagugcugauguagaagcugcaacaaguuauucagaagauccagcuaagaucacuggugaagguggcuacaccaaacaccagauuuucaguguagaugaaacagccuucuacuggaagaagaugccauuccaggauuuugguagcuagagagaagucagugccugccuucugaguuucaaaagacagguugacucuguuguuaagaccuuaugcagcuggugacuuuaaguuaaagccauugcucauugaccauuccaaaaaaccuaaggcucuuaagaaugaugcuaaaucuacucugccugugcucuguaaaaggaacagcaaagccuguaugacggcacaucuggugacagccugguuuauggaauauuuuaagcccuuuguugagaccuacugcucagaaaaaaaaagauuuuuuugcaaaauauuacugcucauucacaguucugcagcuagcuggucacccaagagcucugaaagaguuguacaagaagauuguacaugccugcuaacauagcauucauucugcaacccauguaucaaggaguaauuuugauuuucaaaccuuacuauuuaagaaauauguuuuguaagccuaaagcugccauaaauagugauucuucugauggaucugggaagcaaauugaaaacuuucuggaauggauucaccacuuuaaaugccauugagaacauuugugauucaugggaggagguugaaacagcaaccagcauaaacagggauuugaaggaaguugauuccaagccuccugguugacuuugaagaguucaagacuucaauggaggaaguaacugcagauaugauagaaauagcaaaagaacuagaauuagaaguagagccuggggauaaaacugaguuacugaaaucucaugaaaagaauuugaacagaugaagaguugcaucuuauaaaugagcagagaaaguuauuucaugaaauggaaucuagucccggcaaagaugcugugaacauuguagaaaugacaacaaaggauucagaauauuaccuaaacuugaugaaacagcaucaggguuugagagaauggacucuaauuuugaaagaaguucuacagugaaugaaaugcuaucccacagcauuccaugcuacagagaaauacuuugugaaaggaagagccaguugauggaacaaaccucauuguuuuuuuugccacagccaccaccuccaucagcaaccaccacccugaucagucagcagccacaaacauggaagcaagacccuccagcagcaaaaagauuaugacgcacugaaggcucagaugaucauuagcauuuuuuaacaauaaagugcuuuuauuaaacuacaguauagggugaacacuuuuauaugcccugggaaacuaaaaauuugugugacuugcuguauugcaauauucacuucauugcaguggucuggaacuaaacuugcaguaucucugagguaugccuguauauauucaucucauccucugcucuguagcaucucaucuucugcucugagaaagaaaagcauccuuuuggcaauguagagcuuuaucccagaggugaaaaagagaaacaguauuauucuuccugggaaacauggccacaaauguauaggggaaagagaacauugaaguuuugucuuuuaagcucuaaacuaccugaauggagccggcucagagcacagaccaucuuggcuggaguuuuccugcagaauucuucuaguuuuacguugcuuagacacaagcagucugaucacucgacucugcaucagccaguuccuguguguauuuggcauuauuuuaagcuuagcaauucaaaaggcauugccugaguuaacuuacauugugaaagauagauuacacagaagcaaauacgugauaaaaauauaagccuuuuacauuuuucuccugccauagugugugcuguuauauuaugcaucuuuugguuucuucagaaaccuggcaagaauacaggacagggaaaagucuuaagagaaagcagaucucaguuugcaucauggcucuacuguguauaagcaggugacuuuaacaagguuauuuacccucuucaagccucaguuuacacaucaauuauaacugggaauuguuuccugccucaugauugucgcaguuuaaugaguugacucugaaacaagcccauuauuaagcagaucaucaauaaauaugauccuuccccuugcaaagaguuaguguuuuuauaacuagaguuuaccuugccccucaauuuggaguggcaugauuuugcagcaugugugcacauagcuauggcucuaccauagaaauugugaccuacccauuacuggaaauaaaucaagaaaaggagcuaugccagccuucuucugacuaagcuugcuggaaggaagucuccuggcuuuucccucugagacuuuggagcaaggaacucugcacuguccuaaaaccccaucccaaagaauacacaaguaagacacaguccuagguaucaggaaacacccaagggaauacagacauguaaacaaaauguaaaguugaguacuagaugagagaauagaauuauggacaaggucuagaaguagcacugaggagggaaugauuauuucuuuagguggacaucagagaacaccucccuaggugcugguaucuugagcuguguuuugaaguacauaugaguuuacuguguugggggaggggaguaggaggagaugcacauucuagcuagagacagcagcgugugcagaguuguagagguaugaauaucugcauggaucugggcaaccacauagcccuuguuacugguggaguauaaagagugaggaggguagaguguggggucaggcugacagcucagacacgagcuaguccuucucuuucagauuaugcaguggacccucagagucacuggaagguauuaagcaagggggcagcaugcucagacucggguuaaguaaauucauuuugguggaugcauugaaauaaaugaggcgcaagaaucugggagagcaauuaagaggcaagagaauaguagaggucugaaaucuggggagaaaacuggauagauuuggaaaaguaggagguagacuugaaauucggggaaugccuggucucuuuuuggucaggaguggggggugguguugaguggaggggagaaaaugaaagcauccuagguuugagcaaucugguagauugagauguccacaauuaagagcaacacaaaaguaagaauagguuuuaggaauagguuguucguuugguuuuggaauauccaugagaauguucaagcucagcagaggagccuacgcaaguauucaggucagggagccaucagcauagaggcaguaauuaaaacuguuacagugccuagaggacagguuuacaaggaguaagcacccuggaagacaccaaccugcauggagcgggcugaguguucauauaugggcagagaagauacggucagagcaguaagacagucaugagauagcauucuucuggaagccaagggagugaagaauucccaggcaccagcagugucagaguuuacauaaaacaucaaguauauaaaaacuguaaagggcuuuuaugcuguuuaucaacuaguaagucacagguaaccucucgguacaguuucaucagaguugaguugauuaaagguagauuacaggugacugggaaguaaaagugggaaguaagaaacagacuuaguaaguacagauugcacuucccugauaucuaacagagaauggaaaaguagugcagaaaguaaaagccaaagggugaagguaacauuccgaggaugucagcaucuugugcgcuuuuagaacuguaauucuuauucaagaaucaagaagguauggauagcugaaaaggcuauucaguacaccuauuguuuucauaauauaaauuuuagaauguaaaacucaacaaaauauuggcaaaugagguuauaaaaaaagauagagugagagauuauccuggggaacaugagguuugaaauauugagaagcacucgucugaauucugaagagaaggaaucaggaaaggcugcacagggauaaugaauggagcagugaccuagaagaagcagaagggaugagaugcauggagaacgugguuugagggaguaggcuuggagagagaaagaucccuuggucuuuuaaaacuaccuacaaagcugaaagugaguaggcaugcuauucauguugugggauuguucgccugggcagcgauuguccugcuagagcuuugcagauaucugccguaugcacccuccauuauguaaguguggcauucugcuggaaaugucucuuugcaguaaggaggggguuuggguugugauucucaaggggaaagucaagauaauuauugggagcagucccuuaugugcugcucucauuaaucccagccuuuuggagagccuucuguacuucaaggugggguggacacuuuccauuuuuauguggccuuuuuucaggcagacggccccacagcuugauagggaguggcauuuggcccaagccagcuggcuguucugucacgguuccugcaccccuguauguagaaugaucgcuuggucagaugggauagcagguggggcuagagaagucagcuguagccaacaggucagugccuccugaacgcucuugcccucuaguccuuuaagcaccugccuuaggcuuggcuggugagcaggugaccuuacagcaucagaacugagacuguucaaggucucucugccugcugcuguggccuccuccuaagcgugcugauuucagucucggaggcagucacagacacuucuuguccauaguuagcaaggaagccaagaucccugggcagccugcauuuguuaaaaagcauccuuuuuccucaucuggccuuuagugagccccacacguuuccuuccaugagagcaaaagugguucacgcaguuuuuauuuucacuugucaugugugucccauuuuacuuuaguauuuugucuagggggagauugagucacauauuuggaaauuauuuggcucucaagucaugcuuuuauuuuuuacuuucuuuuucuuuuuucucuuguuucuuuucuuggagacagggucuuacucuguugcccaggcuacagugcaguggccccaucauagcucacuguaaucucgaacuccugggcucaaguaauccucccucagauccugaguaucugagacagcaggugcaugccaccacaccuggcuaauauuguuuuauuuuuuguagagacagggucucaacuguguugcccaggcuggucuuaggguccuggccucaagcaguccucuugccuuagucucccaaagugcuaggauuauaagcaugaaccaugacacauggccucacauuuuuaccuaaaagcccccaguggguguggaguauuugucuuauuacuaugaacuuuauauugaguguccuuauuguaauucccuuauuagaucuuagguaucagggucaugcugcaggcacaguucaggaaguggcccuguuggaugagcauagcagguaucaaggcauggugccuguaaaccaaauacuuuucuccugaauuggaagagaauaauaauuugagauuucagugcaaagugaucuaaggagccuuauaucagauauuuggagucuucugucaacucacugagugaguccaccaugccguguuugcauuuccuuaguguuaaaggugguaccgcaguaaguuugaggaauuacagggugaggcaggcaggaaauggaugccagucaccuugcauggaacucauaguacaaaccaucuagaaggcagcagccacuuggcagggaguucccauguggaucacagcaggugacuuauaauuaaccaguuaccuauucauaugaaauaagacaagaaaaugagacuucccuuuuccugcccuuuagcauuuuucuuucccucccccuuccucucuuuccgucucccaacccuucucccuucuccucucccucucccucccccugucccuucuccucucucucucccucucccucccuuucuggagcuggauuaugacaaaggaggcauugagaaaaguucuaagugucuaggauuugauaaaugguggugggcuugugcauggugaacuaaagguuuggcuguguguccuuucacccugaaugccuuugaaugaaguuccucauuuccuucuuuuccuuuaagaucucuucucuagccaauccucauuggaauaucaacugccuguuucaauagaccaaaaacuucuaaugagaggagggaagggaaggugaacaggaauauccuucucaucuccuggucccaggaaugguggauccccauugauuaccagugccuaacuaaauuacacaauuaaagccaauguauguuuaagugagaaaucccauucugcuaucacagaggugcuaaugaaucaggcuguuauugugguuguguuugcuaggcuucuauccuuaauuaagcaauuacagggucugcugauacuuaugaauuccuuucagaugcuuuaauugaauugcaacuuaauggauauuuguaaagugggguauucuuucucuugggauaucccaguuugauucugucuccauugccuacuuucuguugggucccauuacuagaaaugggcagcuuaacaugagacuuuccuggagcugcucuaguucuuuacuuuuaaagauaucauuauaggaauuauaagaauuauguucauguccggggauccuggagagucacuuacaggaaagaauuaacacaaugaacagauuuggguaguguuuuuuaaugaguacaagauuuuuacaagcacagauuaagaaaaguagucuucaauagauaaauuuuggaugauacauaaauuaguaggauaacuucucccucgaauaucuuuuagucuaguuauguagauggccauacaaauaauguaaacaaggaaauaugaaagagcaguuaucaaaagcauaggccaccuaguaugagaauacagagcaaauaacaauuguugaauggaaaaguuuuccucagggcgauggcauuugaguuuccgagaagaucugcuacauuuucuuugggcagacuggguuugauucaucuaggcagaagaaguuggccuguaucagaucucaggaagaguugccuaaaagaaauggacauauuaaucaaucauuuuucucuccgcuuuuguauugguguguaaaucucccucuuagcucuucugcuauugagccuucacugcuccaccuucagcucuccgucuaugcaggcacacugucacccacuggucaugugaaugaaaccuccaauuacaccaggauuauuuucaucuuuacaccaugaaucauccccagaaugagccucaucauacuugugggucauucaauuacaugguuauuuaauaauuuuuuuuuauauucagugggcacaaugcuaggaauacagaaauggaugauacaguuccagccuuugagcaaaguaauugugucuacuggaguaaagaauguauugacaugaagaaaaaaauauuuuaaaagcauaaggguaagcaaaacauggcuuaaauacuauacaaaugagaacagcucagauuuuauaaaacaauaagaguaaauauguaacugcugucaaaaaggcuguuucaaaacucggaaauacagaacgcagagaggaguggagccagguacugacccagcccaagucauugcauuccuggugguacgguguaccaucugaggaccauccuuuuaggaaggacaucaggaaacugcagguggucagaucagaggaggaugaacaaagaugcuaagagccucagcaugccaauaccugaagauugggaguaggaauuaaaagacagacuuccaugacauaaucuaguguuucaggguaaaagagagagaaacaugauuuguucaguacccauuccagaguaauaaauaaagucaucacuaaaaauaagauuuguuuggccugguuuaauggcagucacagaccuuggagcuaaaacacuuaaagaugaauucuugcccuccugcuuccuaauuaauuauuuccgucagacuggccugcuuaucuuggugugaugcuggugaccuggaggugagggagacagcaaggccgauguggcauuuaugugccagccuaucuagggccuccuauaacuagcaaaagauaguccuaguggugucaucgccuucuauggagucagacuguggaggaugguguggccuccugauugggguguucagcccuuaccaucuacuggguuuuaugugccaagaaaagauagauguugauuuacccuugcuguuagaugauaggccuguggauuagcuuuggauggguaggucagugaggaguuuccuuccuccugaauucucugacuaguguuucuacucuucuacucuaaagcguucuauugugcuuuuuacucuuaugcuuucauguuuuaauacugaugagacaaggggagaaaacauccuggauagaaaaugaggccuguccuaugcagagcuaaugaggccaguggaguaguagagaaggucaguccugugagcuuuucccuagguguuccuuuucgggcccuucuccuucccuccuacuuuaaagcgcguucugucugagucuaugcaggguugucuggcuugccuuccaccuggugggcacugggggauggaaugggaaacuuccagaaaucugauggcuuuucucuguuggauuauuuccaaaaacagcaccugucucguugguugugccuaaaugccucaguucuaagucccuucuuguggcuuucccagaggaauacauuucaguguagauuauucaacacuaucuugucaaccugugggcauuucccagcagccacuuaguaguaauguugacaagcuacugugcuacucaccagaacuccagcccugugggggaguccauuuggucagacuaauaguagaaaauggcaggaccuggaugcaggagagggaguguaaaugguuugguaauuugaaauuaaagguuaaugcuuugaaaucugguaaugggcagcgccagggugaacagugcacacugcuguaagacuuaauccugguugcuauggaaacuaccucacaaaucucccaccccuuucaaccagauuugacuggguuuaaaaaauaaauaaauaaaaccauucuucaucauugaaaagcuguuugcccccuuccccaaacuccaggucauugcucaccuugaguuucuuucaaaaguuuuucugaggcuuccccagucagaugggcuggaucuguuagaguuugggccuggcucuuuguguggaauuugaauaaauagcauuaacaugggaauuagaagacacuuaaguguccaaugugggcagcaugugcaagcuugcucuccugcuggccuugaggaggcgucauaguuucaguccuggcacuggacagggccacugaccacagaaugcacuuccucauuccccauguauggggggcucugaggaagcccaaggagcugcucuucgucucagugcuguggaguguucccagauucugcugcagggcugccaagcacuggccuaugaggagcaagaacaauccacagaaguucguuucauguuuggaaggcaucugagacacaacugcauucucuccgucauuuuauuucaucauuagagcuuuuuccaauuuacuuaaaugacccucuuaaucuagaccuuguaaguuuuugggcuuuuuuuaaccaaagcuucuucacccuuugccuaugaugaaguaaaugagaucuacaucucauuuggcucccugcaagauuagcuuauaggcuucuaaaguaggcuuuguagaaaacuuucuauucaagcuuucuggauucccuguaguuuuuccuuaauauacuuauuauacucuguaaugcuguuacaauagcauuccucaguaaacccucguaacucccaugcuuaccuuuacuaugaguaggaaaauauuuaaauccacugguuagucugcggcugguggagaaguucccauuucccugcccuugugugccuccuuuuccugagcuuguacaucugcuagugauuuuucuaggguuaauuuggguguuuuuauuuuuaaauuggaacauggugucugucucuucucuguguguguuuuggaugcagccccugugcuaggcaugcgguuauuaacuccacugauauaccaguucgcucauuagcauuugcauuuuaaauuacaagcuagagcagacgacauuuaugcuauauuuguaccauugccuucuucaugaaugaugucguaugugcagggaaugcagaaauaacucuucuaaggcccugauguauuuuagucucuuuuuuagcaaacugcuauuucuuuuuuacucuugauucuuauuguuugauagggaguuuuuuuuuuuuuuuuuuuuuuuaaauuuuccaaguuuagaccuauuugugagugcuacugauugggaagugcuaacgacagaccagcccuucauaucaaaauaggcauauugcguagaguggccauuuuucccuuucacguggugcuccuuguaagcagccugccuugauuugagaggagggaguuuuuuccuccacaguuuggugggugggaagacaugguaacaguuacuuguucuugcuaguauucuugcucacaucccucuuuuuuauaguugacuagucagugguuauuuaacaccuguuaauuacuugacacugcaaggggaaaaaaggaaauaguguaugccuucaagggucuuauuuuugacaagcauuuauauugcacuacaguacagcauauacuuaaauauuaauauugaguguaaaauaccaaguuagaggugggucuuuuaagugagauuugccaggagcaaaggucucguggagcagccguugcucuugccagaugguacaauagcuucagcaucugcaucucaagaacugaaucagaaaugcacagucauagaucauggaucugugacugaagccuuccuaggcuugccucauugugccuaacauagugucugguuucuagcagcaggaugagggcagaaagcgagcucugguagauaggucuguguuugugccauuuugcuuuccucugugagcucuaauuuugguucucugaguucuguugcagaguuucuuccuguuggugaaugcuaacuuuuaaaacaucacaugaaaaauacagggaagucauacuggagguaaaugugcauuguuguuaggcaagcacaaauucugcaguugauagaaacuauuuuuauuuccccacuuucucccuaaagguuuucucugauauaaucuucauucuucuaauagcuguuggaauaaccaagacacgaagaguugcauuugaugcugauaauccaaguacagaugauacauuaauucagaaccugaucccuuuaaggagucucauugcugcacauggcauauuauacauuaauaauaugggguaauagcauucugagccucuuacguggauccauuucaugcuaugagguuggccucacagugaacauugccauaucauacucacuccuuauucccuuaaagaauacaucuuacuauuggaaugagugcugggugguugguagcuuugguuccuucaacacaguagcacuugagcugugccacuucacaauccaguucuacuucauguuugauacagcuuuguauauuucuuuugauucuauuaaucauuguaauaauuucuuaccuggaaucuauugauucauaguuucuaagaaauccauacacagcacaucagagcuccaagugggguccaaagucaugugaggggguccuuaguucccaccucaccucaaucuucacauuaguucauuuuccauaaauaaaaauacucaugaaauucuuuugaaaaagugaugggcaggaggacaagacaaaauugauaaagaauuguuaccuaucucuguauuuauccuacgaacgugguccauuuuggguccauuguuugcugugcccuucugugucuuccaugaaauccaggcuccagacauaggccuuugugcuucaaucuuuagcuucuuuuggucucugugccuguuaccuggcaaaguuguucucuagaaacuggucagcugugccuaugagggcaagucuagaucucguggaggagaugagugggacucuagagacuugagagagguaagacagaacaggaggugccauuggcuggcauuaccugugcaaucagaugaaggugcauuuggaugguguggcagcaggcaccuagauggcacucggcacauucauuugguaacguuuagaaauugcuccuuaacugugcugaugaaagcaguuuugacgaacaacucaauaaagagccauggaaucccacagaauauguuucauuuuuucauuacauuuguuaacccguuggagggcugauugcugccagucacuccucauccugcugagcuggugccucagaggagggcggauguggcucgacugcguucccucagcugccaagccauccagcccucuugcaguucucugcaucuacuuccacuaugccauuggcuccugacggaaaccuugaauuaaguggguuagaaauaaacugcuugaaugcauuugugcagauagcuucucucaccagcuaucugaagugcuuuuugaaauacacgggagcccuuuguaagcugcuuuauaagcugugaaguccauuguugcugcucucugcagccagcgugucucuaaccuaaguaaugucuacuuggcucugggccaggacuugguauuggaaucuggcguaagcagcaaagccgcccaccagagucacuagcagcuguugcaaguuggaggauuugcagaaauugagauugcuguucccagauauuggcacuugccuggugaugaaugaccgagucugugcaaagggacucuguaugcuuuccuucagccuuuuauucucagcccucuauuguggcgccugcucaauggccccguuguggaggaggguggcugaauggaggggugaguggccugccucuacugucauucccucccucaguuggccuaaacugagucauuaauaauagcucuuugauccccugaaccgguucuuggggcaggaauuucauggcacauagcacaaaugccaaaggcuaagaauccaaccuugagagaauagagaaaugaacuucaccugagagugaauugagcccugcauugauuacuguagugcccuuuugccuuaauccacccaucugcuccagaauagccagggagguaagaccaagaccagaaaaggucuauucagauaagggguaguguuuauuucugauaugauugcccaagaaugaacuuuucagaggguaaugccaccucguauaauuucuucuuaucacauauucccaugcauauucauauaugcauaugcugaaaccaguguuacagugccaucuuccuagagauuacacugcaaagaaacagccucaauuaacugccauccacccuccugacuacaucccccucuaucacucccucugacaucacuguuucaucaucagauuguaagaugcuugaggguagggaccuugucugucuugucacugcugaacccaccauaacacugccuagaauagugcuucaccaagucagcacucacuagaaaguucuuggauaaaugaaugagcacugauguuucuuggcuaacguuuugacucuuuuaaaauuuagaaaggcugugcgugguggcucacgccuguaaucccagcacuuugggaggccgaggugggcggaucacgaggucaggagaucgagaccauccuggcuaacacggugaaaccccgucucuacuaaaaauaaaaaaauuagccagacaugguggcgggcaccuguagucccagcuacuugguaggcugaggcaggagaauggcgugaacccaggaggcggagcuugcagugagccgagaucgcaccacugcacuccagccugggugacagagcgagacuccaucucaaaaaaaaaaaaauuuuuuuuuagaaagcaaaauaacccuacaguuuccauagagaaagagugcuagagccacagcagcccugcaaucacauacggaaccaaacugggugucucucaggagaacuggauuaauuccuagaucugcccccaaaguaacagagccuugaacaggucacagagccucgccaggccucagauuuuuuucacagaauaagugguuuggauuagguuucucuaagauucauuccacgucugaguuucuaauaauaguuuucacuuaaugaguacuuacaugcuguggauuaacucauuugauccuuacccacaguccugugaggcaggcaccauuacacuacagucuccauuuugcagaugagaaaacuaaggccugggaaaguuaacucacuuacuaaauaaauagcagagcauauuuucuugaucuccucauuuagaacgcaaugcccuaauugacauugaacauauuuaucuccagguaacaagggaccuuuccaaucuucccuccauucacugcaucugcguguacucucuuauuggcuaggaaucaaucugguacugccuuucuuuugggaugaucaaaagcaaagcauaagaaugggacaguggcagugacccuaaguaggaaguguaguaaugaagguaugaauuuuuaguuguuuggggguuuggauuuguuuuauuguccccagagaugacaccaauaggaacauaucuaagaugagagcauggcuaagacaugugaucauagagcaagagagagcaggucagaccugugggauggguuuaugagcuggggcauuuauggauaaauuaaacuuuagcccugaguaagcaaaguccuaagccaguuauuacugcucuggcacuucuaaugggcccuaugcaacccuuauaaauuauucagcuacuuuauuaauaaaagaccaagcaacuugccuaguccuggugauacuuaaguguauagcuuagagagugcaaguuagaggaauagaauauuugccauccaccaaggaauccucuuuucuaauauggaggugaaaggguuaaacugacuaccuugaagagcagaguuuugagauagaguacaugaaacuggcauugaaauguuaacagugucugcuaaaaaagggcuuuccucugaggaaguggcuguugagauuuccuggacuguugcaucugaugcaccuuucacagaauggcaugacuauggcgaguaagugucccaggagauccaccauuuaagccucaaguuuuuuauuuuuguuuuuaauaauucuuaugccucuuuauuuugauauaauuuuacacuuacagaaaaguugcaagaauacaaguacaaagaucuuccauuuacccuuuauuaaauuguuaacauauugccccacuagcuauuuauguauuuuuagaaccagaagauuuuggucagauugcuucucacauccauaagaacagaaaauaauguuuuuccaucucauauagaaaauauuuuuucuagaaguucaaggggucaccauucuuguuucaugauauuguuccagcuuaaaaggcgacucauggcaguuguacauccugguuuuccagggaaacuucugcuuucaaguucucuguucaaauuccagaccaacugugaggccaggggucuuuuuggaucaaaacuuagcauucuagcagcuuuggguuggggcuucugucaggcugagauguuaucaggggugaaagaaccuaaaaguauaauagcauuuaaguaauguaguuuacagcccugucuggaagccucuggaaauguguacaucucaggauauuugcauauuugcugucugaguuuuucaugcugccccuagauaugccaggagcuuuauaauguuauauucuuucagauuucaggaaauaaugagucagaaguauggcaaaauaauccacuucauauacacuucgaagcauguuuggauucuguuauuuaauggcacuaugagaauaucaguguuuucguggugaacuauaaauauuagcugaaugccaaccugcugaaugcagauggacagcacagagaugagagggcccucaagguggcgcuucccaagacgccagcuacagaggcacggauggcaacuaguaccugaggacucugggcgcuggccuuacaugucauggcacagaccaaaaggaagacucuuauuuuuuucaacuuugcacacucuuaucauauuugcaguucccauccacucugagucuuggguccuucugcauuuucacugaaaugaauacuauguugguauguguccuuguccucauugauuaugucucuuuugcccucacucagcucuguuuucccacccaucagugaauaguauggauuuuauggccaguuguuuuauuggccccagagaugacaagcauugugccaauaaugaccccaccauucuuagcuuuugcacuucuuuugcccccauugcuauccaugauccuaugaagucugcaaggagacugcuacuuuuggguacagcaggacacacacaguguaguaggguugagguaggaaaccuaauucaaggggaauaaaauaggcgaaacaugagguggaaauauuuuagagggaaguugauaauggaaaguuuagugaauaagaaauuggaagaccuuauuucucacccagacuguagugauuccuguauggccuuaaaacaaagcucacacagguaucugcccccacuucucugauucucauugucugccuuuauaggcuguaccucccucucaaccccccauuguuaacuccagguuauaguccuagcuauuggcccuggauuauauuaaaugguagcugauguucuuucaagggcuaaaaugccaugaucuuaugaauccugccccuuacuaucuuacauuuugaguuugaaaucaagucagcugaucaguaaauugaguugauuaaauuuuugcccugacauaaauguaaucuguaugaguaggagaugacagcuuagaagaccgucugugucuucccguaguucaucagauaaacacucuaauuggauaacagagcucaguuuuaaaguagacugagcucaaaggugagcuagccaagggcuaaugcuaaugccaucuauccaauucucagaagagcaauuagggcccuaaugagaugaggaccuugggcuuuggugauagcaccagagagaaguugagaagcuauguugaauggcccuaccagcuucuuuggggcaagcugcuuguuugggauucacccauugcucaaaugucucccagauauuugugcaagaucuggaccccugcauagcccaacccucuuccguucccaguucucuucuuguuaggauuauagauucauggugcuaaccauuugauuuaucuuugauuugucuuucuuugucaggugcucauuuuuaaggcuaccgauuuaaacacauaagcugagaaauaaguuucaaguucuguuagaaugcuguuucgcccacuucacacaugugguauauuaaggguucaccuuuagcaacagccaauuaguaauugccaauacugcuuaugugcagugugggauucuuaacaguugcuaugagaaccuuaacuuuugcauucccugacucauuuuacaugaacaaugcaaaugugaagagauuugaaggggagggaugagaagacagggagcuggcaaauaaaugaagcccuguucgcucuuaaaucacuuugaaugguaaguucuuggugcucauucuguucuuccaccucaggcucucucauacacauuuguuuucccugaacccuuaagaaaaaaguaaaauaguuugaccuuuauuugcaucaaacuuaaaagcaguucaaguucacuacuuagcaagaagauugccuuuaaugagccaaguuuaaaagagcuggauuuuuaucucuuaauguuuggaaggagaugagaugugcauacacacugagaaaguaagcuuacagcuuuaacuauuaaauucaaaacugaaucacucucccagcagcauuuaagaacaaaaaaacuguguggguuucuuuuguuguuuuuuguuuugggggacaaaaagcaucucauacaguaugugccugugugugaaaucuugcauuuugaaaaacacccuucccucagcagaccagaagucaucuuuacuuguuuugaacaucaccugagaacaaaauuucuuuuccaauccaugguccuuugccuuauuugaagcugccucccagcuuggauuuggccccagcacagggugaaauguggguuagauccucugaagaaggaaaaggugcuucccucagccuuugucagcacuaauggccagcuguguuuugugcucuaucacuuuguuuugccuuucccuugucauuuggugagccaggcuuuaugcugaauagaagauaaagagugcuuauccuccacucccuucccucucaguucucuuccucucacuguacuugaaagaaaacuggaaugcugggacagaacuucuugauuugcccuuuagaguagaagcuguaaagagacuguggucaccaggaccccaugagcuuuaggaucccaagagcuuuagaauagugcuuuccaaacuuauuuaaugggucuggaguugggccagagaauuugcauuucuagcaaguuuccagacgaugucaaugccagugauuugcagaccccucuuuugagaagaaagggccuagacuucccucccccuuuuuuuuuccucuagguuugggaauuacgaaauauucauuguauacacaaugcguuaauggcuaagagaacagguucuggagccaguccccaccuagucuaaguuuaggcucccuaacuugcuagauaaaugaaacucucaguuuccgcauuaaagaaguggagaaaaaauagugucauugugaucagcagaucauccuugugaugugccucuuauccggugacacagcauuuguaugaugcaaagaaagcccuaaguggccauuucgauccaguacuugauacaugaauugaauccuguccacauaaaugcuauugucugggaaggccuuugccuuaugacauuuuagggcauauccuugaaccaauacuguacaugacuuucccucccauccaugaaaugaaacuacaguccuguuacauucccucccuccugcccagauucgcccuuguuugguaagaggugcagagcucuuagugugcauacuaggcuggucugucauuguggccacaucuuacagagauguaaugguggcugcagauuaaaucucagauguauauaggauuacagacucuuaaaaaagauucuggacugcauacucauuaggauggcuacuaucaaaaaacuaaaagauagcaaguaugagcaagaaccaauuuauuauuuuuuuuaauccccaaacauuugauaugcaagcaagcaccauuucagaacaaaucuagauuuggaacccuugugcacuguuugugagauuguaacaugguucagcugcuauggaaaguaguauggagauuccucaaaaaaaauuuaaauauaauuaccauaggauccagcaauucugcuucuggguauauauccaaaggaaaugaaaucaguaucuugaacagauacuugcaguccccuguucauugcagcacuuauucacaauagccaagauaauucaaacaaccuaaauggccaucuaggaaccaauggauaaagaaaaugugguauauaccuacaauggaauguuaucuagccuuagggaaaaaaaaggagauccugccauuuacgacaacauggaugaaucugcaggucauuaugcuaagugacacaagccagucgcaggacaaauauugcaugauuccaguuacgcgagguaacuaaaauagugacacucauagaaacagagaauagagugaauggugguugccagggucugggagccuugggaaacagggaguuguugcuugacaggucuaaaauuucaguuaugugagacaauuaaguucuagagaucugcuguacaauauugugccuauuguaagaguacuuuauuuaaaaauguguugagaggguaggucacguguuaaguauucuuacauuucuauggaaggggauagggagagauucugcuucuuaaaaguaauuucuucuugugaguaaagcuaauuuugggggauagaauguggugguccaaaacggggguuggaaauaugaggcugaauugauuaaagaaugugccugagaucaggguccauugcauaaauccuggucccugacccucuuuuauuaguaugugugggagccuuagcaagugaccuuagguguugucuugugucauugaaaaaagcaaaaacaaaacaaaacaaaaccacuuuaucuagcugaggaugcuuucuuucuuuuccuggacuuauuuggaccugcauguugcaaaaucuacauugcuacauaaaaagagguagcuccuauucauccuucacuucucaguuuuaauaccacuuuuucccagagcagaauaagcccuucccccucaucauggguucuagcucccuguaguuccccacccuuacuuauuuccuauuuaguggaggcuuucuccaaaagacucuaaacuccuugaaguuuuuguguugcuugucucuauuguauccccaccuagcaguccuugucacauaguagauacucaauauuuguugaauaaguggaaauuucaucuauacaggaaagcgauguauauucuuauauauaaguuuauugcuuagcagguuuugaucuugauuucugugggauaucauuuccaagacauuaauagauuuuuguuuuguagucauauuuguggcaccaaugugcauuuccgagaaucuccugagaggcuguucuaccuccaggaaugaagacugcaucuaaauagagaucaucacuauuuccaaagggcaggcaacaaccacagaggaugcaaauugauggaacaagcucagggagcaggaaaacacaaacgucucugagaaacuguuagcuguaggcugaaaauuaggaacucugagcuuucuuguauuuuuucagaccccauggccuagcagccccuggagauuccucaguagauccguuagccacugaggaaagcagcuguguucgauuuuauggcuguuugcuuuagcuuucugugcuuguaacucauuuuugacaugacaguuaacaacaaucuagauuaucucugaaguugcuuaucaaaauugaaagugucagauacccaauauuuugaggcccauaauuaacgugaacauuuuuacuuaauguagaugccuguaaaacaucuuuuaucaauagaaucucaaccauuuuuucauagugugggugacuguagcacaaguaagagaaaccuacagucagaagaaaggggcuggcugcaguggcucacaccuguaaucccagcacuuugggaggccaaggcaggaggauugcuugaucccaggaguucgagaccagcccuggccauauagugagacccccaucucuacaaaaaauuuaaaaauuagccagacaugguggugugcaccuguaguaccagcuacuugggaggcugaagugggaggaucacuugagccugggaggucgaggcuacagugagccauggucacuccacugcacuccagccugggugacaagaccguguguguguguguguguguguguguguguguguguguguguguguguguguguguguguguguguguguauguaugaaaagaagaaagcaucuguaauaggguguuugauuccucgccugccaacaucaagaucugcuaaugggagcagaggucuuguccuggaucucuuuuccguccccugaacuuuuccucccuccuauuuuaccaccccacacacuucucauucuaaaauuccucuucuagucuuuuuuacuuucaaucucuuuucccaccuacuucuauuuuuccugccuuuaaguuuuuucucccccacuccuucccucuaauaggaaaggagggcaaauaugaaguaaacauuugcaugugcauguggacuggaccaguuagucucuguguucguggcuuuuauauggauuacacacuuaaucucccuuaacucucucaaucugccuuuuauuuaguuuauugucauaaugacacuaauuggggcaguaaaagaaaugucaaguaaaaagugaaaagugcuuuugauggagaaauguuuuuccucguucauuccaccagcaaucauuuucacuuggauuugaagguauuggaaaacaagucuuguuaauuuucauuuauucagugacugcuuauccaauuuggcaauuaucacuuccuucucuggucucuccugcugcuacucuuagccuuuucacgguuccucuuccaccauagggaaggagaaaaggaaggaaaugaaauuucagcauucaguguagcuacuuauuuuuuaauuugaucaguugauuacuguaaggcaguguauagguuugagaugaacugcauuuagauuugggaaauugaauuggcuuuaaauauauauauauuugcuaucuuacaagcuccucgugggauugugggcaaagauggaccugcugauugaugcggacuggacaguggauaggguggcuaugugagcaccucucagugaaaugagucaggcagaaccugcuuuccuuccuuccccccuuacuccagcaaauauuucuggaaugcacacuguguucuggagacacagcaggaaacaaaacaaaagcccaccuucauuaagccaacagugggguuuuguauggagaugcuguacuaaagaucuuaucugugaaaauaucuaucuuuacuccccccaaaaugcagucuauaaaccucauuacugcaggagcccuuauuauuaccugcuuggguaaaacagucccucccccauuuuugcuugaguugugcuucuccuugauuaaauaguggcuccgauggucucuugaagcaggguugaaagagacucuggggagaucaucucaucuuuuaaucucuuaugucuucggcuuuguauggagcagcccucucucucuuucccuggaagcucaggcuccauccaugugaccacucuccaagagcuuuguguuuguguuggcagaaguuaggaucuggagagcaauauuucuuacagauuaauugccaaaguaauuauauuguaaaauaauaugcaugauugauauuuaauauaucccucuccagggagcuggagagcuucauugauuugggaagaugagccaguugcuuguuuaggagcagagcuuuguaugaaaagccaaauugauggccuggaccuaaagacaaagagcaggugaugggagguggauaaagcacagccuccagaaucauaaaggguguugcaccaagaagucucccaccaguuccacuuccagaaaucacagaucucuaggagaugacaagcagcagguucucuugcugagacucaugucuuguuuagaaugaguaucccuaguaucugcagugggauccugccaauaaagaaucuccucccugcccuguugcuggcacugguuugaaggauacuggcucaagagcaguaucuggcaucucuguaaagucucuuccucuccuuucuuguugaacagggcacaugcagcuucucugugugggugacguccacauaaggagaaugccuuauuuauuuuagguccaugagcuugcguaaugugccuauuuaacacccuccuaaaagcgcuuuucagcacaugagcaaguaacgaagcccacuaaauccugccucuucugggcacacugggcuguuuaagguuguuccugcgcuguguauuuauggauaggagcuggaguuaugacauuuauuucuguugguuagggcacugauauauaucugccugcaucucccauggagaaccgcaccuuaucuugagagagagaugagagcauucccauaacucauccugccaagcacugggacugucagggugggaagcuacuucucucccccuagccaguggaguugugggggggugguggcacgugguuaugcagagagacuuuggugguaaaauuaucuaggauuuaaaacaggagagagaaaaauguagcuccuaauaagcucuccuuuugcugucaugcuuuguucaaccugccccccaguccccuuucucaggcauaucaucagcaauccuuggggucuauagaaucaguuuauuccagucuuuugcucugacaggauucugucuccuaaccagucuucuucuguucucaugacccuucuggccugucugccuuguacaagggagaccauucuaagacacauaucugcucacaucaugcccugcuuauaacuucucaucaguuccuuuaccuucaaaauaagacauacauggccuucaugaucuauacccuguucauccuucuagcuucguuacccacauucccccaccauccgcucuuccugagcaggagcacuugaagaguccaaaacuagucuuacuggccucaggcaucuaacccuuucugcucucuacuuggaaugccuguugccuucucucuuuuuaucaucaccucccagaaccugguguaaguaaguauauggcuccaaagaaaccucaguuuagcauacaugucucucuuccucuagccuguguuccuuguuuaucuccauaugcccaauccuuagcacaaugccuaucuuguagcagauguugcaucuguguaugccaaaugaacagagauugucaucuagugaucuccugcgaagucucugcucccgccuccuugcucuaugaccauaccugcucccugaaauccagagccccaguaugucacuugcuccaauugccccugcauuuauagcuggacuguggcagauacaucuggauacuuugucuccaggaguaaguccauguugaggaggugguacacuuggaaaaucagauuaaauacuccuuuaauauuuaauuaacucucuuuagcucacuccaggcagugagcaucugcauaaaggugaggugagguuacagaacaucucuggaaguucaugugagaaagaggagacagggcuagaguggucaggagaggcucgauggauggccuagagcuucagcagaucccuaaguccuguuuccugcacugccaaugauuauuauuggccuacugcugaguucuaagaacaggggcaagcuacaguuuagggcacauuaucucuuaguuaucccaggccugagugcuaugguugggauaguuugaugauacguguuuacacaucugcacgugugcaugugugcauaauuuuuugcuaccuucuuccuugacacuaucucuuguuuauuuuauuagauauuacuuaccaccuucuaucacauuguauaauuuacuugcuucuuuuacuaucuuuucccccucuucagaauauaaaguucauggaggcagagauucuugucuguuucagucccugucauauccucagcaccuaggacacugccuagaucagagugggcauuuaaucaauagagaccguuucccuaaacaggaaaauauugagaggccgucugagaaaccuaguaucuaccagucuacuauucaauguucuguggccaguagaacagcaaauuauuaaguugcaugauccuauaguucuguccccagguccccaagaagauagguccaagaacaguuuuucuucaaagguaucuuguuauguugucccugcugcuucugaaccaugggaauaacaaaaugacaguguuagcaccauguuggcaucauuuggaacuaggaaagcagcccgguuggcauuucacuaacuaguguccucuccuguagaaguucucagcaugcugaugagaaccuggcccuguguacgcuauagccaguuagauggcccuaucguuguggggguguuucugaugaauugaaauucauucccucaucuuguucugcugcuuccacaacugccauccuauugauucaaaagagacugagaauaugaccuccugaguuucagugucuaacauuguguuucuuggaaggcuguuguuucuauuccacuuguuauguaccuuuuaaauggcaaaaaguuauaccguugccuugcuagccuuggcuauacaguacauauucugggucuuccagagcaggauuucucaggauucuuagacuaagaauugugugauaauaaugauggcugcaguuauuuuauuuauuuguuuauguauuuauuuauuuuugugagauggaguuucgcucuuguuguccaggcuggagugcaguggcucaaucucggcucacugcaaccuccaccucccagguucaagcaauuccccugccccagccucccaaguagcugggauuacaggcgcgagccaccacacccagcuaauuuuuuguauuuuuaguagaaaugggguuucaccauguuggccaggcuggucucaaacuccuugccucaagcauuccaccugccucggccucccaaagugcugggguuacaggcgugugccacugcccccagccuagccgcaguuaauugggccgugaucaccaaguauucaccuauuucuucagcucaugcagguguccguguugaaggcuagggggcaugaggauacaaagcaaacuauaugaaacaaaaggccaguagaaucugcugaaagcuaaguaguauagggccaacccagauccaagauucagaucagccauugggagcuucuucccugucaaaucucacuggucccugcuaccagugaauuaggaugaaucacucuucugaauuauguuaguaggcacuuaauguuuaccaaugcuguuacgugcuucauaguaaauuaucugauuuaauacauacaacaacccuauuuuuauuuucacuguuacccuuauuuugcuggugaggaaacuuuguccagucgucuguguccguaucaacucuggaacuauucagggccuggacugcauagccaugcaugguggcccugagaugcgcagaacuagggcuagccugagccacuuugcuccaccuuucagugucaggauuggcaggaauguuuaaauagagucauguaaggcuagaguccggguuucucacagggauuugagcuucugugugaagguaugugaaaccccuggauaaauaugacacaucuuagcuugaccauuuuaccucacuuucauccaugcuuacguccagagugccugucccuuaugaaacucugccugcuccauuuugaaagagguaaguggggcucuccugcuuuccccgccucuguagaauacauagagagaggagagcugcagaagaguaaaccacuggacaacuuuugggaggcauuagguaugaguacccaaguagaagcacugacuucucuguccccugaauuuucugcacacauagaaagugucaccugagaugagaguugaggguacagggaugaugagagcaugcagcaugcuggcggguucacugauugcugcucuuauuaugguucuaaggcaguguuaaauuagccaauuaauaaaaaugaacacaccauuggaagcuacauuugugugggguuuuuuguuguuguuauuaaacuggcuaauuuaacaccauccuagagugguagugaugguaauagcagcagcccacgaguucagaagaaggugggggugauucccucccaagcuuucccaggcauugcugugugcucuaugucuuuacucugugaggaaacgggauaaacaauagcuagacguccgcuggcagucuugggacucugcagugugcuagccagaucccuaucaucauggcuauaccacuuaggaguguuucccuggcagacugcauugcagucauuuuuauauacacauuccuacacauguagcugucuauguaugucuucaucccuggguaccauucuauucuaacaguggcuuuccauuugacucagagugcaagcuggguucuuacuguggccuggaaguguggccugucuucccuguguuuuguuuccucucucugaccucaucuccugcucuucccacuucacugccucuacuccuguguuggggccuuugcacucucuucuggauauccuuagguucaguccuucuacuacuucagaucuuuggucaaaugcuacuuucucaauaaauguuucuccaaccguccucuuuaaaaucgcaaaacuaccccauucccucucccucuuccauagcacugucaccauccaacaugguaugcauuuuacuggcuugucugucucucuccaccaggauguuaaauugcgagaaggugaggauuuuggucuguuuuguucauugcuauguauaucuccccagcauguagaacaaugccuggcacaugguaggcacuugauacauauuuguugaaugaauuggcucuaguagccaugguauuccccuaugauauggaaaucuauguuguaucaguuuucauuucacucauuacuggguaaacaucacccagcagaagaguucauugauguucccucugguuccccuguugccucucgucugcuaucuauucuugcccagguggaaaagaaggaaguggaaacagaucuguucuucuagcugcuggccauucgucucuggaacuuaccggguggcaagaccaaucuagcagcaccucugcuucugucgcugcuuucccaggcucacauuacaauaucuaggccaauauuaucauugcugucacagacacccuguuuuucuuaagcuucuaaaauggauucucauugcuaauuuccuagcacgauggugggcauaggcaguaccuaagacagauaguaagugcaucgugugggacuacccgcauucacuuuauugguccuuccucacuaaaugccauuagcagcacaccgucccaccccagcuauugccacaaccaaaaaugacacccagcccacacaaaacguacacauuagaaaacacucuuuggagguugauacuguuccuccuugcagaucuccaaucucugguagaagaaagcaagcauugaauuacagucaucuagaaaaggguggagugcagaaguuuugcugagcauugagucuccaccugagguuaaguaaugaugaauaauuaauaaagugcaaucagccugguuauaugagguucuccauucagcuauauucuguagcccuaggcuuaucaguagcugagaaaauagacauuaaaucuguauccaccaugauuccuuuguguugauguaggaagaacaaauggaccagguugcaaucuauauucagaucuucccuguguuguauuuuaggagagagauuaggaccagacugagagucuuuaagggauuauaucaggugcugcagugcuacagugaaauugaaaugaaaacucaacuucugugaguuucaauacuauucugccagcugcccagaaacauccugggauaaagcuuaggggaaucccaagagaaguuuggucuugggagaagaauuuuuuaguaccaaauguguccauuccucuccaccuggacuugggagguguaggcacaucucuggcagagggugccucaaacccuaacaaagucagcuuuccuucuuccugccaagagagggcauuaauuaaauacagcccuaucauuuuggacaguguaaauucacucguauguggguccacuguauguuuuuccacagcccuagcauuuuauccugauuguuacuaaauguauaaauaauguaaaauauauacacaccugcuucacaaaauuaaaacuacaauacuugguuaacuuaggaagaucuaguuguaauauauuacauaaguguauuuucuaaaagaaucaaugaggauuuuuuucauacaguaacuacaaaugguguuuacuuacauauuuucuucuuuacaaauaaagcuguaugauaguaagaucuagauccaggcaucuuuauuccgagccacuugaaaagcaagcugaaacuugagaacagaagaaaccuuaggaugauagcacaacaaauaaaauuaaauucuuugauuaaguguuugccacuguaaaaaacacgugcaaaagcacucauuuucaagagaggagggaagaaagcagaaccuaaacccaaaacaaccaaaauuuaaauacuacuuuugccaugugaaauugucuaaucagccucauuuucuucuauugccgucaucagcuucuguuuguucugaugcuucauuuuuaguaucguugugggcuuaugaaagcagaaagauugccugaguuggaacaagcuuuucuaccauuuccuauguguccauucucaaccagaauaaaucagugcaaaugccaguguccacucccucgccagaccuuugagaccuaguuggaagaaaaaggguauauuuuaucaagcuacgugaaaaucaacaggacacccuccugcaacaacagaguugcccuuuguuggccgaagcgccucuuaucauuaccugugagagcugauuggccugaaugcucucagcaccugcccugugcaucacgugaucggauccuauaaguauccuaagaucauauugcacaacucuuagaaaugagugagagaauuuaaagguagaacagcuacauugguacacauaauuuaugccuuuucuugagguuacuaaaaagaaaaaguauuccagagaguucuaauauaaagcugaggaacucuuuguauaagggaguaugauguguucucucucugcuuggaauugcugugcuggaaggaagauggggaaagggaaugaauauagucaaauaaauuaagccuugaaacccaaauagugcuguguaagcaaacugacugcaaaucaaacagaggaguguuagcaaaagaauacacgaucuugguugaggcugaacaaaaccagguucuuuguauauacguauauauuucucuggacgugugcagaguuguugcauuucuacucccuuaaucucagacaucuuuggcaaaauguguuaucuguccaugaagaagaaaacugaagaguguauuucccccaaauggcaaagcguaggcuuuaucaaauguagacaugccuguuggcaacagaaagcaggauguguauggcuuuucugucuuuaggaaugcccauguuuccuauguuucuuaccauuuuucuggcuagcauauaaaucugaaagguuagguuauggugugggucauaaccaucaggcccagucuauucuccauccccacucugcaggcagcucugacacuauuucuggagcaagcauugaaaacuauccgacugucugguuuuguagaugaggaaacagcacaaagaaauggaguggcauugucauaguuacagacugugugaguggcaaaacagaggcuucauccacuggacuuucagcucuacaacuugcaaucaggcauaacauguucuuaacuugccuuuuugaaaugacaccucucugagccaaagcuucucuaagcaucaguucaaaugacuccaugaucucuuagagucuguaaaaaacuugagaguagaacauauuuucuuccuucuuagaaccucaagucaaaucaacaauuacuuuauauuuauugugaugaucgcauucuguuugaucuauuuuucucuaaguuguuaaacagccuuuggcuaaaaucauuauguucugaccugaacaaggagauuggggcagcucuauucuaagcugugugaaaaugcaaagcaugggcagggugcagcaaguuguucacuuuggauggaauguggaugguggcugaguacccagagauaagacuagagcggcauauuucuuuucuuuuuuuuuuuuuaauuauacuuuaaguuuuaggguacaugugcacauugugcagguuaguuacauauguauacaugugccaugcuggugcgcugcacccacuaacucgucaucuagcauuagguauaucucccaaugcuaucccuccccccuccccgccgccaccacaguccccagagugugauauuccccuuccuguguccaugugaucucauuguucaauucccaccuaugagugagaauaugcgguguuugguuuuuuguucuugcgauaguuuacugagaaugaugguuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauaaugccgcaauaaacauacgugugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugauaucucauagugguuuugauuugcauuucucugauggccagugaugaugagcauuuuuccauguguguuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcaaaaauuuucucccauguuauagguugccuguucacucugaugguaguuucuuuugcugugcagaagcucuugaguuuaauuagaucccauuugucaauuuuggcuuuuguugccauugcuuuugguguuuuggacaugaaguccuugcccacgccuauguccugaaugguaaugccuagguuuucuucuaggguuuuuaugguuuuaggucuaacguuuaaaucuuuaauccaucuugaauugauuuuuguauaagguguaaggaagggauccaguuucagcuuucuacauauggcuagccaauuuucccagcaccauuuauuaaauagggaauccuuuccccauugcuuguuuuucucagguuugucaaagaucagauaguuguagguaagcggcguuauuucugagggcccuguucuguuccauugaucuauaucucuguuuugguaccaguaccaugcuguuuugguuaccguagccuuguaguauaguuugaagucagguagcgugaugccuccagcuuuguucuuuuggcuuaggauugacuuggcuaugcgggcuguuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguauccucuuuuauuuccuugagcagugguuuguaguucuccuugaagagguccuucacaucccuuguaaguuagauuccuagguauuuuauucucuuugaagcaauugugaaugggaguucacucaugauuuggcucucuguuugucuguuguugguguauaggaaugcuugugauuuuuguacauugauuuuguauccugagacuuugcugaaguugcuuaucagcuuaaggagauuuugggcugagacgaugggguuuucuagauaaacaaucaugucgucugcaaacagggacaauuugacuuccucuuuuccuaauugaauacccuuuauuuccuucuccugccugauugcccuggccagaacuuccaacacuauguugaauaggagcggugagagagggcaucccugucuugugccaguuuucaaagggaaugcuuccaguuuuugcccauucaguaugauauuggcuguggguuugccauagauagcucuuauuauuuugaaauacgucccaucaauaccuaauuuauugagaguuuuuagcaugaaggguuguugaauuuugucaaaggcuuuuucugcaucuauugagauaaucauguggcuuuugucuuuggcucuguuuauaugcuggauuacauuuauugauuugcauauauugaaccagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuugguugugucucugcccggcuuugguaucagaaugaugcuggccucauaaaaugaguuagggaggauucccucuuuuucuauugauuggaauaguuucagaaggaaugguaccaguuccuccuuguaccucugguagaauucggcugugaauccaucugguccuggacucuuuuugguugguaaacuauugauuauugccacaauuucagcuccuguuauuggucuauucagagauucaacuucuuccugguuuagucuugggagaguguaugugucgaggaauguauccauuucuucuagauuuucuaguuuauuugcguagagguguuuguaguauucucugaugguaguuuguauuucugugggaucaguggugauauccccuuuaucauuuuuuauugugucuauuugauucuucucucuuuuuuucuuuauuagucuugcuagcggucuaucaauuuuguugauccuuucaaaagcagguccugagugaccuacaaagagccuuagacucccacacauuaauaaugggauacuuuaacaccccacugucaacauuagacagaucaacgagacagaaagucaacaaggauacccaggaauugaacucagcucugcaccaagcggaccuaauagacaucuacagaacucuccaccccagaucaacagaauauacauuuuuuucagcaccacaccacaccuauuccaaaauugaccacauaguuggaaguaaagcucuccucagcaaacguaaaagaacagaaauuauaacaaacuaucucucagaccacagugcaaucaaacuagaacucaggauuaagaaucucacucaaagccgcucaacuacauggaaacugaacaaccugcuccugaaugacuacuggguacauaacgaaaugaaggcagaaauaaagauguucuuugaaaccaacgagaacaaagacacaacauaccagaaucucugggacacauucaaagcaguguguagagggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaaaucaaugaauccaggagcugguuuuuugaaaggaucaacaaaauugauagagcggcauauuucuaacggggcacuaguggcauuuggguggaacauuuccuccuuguggaggacuucccaugaauugcaggauguuuaccccuuagcuucccuucccaaauccuguagcacccuucugcaaucagaaacacugagaaccucagucagucacccucgguuucccccaugcucccaguggguguugcacagucauuagaucuguugguugguuggugagagugcuggagaaggcagaaggucgaaacggaggcaauacugaaagcauaguucuccugguuuaggagcuagcacucucuuucucaguaggaucaguauuuauugacauggaauccagagagaaaacucucaugccaccuugaugcuucaugcacaaguucguggcagggauggggguggugggaaaaaauguguuugcugaaaucacgauggagcaaaucagcaaggaauguaauuucugcuuucauguaacuaucacuuguugccauccaugcuguaucuuucagggagcaugaauaacuauggcuugauguacucccuuccugauuucccagcuguugucuguucuucaugcuucacaaacuucagccagaaacauguccuaagaucuaggagaugcaagccuuuucuuccuacucagcacccuacccuugcuggcuuauccucacuccugccaugcucuuuagaauccaaaguauucucuaauuguguuguauauauuuauccauauucaguuuuucucgauauacccugcuuuuacauuaguauacgguuacugugcauuugccaggaaacuauaguugcuaaaaaauauuuccaagagauaucuguugacguuggugaggucauuagcucucucaucaccaguguggccaccuuuaagcccuggcucggaccaugauuaaauaugcuaaaacucaucaggaagauuauccucuguaaguauuaauuuauauaauaacacguacuucucaggguguuuuacucuauguauuucccccuggaugcuuauuacaaugcugugggguaggaaggguugcucuuaccuccauuuaacaagugagaacacuaaggcucugcgagguuauuaauuggccagggucacacagcuuuaauuagggauggaccuggcacuuaccacuccaccauuuccucucucuccuuuucagggacugagggagaagaccaauuugauuuguccucuuuagaugucagaacaauguugcuuuuuuucaaagaauauuuuaagcuuuucaguuucaaucuuccauugagacaaguucuuuauccuucugcuggcaaauugugaccuccugucaaucaaauaucucuguccccuuucaaugacucuacauuggguuuugaaauuugucucaguaacacagagaucugcagucuguguugucugauauauguauguaauguugggaaaagccauuuccacaauaguaggaaguuaaaagauuuuuguaaaguggggaugaauuauaaaauaguccacuuuuuacucuucuagcucccauugaguuucuuuuuguaagguuugauuagacaucgacagagggaagaagaaugcugggauaaugguucucagaucacaauuuaaauuaaaaccaaaucugguugauauugugaaauguuauguucauauaguuugcacacagagucugaauaauuaccuuuuucgaugucuaagaaauuauaacagaacuuguuggaggaaagagcacacaggaugcaauuguguuucacaaagccaguuccuuuucuggcuuagaaucaagaguagcaggaagacuggcuugugcucucccaagcauaacacaacagauccaacaucuccugaacugggcugugguucucagaagaaaaucaagggcccuggcagggcacauauaguuuguuuuugcccccaacuccccaaauccuuggcuuccuucuauuguaaacaucuggagcagaaucagcaaccgcccccacaguugugcuugagguaugguccucugggcagcuuuuacucagucuuuacgacucaacuccauccagaguugccuccugcacguccuucucuaccuccucuguguucacccaccaucuuuugcugccucugcuauugccuaguccacuaccuaguaacuguuccuuugccuggaguuuugacacuggcaacacaguggaaguaaauaguuggugguggguagguggguucugaguccugaggaagaggauuacaguagaauguacauuucucugguuagucauuacgggugccuugaaccugggaagggaggaagguauaccgagcugcuuccaccacauguccaagcagaaccagcuagcccgcuuucuguccccucaaacacuagugcaguaacgugcuguaugggaagaaguaaaugauuuaauauacagaugccugguuucugauccuggcuccauucgcucguauacaaaaugagaaaguuauacaauaagaacuccagcuuuaggcugggcgcagugacucacgccuguaaucccagcacuuugggaggccgaggcgggcagaucacgaggucaggagaucgagaccagccuggcuaacauggugaaaucccgucucuacuaaaaauacaagaauuagccaggcaugguggcgggcacguguaguccuagcuacuuacucgggaggcugaggcaggagaauagugugaacccgggaggcggagcuugcagugagcugagaucgcaccacugcauuccauccugggcagcagagcaagacuccgucucaaaaacaaaacaaaacaaaaaaaacuccagcuuuguaaauucagugauauauuccuuuuugagggaugcacuuuacuguauucauuucacaugugaauuuuagaaucacaggaacagucucaaauucuggauaugcccuuuauaauccccgugaucuaggacaacuugcuuaaccuaucuuugccuuaguuuaucuucuauaaauuagaguuucucuaaguauuaccuagcaugaugccuuuauuuaaaaagugcuugauccagugcccuacgcagcagaaggguaauuucacauuguagucauuauuguuaugugaguuucuucuccaguagucuauauagucacuuguuguacuuuaaaaaacuuuuaauuguaugugaaccuaguuuugauaauacagcuauuuccuauguuuuuuuaaagucuaucauagucuaucagauuaucuguucacuugggaaaagacaucuaaaaacagaauuccuuuggauaaaucagguaaccuaaguaauauaaaguucauucaaccugaacugacaggauacaguggaaagaacaacugcccaucaaaagauaggguuuauaagcugcauuuuauugccaaguugccaugugaccuuguguaagucauugaacuucucuuauuuccaguaacguccucuguaaaaauaaggaguuuggacucgauuucuaagguucuuucuccagcuauaacauuuugugauucugugaaugcuuaggugauacaugaagaugucuuugcugucacugucuuuuccuuuuuaggcagggaaacuaggaaagauaggcagugugauuuucuuucucaaguuuuuuuuuaaguucugcgugucacagaaugguagucaaacacauauuuucuagguccuuuauacaugaacuuguaugaaaguauaucacagucucucauuuucuguugagcacuugcuguuaaucccuuuucaauuuuaucuugguaacuuuaaccccugauucuugccugauugaguuuguauguuuguccucucaugugauauguauauuaaauacauacaucugcaaugccuucaccucagcuguuaauaaaaauccugauuagggccagguaugguggcucaugccuauaaucccagcacuuugggaggccugggugagaggaucacuugagcccaggaguuugagaccagccugggcaacaaagcgagacccugucucuauaaauaaauaaauaaauaaauguuuuaaaaaauaaaaauccugauaaggccccaguguggauugccaucaccugaucgucuuuacaggaccacaaaagcagugaauucaaauacucagauuuauucauucuuucaacaaucuuuaaugagcuucuucccagccccaagccacccuuugcagacugauuguuuugcuggaguucagcacagaguuauuucgaugucacuuuucccuguggcucaguuucuuugcuguugggguggucaccaaccauuuuacaaaucuuagaaggcuauaggcuuucucccuagaaaaugccagauagaugaagaaagaaaaagguuuguaaccagcaaaggaaggagagagggcugugaaaaagcaucguuauucagaaggauaaauaguuuauuauggcugucaugucugcuagaagagggacagugguuaaagguaaguuuggaaagucagauaucccagucuuagaagggccuugugucugugcaagguuguuuagauuguaccacauagaucaguuguuggugacgcugagucuuagacauucucaguaaauaaugaaucugaagaguacaagguaaucuucucuucagaaaauacauacaaagauguucauauaauuucacuggguuuacaaacaccagccucucuccccuaagcccauucuugaccccuaguuuaggaacuccuaagguaaguuaucagaagcaaugaaagauaggugauacauugucauuaaaauaaauuuaaaugugacuuauauacaauaaaguacacaagucguaaguauacagcuugcugaauuaauuuuuuuuuuuuuuuuuuugauucggagucucacucugucgcccaggcuggagugcaguggugcgaucucagcucacugcaaccucugccuccuggguucaagcaauucuccugccucagccucccaaguaacugggauuacaggugcaugccaccacgcccagcuaacuuuuuuguuuuuuuaguagagaccagguuucaccguguugcccaggcuggucucgaacuccugagcucagacaguccacccgccucggccucccaaagugcuaggauuauaggcgugagccaccacgccuggccagcuugaugaauuuuuauauaugaauguaauuucaaguaaacaccauacaugaagauaugaaguauuucuaacacuccacaggacccuccuggugcuccccucaaagauaaccaguauccuuuccgaccucggucaucauagauuaguuuugucuaguuuuuagguuuuuugcagggggcggugagggggguuguuuuguuuuguugagacagagccuugcacugucaccaagcuggagugcaguggcacaaucuuggcucacugcaaccucugccucccaagcucaagugauccuccugccucagccucccaaguagcugggacuauagguucaugucacaccaugcuaauuuuuauauuuuuuauagagacggguuucgccauguuggccaggcuggucucaagcuccugggaucaagugauccccugucuuggccucaugaagugcugggauuacaggugugagccacagcaccuggcccuaucuuugaacuucagaaauggaaucacaaucuuaguuuaccuuuuuuucuugagacagagucuugcucugucacccaggggcccaaucucugcucgccgcaaccucugcccucuggguucaagcaauuauccuaccucagccucccuaguggcugggauuacagguaugcacuaucacaccuggcuaauuuuuguauuuuuaguagagacaggguuucaccguguuggccaagcuggucucgaacucuugaccucaagagauccaccugucuuggccucccaaaguguugggauuacaggcaugagccaccgcaccuggccauuuuacccaacuguugucuaugagauucauccauguuacuggauguagcagaaagucaucuuuuuucauugcauuauguaauuuucaaagaucccuuugacugcuguauggagacaagauuggagagggcccaaaugaggugaggaagucuggcugggaggugguugccaugugucugagaagaggugugcagccugccuaggccgcagagugggaaugaagaggaaggagcagcccuguuuaaggaggcuuuaaaccugguuggugcuuugauaguagagcaugaggaagagagaggucaguuuucuggcuuguuaauaacacaagguuugaugaggucaguuuugacaacuuggauguuagaugacugugaguguuugcagguccagaugaauucaauagaaaugucagaaauggagauuaaaacuuugagagucaucagcuuauaguggaauuggaagcacagagagcaaaugauugccuagggacuggauuuggagugggaagcagcuaagaacagaccauugugauguucggaggcuucugaacugucagaaaagaggaucugacagcagaggcuuagauugagaagagguaggaagggcacuaggaggaagggcaaacaaagcagccaagccaagggcagaggaguggguuagaacugucaaaugucaaugauuugggaagaggaggcuuugaagcuaccugaggugagguggucucuaacaucucuccucuucccagccacacccauucacugcuccuguucaccaaccucauucuuuugguucugcucuaccuauagcuuuguacugugucauaucuaugugugugccuaucuuccacaaugaccuguguggauucuugaaggagagacaccauauuacucccccuucucauuccuuuccaaaauuuagcagagcugaccuuuuauguauuaaguggucacuauguccaaauugccuuuguuucuaaagcagcccugaauugaguggccuucccuggccugaccaccugaaccucugugggggcugucuugcuaaggaagcuuguguacagccuggcuauguuucugccuuuugucaggggacagggagguugaaaacccagcucugcagagucucaguagcagcagacaguacugccucucugggagugcuacugucuuccagcaagcuagguggcuucuucacuuacauaagauguguguguucuggcagggaagagcugccugagugaguguuuagcaaaaaugauuuguguggaguuauuuugagaccccagggaagggaauggcagccaaagccugcaguauuuuaaaccacaucacucauccacaaagauuuaauacgauacagcaucucagcuagaauauuggugaagagaaguaagaauguuagggucccaucagauuauaaaugcccguuaucuccauccacgcaaggugaauuuggagugguuuggaucaaacuugguacuugaagauucguucaugcuccuucuuugaucuugucugcccuggaaauaccaaauagaagacagaguugcuugcugggggguuggccugggcucccuuuggagcagcgauuucauugcccucucucauucacuaccucgggagccauuugguuuccaaggagauacagaaaugagcccacuuuuuaugccgguccaaaauacugacauuauuuaggugauugagcuucuucagauuccaggcugucuaggagaauuccccuuccaaagcauucaccuuuccuccugacucaggcaugaacagcugucugcuaagggugggugaauucaagaauauaggauuuuccaguuuagugacauuaggggagacagccuccauaugaaacacuucucuuguuuuuguuuuucucuuggcuguuaggcugugaaauuugccucaccgcucccccgcccuuuugcugacagcuguccucuuugccauucaggagcuggugucucccuaggaugguugacugagaaagaaaaggccaucuuccuuuguccccugggucuugaguuguauugcugaagagcaucuugugucaggagaucuaauugccuucagaccuggggggauccauuugggccagagaguguccaggcacuuugugaauugcagagggaguuacccaaagagaaaaagcccuauuugugacuggccacuugauuuuguuuguuuuguuuuauauuuuuagaggacauacaauuucuuuaaugauaaaaacuaugaaaaccaaaauacauuguuacacaaaagaggcacacacaaaccauacagcuuuucagacuccccaaauuucccuacaaggacgugcagcgcaucguuuuuccauuaauuuagguguuuuugagcaggccacuuguuuacaccccaguauugaguugaguguaguagggagacacucaggagaagcauuacuuguguuuguaugugugggcgcgcgcgcaugugcgcacgcgcguguguaugugagagauugacuccccucguguguguguguguguguguaagagagauugacuccccucguguguguguguguguguguguguguguguguguaagagagauugacuccccucugcuugcaccccagagcagccagcaaucagaguaaaaggcuucagcuaaguuucuuucugcuugugauacuacacaagaauggccugacagagagcaggauuaagauaugguggagagggaacaaggaaccaaagugagugaaaaggcacaaacaagccagcaucuaccaaagucggcaggauggacaaagggagcagagcaggcagccagccuggggcuuuggaagacaugugaagggugugaggcuggcagaucacuacagaagggguggcuccucucuuuugcccuggcaugagacuuucuucugugcgcuguagcgccgagcacgcuaccccguucuucucucugcuccacuccacucugacacccccacagaggugcucauggcuguuaguaggcagguccggcuccauucagcauucuuccuacguucuucccaaauaccaguuucugauuugggucauugugacaguugcuaugucccaccaugggcuuauacaugagaguucagcccucagagauggccacugugguuuccuuagccccuccuccacccuguucuccuuuccucucuuauuccccacccuauuuccuugggugagugagcacagacaagugcacaagcucacacacaccccuuggcugucacaggcaccaggaacccuggucggggaaugugcuuuguggagagcuguguucaggaaguuuacuccuccucuccguaaucaguccucgccacucccuccccugccccacccuuauuagaaauccugauuucuggcaagcuucccauccuggugcuguccuucuuuugugcggagcacacuggagcagcuuuccucucccuggaagacaggcacagccugauggcacaaguuaauaccuccugcauggcugcaaaaauaaagaccagaugcgggucuguuggguaccugauuuucucccucacugcccuccuucuuuucaacugaagcuuuguguccagcaugacaguugaaauccuggugcuuuggugcacuguugccacacugugacaggggcuaaaaagcuuccguugagugcacugcugugccuucccuguccacuggccacaguggugacugaaauacucaugucugcaauguugcaucaguggaaaguaaaggaugcagaaguccuuuucuuucccucaggucucccaaccagggaaaaucaucacuucaguagaacaaucuuucccugaauucugcaaagugaauucugggcagugguuuggauuugcuguuccuuuuuaucccuuaaagcccagugaaugagagaaggaaaugaauagacugcuugucacaacaccaccagggucuccacagugccuggggcugcugcugagagacagagaaugaaagcuggaauggaggccguggaggcaggaaaccuuugcugggacaggcuccaccuccccuacauggugucuugagggcuucccauuuccuucagucuggggauuccgcccgcacuaauggagcugucucuugcugcagcaugcuuccuggaggaaaaguccaacucugccuggccacacagagagaagacugauaugcagucucuccacaccccucccccguuuauccaacaaagcagcacauuucacugcgaacgcuuccggagucggcucucaacagugcagaaaaagggaugcucccuguugcacacuccaccacccccauuggacguuuuuaauuaaaucaacuagaaagauauuuucaguuugaagauucacuucaucuuauguagguuuaaagaagaaagaaaaagaguagaaugguaagaaaucaaaauucacgucucaugaggaccuuagaaauguucaacccagagaaaauaagacuugagaaugagaagaaauagauguugcaagucucuucaaauauuugaaaaggugucaaauggguaaugcauguuuuauaugguccgaaggaauuggaccagaucuuagaaggccuaggaugucagauuguggaguucugauuuuguuuggaagcaaauaaaaaaaaaagaaaauaagaagcagaacauuguguuuuaggaagauuaaucugguagcugauuaaucugguaguagauuaagcugguaguguguauaaagaauaguaugguauaaagaauaguaugguauaaaguauaaagaauaguagauuaagcugguaguguguauaaagaauaaguauagggaaaaaucgagggcaggcacagguagaucgaucagaagauucuuggccacaagugacaagagccugacaaacagagguaugcugaagauucagaggaauaacuauagaagggaaaauaauggaaucaagaggauguagcaaucacuggguuauguggauagaguagggaagaagauaagagagguuuucagcccaagaggauggucaugcuggagccagaauggggaacucuggaagaggaggagguagguggcagagguuuaggaggaagaagaugaguuugguuuuaagacauguugaguuugaggucuuggcaggacauccaaggggagacgugggcaguuguuagauguuuggcaauuggguauagagccaggauuacaugucugaguucugcaugaucacagugaauggagaaggugagaauggauagaccugccaaaggauagugcagagagaaaaaaagggcccagugcaugacugagggcaacaguaagaaacaaaacaagcagccagagagauaggacaccuagaagacagaagcaucaaggaagaaaggaucucacuaagggguuggcgcucagugguaaauaccauagaacaaucuaguaggacuucuaacuaucauuuaguugaaagauaaagucuaaggacaacaucuuaggagcaaaggacuucuucacaagaaauguaauggugagcagauuggucaggaaguggagagaagcaguuauaaugaagaacagaguggcaacucuggcauuuucaagguuugagcuuauggaaaguaugcuuugaauggggaaauaugcaucugugggaggacagugggaauaaaauagaaugaucagacguacaggaaaguggacauucauagaacagggcucaggagagaaagguuaagggcacauaccugugguuaaugucagcugccucuggccauuuccccuaagccauguuuucauuccuuuuaccuucuaggucacaugaccauaagguuuuuuaaauauuauuuuuauuuauuauaauuuaacauuuuaugcugucaccuguacugauaacuaaacaucagguuuaguuacccuguacuaucagguucaagcgauucuccugcgucagccugccgaguagcugggauuacaggcgcacaccaccacgccuggccaauuuuuguauuuuuaguagaggugggguuucaccauguuggccaggcuggucuugaacuccugaccucaggugauccacccaccucagccucccaaagugcugggauuacagacgugagccaccacaccuggccgccuguauuuuuuuuuaaaccaccaugcaacaugcuucagagcguguuggcgagcuuuuucuagaaaggggcaaauaguaaauaucuuagucuuugugggccuuaugaucuuuguuacaaauauucaugguacaacucuagcccuguacuaugaaagcagucauagacagcaaauacauguggccauguucuaauaagacuucauuuauugacacugaaauuugaauuucauagucuucacauuguuggaaauaaauuuucaguguggcaaaagaaacagcacucgaacauaaauuuucucagcaaggcaauuuuacuucuguagaagggugcgacucacggauggagcaauggcgagagcacacuugaacgagggaggggaaggggcagguagccccuauugcugugucguuucccuaucggcuaggguuggaccacacacucuaagcuaauucugauuggcucuuuuaaagagagcagggguacgagcuggaguggcagggugaguaguuuggcaggaagggcaguuacagaacaggugacucuggaugaauaagaacagagcaggugaccaaggaugacuaagaucagagcaggugauagaggcuaggaggggguuguuuacugaaacuaggggcaaggagacauaaagaacgaggaaguuaaacuuuaaaaugaagaacaaagaacaggggagcugaacauacugauauauugguucuuuggaaaggaccucagaacucauuguacuuaacaauuuacaggcuaaaaccuuugaagaggaauuuauuauauccuauaacaugucacaaauauucuucuucugauuuuugucuuaaccauucaaaaauguaaaaaucauucuuagcucaugagcucuguaaaaucagugggcagacuuagucuucaggaaguugucuguuguucccugcuuuagaguaugguaacuaaaaaauaaauagaugaauaaggcaaaugccauucuugacccacagcuggcccaggauucaagcuacucaggauaggauauauguagcuuggccugugcucuuggagaaccuugacuuuucacaauuccuuucccuuuuugcuugcuuuauuuuauuuuauuuuauucuuuuucuuuuuuuuuuuuuuuuuuuuugagacggagucucgcucugucgcccaggcuggagugcaguggcgcaaucucggcucacugcaugcuccgccucccggguucacgccauucuccugccucagccucccaaguagcugggacuacaggcgcccgccacuacgcccggcuaauuuuuuuuuuuuuuguauuuuuaguagagacgggguuucaccguuuuagccgggauggucucgaucuccugaccucgugauccgcccgccucggccucccaaagugcugggauuacaggcgugagccaccgcgcccggccucuuuuucuuuaaaguaaaguuagugaggugaaggacucuugcuaagaguuucucagcccagagguuuuuuuuauucaugcucuuugguucuuaagucuuaauauuccugacacuagcugguuuuuccuccucauccuacuguaggcuaaguauacuaaucucuagacauuuggaauucacuugccucaggaggaggagcucagagcaauuuuauuugagugaaagcucaaaaaaggcaauaguuuagaaguacacuccacacaucucagaaccauuuuguucaaauaaaacagcuuggucuagaaaaagucacucuaaauuuaugcaaguaaguagcuuuuacauuuggcugccaggugugugccagaauaccucauggaaguggagacuugcaagauccauagggguauuuccuguggcuuucucuucaccuuguagcaaaucucuagcaaccuggacaguagauucaaauuuuucucuuuaucaauuaacauggaauaaaaaagaccaagaauaggaaccuuuggugccaaaaaucaaaagggaggaaaauauguuuuauuugauuuaaagauaaaguccuauugcuuuaaaauaagucagaagaaauaaaaguugagguucucauagaaaccaacuccuccuccuugcucagacguagcauuugugccuguuagaugcugucugcacagugccacuguguuacauaaaagcuugagccauguaggagcuuucuugucauucagaacacugcagcucuagcuuuugaccucagauacuuuguuuucugugaauuuguuaaugaagguaugagguuguuguuuugguauggauaauaaagagaaacccaggaaaaaaaaaaaauuuuugaaaggcacaggucucucccaugcccaguuguucuuucugcuaguagcugauggugacauuauugcagcugcugcuuauagcaauccccaaaaaugaacaugggcauugggaagcggacagccugcgaucuccaguccccuucccaaacacaccuccagagacagccuggugagguggguuacagccugcucuugggaugccacagaaagggaaaggccucguuaaucagugagaggguuuuuuuuuucuccccuuaaaaaucauuguuuucagaucuugcuuugcaauggggagaauuauaaaagguuauucccaugcuggccugauuguuaucuucuguaccagcuccaucuaaaaaugcuuuuuucccauuugggagagauuguguggugucuaaagcuaacaauaaaucaaauucagugaagcugguuuuguacauugccuggcuagacugagagcaagauauucaguauaaggccucuaagucaucccuuccuugccucuuccacuggcuguggucaaugauugagcauuuaaccacacacucaccuuuaaguccugagaauaaguaguacuagaauuccucaucaauacuccacagguuaacucauaugcauccagaacucuuggaaaagcagguuguuguaacagguuugguguaucuguuauugcuagauuuucuccucucuggcauucauguagcaaacugaauuauugagcaucuucuguuugccagauaccggggauguagagagaaguggcauaucccuuaccucaaaugacuguagaagagggaucuaccauuaacaggcgaacaacuauuaugacuuguaucagaaacuuaaggcauguuuaacagccaagcaccgcacuuccugucuguagaugcuucucuucucuuccccuuccuuucuucaaagagagcugcaguuuccauugcauugugaagacuugguuuucuuguuccaauuccaaauuaacuucagugccuggucuuucaacaaaugcaucaaacauuacaaaauccgaacaaccuaauaaaagucuauccuaaaaaauuggagcugugacuaaaaacagcuucagucucagcuucugcccaguucugacuccccugacuacaauuagguauuugaucccuuuaauuaggaucccuucauucuucuuuuaucccuuuauucugaucauugaaagagcuuuagcagugacauguuccaaaauugguccacaagauccuaccuccccugagguaacaaaguaggaguuuagagaacaagggagagaauaaagaauuugagagaaugcaaaaucuuuguuuuacuucuaaaccuuuuaguacaaacuguagccucauaucaugaagaacgaacucuugggaaccaacuggucugccauuucccuuuuucuuugggccauuuuaggaauguggaaauauacgcccuaagugagauggugugcaguuuucaauagugaacugauucauugacaucguuugcaaccugagccauccaaauucuuucuacuuuaaagcuuaugagcaagaaguacaaguuuuugguguaugagcuauuacaggucugagaagcaauggcaugaacugauuuggcuuuguauguuauuuaagugauaacuacauuccuuaaaauuaggcagauggucugucugacucuaccuuucauguugaugguuaaaaguucuugauuuuguucuugauacuuaaggagggaauaccugucuauauauuguuggcgcugaagaauuuuugaaaucggccuggacaaacuuaaaaguguugcuuuucucagccuuuauacggaguuuaaguaucuuacagucuauguguaguggggcuuuuuacaauuuuguuuuguuuuuuggugggaagaagggugguaugggaaaguauagaaauggaacuaauugagucuagggguaaaaaacugcugggagccuguggauuauaaaucgaguagcugcagcagcagguacucaggcagagguaugggagugcagucagugggacaggaagcuuguuuugguguucugugucuuguccuugacaaugacuccaggggaccaagugcagucuauagaaaggagagguguccauaguuuccuaucuggaaaacuuuuacagcauuccugccuggggucuuaaagacuagaaaggaagaugaaaacuagaugagauacucuugccuccuguuccucuccccacuguccacccccuacaucugcacugagcaccccuuuaucugcuagcuagguauguggcuagggagauaaacccuguuuuguugugaaaguuccaucaaaacugccauuuugucucccccaucguuugaucaacaaaaauuguguugaaauuucagggagcauuauuuaaagcagagguauugaauauucaauauucaauaauauugaauauuauuaauuugccuaaauauauaaaaugaaaucacaauucacuggccugggcuccucacuguaagcagaggaguggacuuagugaccaucuuucagcuuuaagacugaauaacauuuucccuuccauugggaaacuuauuuauaucccaguagucauccccacacuaaguuuuuccgauauggcguccagauuuuauuuccccuaauaauuacacccccuguuuucaggcuaggcauucucccuccuuucuuguguuuacaccuuucaaauauuugcagauuguuauccugucacccucuuagucaccgcuuagcugagcuguacaaauuuagcaccuuuuaucuucccuuuaaaggcaggucuccacgccccugagucauuuuccccugcucucuuuaagugugcuccaguuuucugcauuuccauguggccacauaacuuuccuagaauugaacauaggucaugagugagaauuguuuuccuccuuuggcaugucagaagcuaaacauuucugcuaugcuccagccucaggucucucugacauagcuggucaguguugaccacuucaacucuguaguuaaaccacguucucuaaaugugccaauuuaaagaccagugggguaaaaggguguagcuaugcuauacuuuguuuaauccuugaaguguuauauaaccaugggaaagugggauguauguaguuauggauucuguuggccccuuuccugguauuugcauaaaacaccucuguucuccaggugugucagacuaaaccucaucucagcucugcgcccugacaguucaucaaccaucucuuucucuguguguuuacguuuuucagaacuauuuuucacuaauauucauucaacauuuauugagcgucuccaaugccacugugugcuacauaguauguuaagugcuggaaagauuaaaaucugaauaugacacagugccugcccuaagaugcacuguuuuuguuauaguuuuaguuuuaguuugguugaaaguaccagauccucacagauuggcuuacagugucagugaggggagagagcagaggaauauccaugaaaaucuaauaggagccuagguagggucaggugucacagauccuggaaccugaggugauucugagucugagacugcuccagggaccucacuguagaucuccaguguuaaugucaguucguccccucugcuuauugccuccuuccucuggcuccugcggggauuguguuuuaaacacugcucaguucaaauuccagaaggagacucuuauugguucaccuggcaucugccauuucuauuugaauagagcuguuuuuccuauugcuggccugacugcacauuugcuacccuugaagcugcuacagcaccacucccucccucucugccauuccccaccuucugcacugacuucccauucccagcuuguggugugcggagagaacagaggucaugugcuaaaaagcauagcugcccgaggcugucuccuuagugagggauguguccuguuaagccccgugauugaguuguccacuacauucugccaauagcuuccuagccauacaugcacuucuagcccgggcuagagugcagugguacaaucucagcucacugcaaccuccacuucuggaauucaagugguucuccugccucagccuccugaguagcuggcccuacaggcgcacaccaccacacccugccaauuuuuguauuuuuaguagaggcgggguuucaccaucuuggccaggcuggucucaaacuccugaccucaagugauccgccugccuuggccucccagagugcugggauuacaggcuucagccacugugcccggccauguacuauuucuuaacauuaugcaacauauaggccaaauggcaaauccagucaccaauaacauaccuuuuacaauaguagaguaaaauaaucuuuccuagcugguaacuaacuucaugagcacaaaguguuuucaucauugaauccucaucuuccacaacaauccucaucuuccuggcccagaguagacauugacaagcauuaguucaauggagaguagaggucugcuagaugagcugguggauuuuucaguguaccccguggacagaaggcagguucugcaugccuccugugccacugugaugucugaugcaguagugagaacacagcgggcaugcaguagacaccguugacuaauccuucaaacuguuuuuuguuuccacuugaguuuugucuccuucagcuaaugccuggucucuuagugguggaauaagugccacugggaagcugucacauacuuccagcuaaggccaauuugucacacuucccuuagcucccacugcccaauaaaggaaaaagugaacacauucugaguccugagacuuaguuaucauaaaacucgaaaaagaguguaaaauacucagagcgauacauaaguuucacauagccaucaauagaaucucuuacagagcccauugucuugucauuaacaagaauguguacuucuuguuccaaagcugacugaccagaguauuuguguuaauugaccuaguuagucaaugucucuaaauguauaauuuuuuuaauagaaugauugcuccauagcccagcauuuuguuggauauuuauacuccaugagucaaggcuugggugaggaaucucaaaaggguauaaccaaaaugguaagauuuuguguccagagaaggccuugcauauccuucauuuuauagacagaugaggccuggauaaguuuaauauucuaucaguggcagagcagaacccagaaucaugaugugcugauggcuagcaaugaauuuucucuuccuaaacuauacagagucaggcagaaaccucuuuuuacuugauuuuauuuccuuuuguuuuguuuuguuuuguuuuguuucaaauagccauggccaaccauucauaucccagaaagucuagaaaagguaugaaaaauaaugaguuuuugcuuauaggcagauggaccuguagaguuugaaagaggucaggagcagcagccacauggagcaggagguggggcaggcauuugucuuaccugccucuccugugccugcccuuguggaagucagcugaguccccccaugggggaucugucuuuguucuggcacaccccaugauagagaaggaaaaugcucaggaauuuuugggauuuuuuuuuaaguguaguguuuugucuucuuuuguguuuauuaaaacaaaauaguuuguuucuuaaaggcuugugucagagguaagcuuggcacuucucuugcaccuguggcauuugaggcacagcugaguuaauauaucuuuaucagcaggcagcacugcacugguauguuaucagaaaagacagcuauuggugguaacaugcaggauccagccaggcacuuucucaacuggcuggggagaacuucugcagcuccagugauaucucacuucauauuuacagucugaggcccuguguggcuugggagcgcuccauugcugccugucagccugcccagcugagcaucagcagccuuggguuugcuuucuuagaacccaacuuucuuucccuucaucuguuuucuuuaacuuuuauuuuuaacguccauuuuauugcaucaccagcccagcagugcaggcauugcuugaggaaaggugcagcauggauuagguugacuugcucccugagcucuugggagaggagggcacagcauaauaacucugcucgcugccagcauguggcuucaucuggcuuucagcagcaacgacaacugacuuuuuggcucagaauguuaccauuuguguggucuccucucuaccaguggacagcauauuuuuugcucuguuccuuggucccuuaguacacaaaagcaagucuagaaacuggauaaacccucaguuggagcacuuuuuuaacucugcaagaaagccaucaggaccugccccguccuuccauccuucugucuuuacaccucagucaauaccaguguuuuucaaacuggguauuugucccacuagagguuuuaaaucaauucagugucauagccguuuuguuuuuuuccuuaaugaaauggugaacagaagagagacugucaguauaacauauacugacauauauaacuaacauauauagucaagauuaaccauuguuuuguggaaacguaauaauugcuaagcuggccuccaauaaaaauaaccccccaaauaaauaaaugaauacauaaauacugcucugcaaaagguaauaucaagauggcagagaaggaaaccucaggaaauggucuuccugccuaaauaauugcacuggcagaaucugccugaugugacuguuuugagacucuggaaucuauugaaggcuucuuacuuccauugguugucuacagguguuuguacccauauguaaguguguauguuggucacaguaagaauaaaaaguuugaaaaacgcccaucuacaguaucuucuaucuguagauguagcucggcucggcaaauuucuaauacucagacauucagauaucauaaagccuguccugcucuccuggcccugacuuuguaccuuagucugggaauagauucugccucugccugaugggaauggaugugaauggauguuuacuuauuuccacuugaaaaagggcacagaagcacccuacuucggcuuccuacucuugucgugcuagggcuuaacugcugggaaguggacuagcaacguaacaaaggcccuucuuugccuuugugucuacauggagugacugggauuugguuuucacaggcccagaggacuaucucaugaaaaauguuuugaauauauuucugcuugauuuguuuaacacccuggcccacugagccaucauguuuucucaauuuaaucacuugguggucuccaggauucaggggagcaacugcaaucucugaagcuucaccaaccuggugagauuucagaauaccaagagagugacaaaggaguagagugguacucaguaagugaagcucggaaaucuuuuaugcccucauagugaaaauucaaccccuuaguuccugcugcccagugcaguacccuagcuacaucccaguucuaguccccaguucauagcagccccacccaacagcaccccaguccuguccugcccaaauggcugcuaagagucagaaacaaacugaacacuuguuuuagcauuaugccuguuucugcaacaaugcuuuuucugugguuauguggcaagauuguucaauggaauuguuuauuuuucucucugaugauuuuguucuugcuuaguuugcagauauaaaaagaaaaguguuuuuggcuauugauguaaaaaacaugggccaucuuucauuccauuuuucucuagccucaucucucccuguaggguuaaucucaggcuccuuggcucaugaguuuauugcugucuuuuacaaaaauacguuccaccccucccuugcaggccggcacugaagugccaggaaugaggcagcccuggugaucuucuuugccaugugacacuuggguggggccuucaucugucccaucuuuucaaggguggcagaaugguccuugcugucaccucaagcugcuguccuguggcagucuuucuccuggccuagcauuuuauuugaugugguguauuccauuuguaaggccuuggggcucagagagaaagcuccguucuuuaucuucugaaagcccaauauauagccuauucccuuuuuucugagcuuugucaccuugaaucaaugcccuggccagaaacaugagcagcaccuagcuuuauucauacacagagauguaccuucuauccuagcaacagugggaccuugucuccaccaagcagguguuugccaucaccgagacacccugcuucugcugcuccuaugccagaucucuuguacguucccuugaggcuguucguaaauaaaagguagcaccucuuaguucugccuuacugcagcaggagagaccaccagugauucagagacacacauacuccaugcauccucccccagaucuucaucauuuucguuuccuaugucucuagcccaguuccacuuuuuguggaauuaugucuguaauuauauagcgucauaauuauagcuacagugugaauuuuuuugaaauauuuguaagucucagauaucaaaauguagcauauuucauggucugucacagaugaccacuguuagugguaaauauacuugcaaaacuaacggguugacucaaagaaagaaaaggcagucucacuugguuagugagcacuuuguacagaauccugugguuggauacaaaaaaagaguaugaaggauaggauucugucuucagggacagguugguugugggggucaaagaggauuuugagguuuugagcaugggaauugcuaagagugauaaugaugauacagauaauauuaauaauaggauauaguaaacgucuccauguggcaggcaucguucuaaauaaucucuccuaguucacacagcaaccuuaagaagcggauauauuauaauaucuguuuuauaaguaggaaaacugagacuuucugaguaauuuggcuaaggucacacagcuaauaagugauagagcugggaugugaaacuggguuucuuuggcuccaggcaccuaauauuucaucaguauucugagguguuuugcuuuuuuuucugucucucauucugaaugaaaagccgaugauacuauuguccagaauacacccagaguugagaggggaggcuuauuugaagagaaaagugacacugaauuaacacuuuugaauuugguguaaaagucagacagcaaggagaaaauguccaggagucagugagaauggcacuuaggaggcagaauggcugggauaucaguaggugagggagccauuucuguaagagauggcucaagcugcgagacuaugggaccgucaguuggagcagugcaggaugaggaguuccugcucaucuuacuuggaaggcuccuuucgccaugugcucuugauaauucccagaugcuguggcugagagcuccuauccauuggugcugcugugauaguguugguuuuuuccaccuggagagaacuaaaccccuccuccacuucucccauuaccucugucuucgucucagauagaauggauggaaguuagauguaacgccugcuucacuggaggugucaggggaccguccuuauuggacagcaagccuagugggcaccuuuucaucacagauucuacuuuucuccugacacaggcauugaaugccccagaggagcccgaaaccucccaggcuuggugcaggaaggagagcccuucagcgaggaagcuacacuuuucaccaaggaacuggugcugcagcgagagguaggacaucuuccuguugcuucuucugugaggaggggugacaaaauaaggcucccuuggucugccaugucagagaucagucuguuguuuuuuccacugcucagccuugcacauccauaauccauucuugugucugcccacaucuuauuucccugagcgcugcuucauuggccagccacccccaaauugcuccccuccacugguggccugggaugugugguggacaccaggccagcccagccagacuccugaugcagagagcuuacaucuuugcauucuuccuccuugguguauuagccugaguugccugucuccagcuggauuuagaagcuugacuaacccugucaggggccaauuuucuuugaacauuuauuuguaucuuugaguaauuguauuuucuguagcggguuuucugacuuaauuuaauuguauuucuguuucugccuguugggcuggcucuugcaugcaggaguuaggaucucagcugcuguggugcccuucuaccugcuaauuuugcucaagccuucaucaacagauccaucuucuuuccaggaguaugccagccauuuguccugcuaggugggcacaagaaaggagcagcagggaggugugcuuggcucagccuuaggauuuuugaaucugccauuguccccauuucuuuuacagucaucuauagggucccuccagcuuucauaauacucacagagguacaagauuauaggguccuagaggcugucucucuaaugagucuucguagaucuuugagagcagaugcguggacuucuuuaggaugcucagugauaaaaauaccuguuuguaagcuucagccucucaagcugauuugaauugcuaagaaauacaugaggcgugagagaacaagagaacacgccacuccgagaugcuuauguuggacuauccuggccuugagagaaguguugguugccaccucuuugauucuuuacugcuugccuucuuauuuuguagaagaaaguggaguggccuaacaaauccugaauucucaguuccauuucccaaacaucagcuacaacaaucuggguaucacaucugcuuuguuggcuaucuguacaaugauugggggauuggggggcuuaauuguaucaucagauucacauugcccuccauuuuauuuuuugugaagaugcaugcaaaguaaaaauccuuauauugacauggaaggugcuucccccucucccguuuuguaguuacacaaugcugccugaauuuuuaucaauuaaaaauaaccccgugcaagagaaguauuucaaaaauccaaacacuccaguugucuauaagugccuguugcaguuuuugaagugggccagggauuaaguggauggggcagauauuguagaauuucccucuaauuuuggauaaugaacugcaaaguaacuauguugguaaaagcaggugagucuguucaaauucauaacuuaaagacauugugaaggaugcagcaacagacuuuuguuuguugugcuuuggauggaggaaggaaaucccuucauuagauugcccaagacaucgguugauggcauucucaucauuuacugucuaagucaaauuucucaccaucauugucuuccuacuguuucacaucuccuaaaguuucuuucccauucuuuuucaacugucuuuuucccaaccaccuuucuuccugaucauguuucuggcccacugaugagauccaaaaguacaaggggaucaaagagaauacugaucacuaaaaggagugaguggcccaaaacucuuuuacucucccaugguuauugcgaccuuaccuuugucuuauauuugcuaauaccugacuguugaaaaagauuaaaauuuuccccaguuuucuuuggggaaacucuuuggugcucuugguauguaauugaguuugcagauucuuagucuaacccagaguugaucuuucuugauuauaguggccccaucuuucauaucccuagguugaggaucucaauaagaaccuuucugcauuuucuuagcuacuuauaugauuacuuggguuggcuguuuugaaaguucuuuacacugagaaaaugugaguauguccuaaacuaugaauaauucaaaaaucugacuaaaagauccaguaauacccuacuguccugaacauuuccuuuauauuauauaugaaaacuguuuucugaacaguguaggaauggagagguuuguguuuuguuacaggcuuauucauuuacuuuuaccuauguaguaccuccauuuuuauuucauaaguugucuuggggaaugcuucucuuuguccuacucccccaaccccacaaagaucuagcagaagaggaaagucccaguacauugguacuccuggaugcagagguccuucccgcccucagcagaaguccugagcaaugcauggaugccugaaugugggcccacgaccucccaccucaugcagcucuuaccuuccaggcagccucuaucuugcccacagugcacgacagugcaggaacucuccuggagcugagccaccgcugggauggccgcaguugaacugguuuuuugugccuuuuaccuguucccuugaucaugaguuuuagcucagauaaccagguauuuugaagacgugauuguccuuggcccugccccaucccuucccuuuaaaguuuuaaauuuuuuucaugucuuuucuuuggccagaauuucucuauccccugcaugccuuccucgguuaccauaaaucugcauuauccuaggaaagaugaagcccacagauuguacgauuucagaguacuuccugggccccugugugauccgacagaggccuggucaucaaguuggacuucccuaugugaaaccauaaacuaaccugaggaagauacugaggggagaggggcuguguaacggugacugccucuaggccagccuucugccaggcagagaacaggaagcuggcaugcagggugucuggcacugguaaaaugacaccauguuuguaagugcauuguccuggcuuuuggugggccgugcaggaguuccugccugaauuauagucuuuccaucucauaucuucauguggagcccucaagcuuuagacaagucuuuuaucuccguuuucagguggcucccauuaucuugagaccucauaaugcugcuuuccuuaaauuuguuuuacacugacgcuagucagcacagagcuacucacauuucuggccaccacucggcuccauuaucuugacuucucuccugcccucuuacguugcauuucuucuuuuacaccacuguuuuacauguugcuccuccuuagccauugguuccuguuggcuuuuguucuuuuaccugaguuggaaaucugggaagacaauuccaacucaguggucugggcauucugguggugcugccaaccccagggcaggaagaacagugagugagauacugugccauuaccugcuucuccagccuugaagcccaaagcagccaaauaacucucaaaugacgaucacuuuuacucaaaaaaaaaaaaaaaaaaaaaaaaaaaaaaaaaaaacaguaaauucagucuuucuuucuagccugacuccgcugguauuuaggacaggugggcaaaucugugccacugccaguuuuuacaauaaaguuucauugaaacacagccaugcuaacucuguuuuuucuuguuguuugauuguuugaaacggagucucgcucugucgcccaggcuggagugcaguggcgcgaucucagcucacugcaaccucugccuucuggguucaagcaauucuccugccucagccucccaaguagcugggauuacaggccugcaccaccaugcucggcuaauuuuuuuuuuuguuuuuguauuuuuaguagagacgggguuucaccauauuggccaggcuggucucgaacuccugaccuugugaucugccuaccucagccucccaaagugcugggauuacaggcaugagccaaccgcgccuggccuggccaugcuaauucuuucauguauugucuauaacugcuuucauacuauaacagccgaguuguguaguuacgacagaggcuauauggcuugcaaagccuaaacuauuuacgaucuguuccuuuaccaaaaaguuugcugacuacugcugcauaugguaugcugaauuggguuuaaauggcuuguaauagcccugaaaauuuaaguuggcucuccuguccccugccguugaggcuggacugcaugagauuauuguaucuguuggcuguagcugugacuaugagcugagugccaugucccauuggauagcauguacuuggugaccccugacccacauacagcugacucuuuaaggcaguucccugccacacagucaaggacaggaagaucuggugugauuucccagauggggaguugugccuauuacuagcaucccccagaaguagugagagauagcauuagcuaauggguaaauaacuggcuuaaaaguguaaacuccuagguuuucacacuccaguuuuuaugugguccuggauaugugauucuuuucugccuuggcauuccugucuaaaacacugaucuagcaaucccaagccacccuuuccuuuuugcggcccuuguucugaauaaaacagugauuucaugucucuucucacuuucuuccagaaggcagcuagccagcacauacucacugaccaguugcugccugcacagcaguguuuucacugcuguguuggagaaacccgaagucuuaaagggccauaagguauuauuuaaagagaucagugucauaguuuaacugucuucacaguuccaggcuguaggagguacaguuucugaggacaggggcaauguauguggguuuggugaucauuucuaaggccuuuuucgaugaccccuuuguccuuucugacacauuagaauugcucuuugcugcugccugaaaaaugauguccucaugcuggacagccccagcugaaaacucaggcugcugccuugaccuauuucccuucucccugcuggcauuaaaagggaggaugcccccggggagcucauucugcaggcugcaguggccagggcagaguccuggguuuccucucucucccuuacucccugcuuuaaaaaaaaaaaaaagguacagaaaaacauuauaagcaacuguugccauuggggaaaaaaaaguauuuacguuucaggggaauguggccucagccaugaauauugguguguauuuaugaagggguguaugucugggaaauaaaacuuagaauacaagaaaaagugauuucauuucuuucaucguagcuccaagugugcuguaucgugucugaaauagauaaacugcucuaagcaguuucaaguuuaucucaaucucuguccuucuugugcccucgguccuuucccuacaucaccccacaagcgcugugguguaugcucucuuagcccuucccauuccaucucucugcgcaggcuccuucccuguugaggagacccacaagagagggaacacuagcaaaguuauaucucuggaucaaaggaaugaggacaguucaagccacaggaaauuccaagaaaguaauggacgcccagugagggugaauccagugcaaccuacucuccugacucucccugacggccaugucgcuugggaacccucuccgagccacaaauaauuaccugcuggaaaagcaagcaggcuguccggcaauguuucauuuauuuucacaaagcccccuuauucuagauuaucucagccacugcccaggaaaaagggaacauguuauggucagcuuucuaaauagcucucucaucccacaagcuuuuaaaggcuguuugggggcuaaggccuuuaucaccuccccacacaugcuugacaguucaucacccaccaguggucuuuaauuucaagcaguuuauucuuaguuaagggccauauucuuugaagaagucucagguaagaaaaacuccugucuuaauagcgaucaaaccuuaauuuuauauagcauuuucucauuuuaaaaguguuuucaugcauaauguuucauuuuaaucucacagcaaaccuauaagaaaaauauuaacccugucuuacaguucaggacaccaaaaugcacaguaacuugccucuguucacagagcuaaugguaagacauauacuaaaacucaaauaucugcauuccaaaucaaaugcuuuuucuccucaaaucaugccaguuuugcuuuuagaaggcaauaauucuuuuagccauauuuuaccauuuuucaaccauagaauaucuggaacuaguuaaaggaauaguagaggacuucccugaaggucccacauugacuaagagucagucuucuauagggcauggauucugauccugaaugcuuccaagacugcagaggaauuugaagaauuugcuaugcccaugccuccccuaaauauuuacucugcucuucccacagcuccugugucuguugucugauuccugcuucaucugcuguuugauuuuugugggccuuacuuuucccauuugcucauguaugucuauauuccuauaucuaauguuucuuaaaagacaaaucugacuguguaggugcauuuguuuaaaaaauauaacuccccauugccucugggauaaagucuuaucucaguuuacauauauucuugauaaccucuccaacuuuaugucucaccacccccacucacuucguaauucgugccuuaucagaauggaccuguuauacuggcaguucaccauauauaccauuacauuuuguuucucccaucucucagguagacuuacacuuucggcccagcacaucagucaucgcccuugcuugcuuuccuauucacuccuguucuggaaggugcaccaccuuuucuuggaaggcuucccuugcucucccaggcuagaugagauguccuuccaucaguucccacagcacccugugcauguaucuguugugcacuuaccaauaguauacaagggaucuaugacccaagucucuccccacuagcuuguaagcuccucacagacaggaaccauguuuugucuuuguacuccagugccuaguauauaagagauacucaauaaauaaauauuugucaaaucaacuaauugauuccuugugaccuaauucuagagaaugggaagaaggccuguuauuuuguuguccuuuaugguucuuuaggaaagcucuccaagcuuggcauuugucagggugggaggaaaacuguugaaguauuaagacuggacacauggcugcuaauucaucagcuuaucauugaaaaaguccauagccaaaaccugacugugcacuuacuauaggacccugaccugccugggucucccugucucuccagccaguauauuuaaagguaaugagauaaugaugaguguuuugaaaaauguuuaguguucaaauagaaaccauucgugucccuucacucucugaacauagucugcaaaucucucccucucugguauguuucuguuuuguggauuagacugcuaaauaagcgaagaguuaauuuugaaguucaggucaacaaauuccuguuuggagacgggcuguuccugaauaccagguuguuaucugucuauuacagccccuucacuucugggcuccuggcccuuugcgaaguacuucagaaagccuagagagaagagagggcccucaaaucccauuccagccccuaaaugaaaguggcaucacaaggagaaaaguggagguagaaauguaccaugggggacguugccccauugccuuucuuccccugacuacugggcuuccucuaucagcuuuuaacgccuggaaguagcugagucuccagucacugguggccuuccccaagugagcucagcagcaugugcuaauaggugccaauacugugcuggcuccagugggauuccucucugcaaagcugcuggcuuagcuugacuguuucccuauuccucuccuuagaacuuucauagccagucaagcauagaauugcauccauucuucugaaauagguacugugccuaauuuuucauuggcuuggccaagauucuguuaccuguaauuaugucauaugggcugacugguguagguuugguaggccucacugcucuccagaggcuaguguuccuaucccaggauggcuguugggauuaggaguggaaugaggaauaguuuaggaccacaagagauuuggccuccuuggaacauguaggaaggccucaaggauguaauucuagcccagggaagaaaauccuuuucagcagacgcuucccuucccuuccccuagggaaugugucccuacuauaguaaacucuuccuuaagagaguuuuauguuuucucugucagaucaauuuguuuuucuuaauguuguuccuaucaaaaaaaaaaaaaaggaagaaauacaguccucagaccugacaguuucauuuuuccccccaaguagaagcaauagaaaccuuagcaguuccaagacuccuggcacucacuuuuccucuccaucuuuaggucuaacccagcucagcccagaguaaagacauaaaagccucacaugugauuuccucuugcauuuuuucugcuagaaggguccacaguacuuacuuuaugccucaucucaauugaagcuggaugaugaggauagugggcagugauugcaauuggggaaugcauguacuggaucacauaaggucaugaaaguccuugaaacagagccuugccaagcagaacccuugccacucaugguauucgauacagucuacccaucugacaugaaaugauauucuuaaugagccauuccuauggaagauagcuauugccaggcacauucagucuccuggucucccucucauagcuauguagggccuaugaccuagaauaaauggaaaaauguuaucaggaggaagagacugcuggacuccccugagagguaggguuugugcuaggagagcugggugccauuuauuucauuuugauauaucaggugcuccuaguaacaauuccuaguuucucuuaccucuguaaucauccugaauagucacugcuucuugagcuuuggugaguguucucuaaaaaaaaaaaaaaaaaaaaagguggaagcuaauauuuuuaauaacaaagggcugaagaaaagcagcucagaauuuuuauuuuucaggugaaauaccuauugugaaaucuguuaacuuccuucuggaagccuaauuugguaguaucuacagacaagcagauaauuucuugacaaacuaaagaugaccucacacagaccugcccacuacuuguuuucagaagaacuucugaacccagagcauuggccaacacccauacagacuugagugugagcuugcuuugcuuuugcuucuuuuuuuuuuuuuuuuugagacagggucucacucugucgcccaggcuggaaugcaguggcacagucauggcucacuguagccucaaccucccaggcucaggugacccucccaccucagccucucaaguagguaggacuacaggcccguguccccaugcccagcuaauguuuuguuauuuucuguagagacaggcuuucaccauguugcccaggcuggucucaaacucugggcucaagagaucugccugccucagccucccacagugcugggauuacgggcaugagccauugcaccuggcaagugaacuuuaaugugguauguuuggagugucuucaggcuucaggccucccuguuccguuuguccuaaacauugcaagccaugcccauugucugaauauccccuauggaauuacauaauucaacucauaucuuuuuagaacacagcucuuaauguauaauagcaaggcugccugagccaccagcagagcacaagcagacuguagauggcauuuuuucuccagguaauacuaacguugugguguuucacaugugacucgcccaaggacagaggggcaacuguucugguggaugagcugaccuuuacccugcccuguucuugccauuagcaugcccacucccugugucuguugccaaggacuugaagagaaccuccguguuccaaaccuggcuuuauugaugaacuuuccacuugcuacuccacccgugacgguuucuggucagcugcacuuaaauggauuuugaaaaugaaagugaccaauggucuguuaugaaaugcugcggugcaugaaauaagauuaugagcaagcuugagaauuaagaacagagauacccuaaccuggucaaaacaacauguuucacauagugagaaaggaauagcucauucuuagucucuucuuuaggacauuuaagggcaucuuuuccuucuuaaugaaacucuguuagcaugugaaaagucaaaccuagguucucauuccacuuucaccauuugcugucugaccaugcacacaucccuuagccucucuaaaccgagggcaaucucagugccuauuagaauuuaauaugaacgcuaucccuagcauugugcaaugcagccauccugcuaaaccuaauugccucaccuauguaaggaggguaccuucucacuaggguuacugugaaaauuaaguguauguguaaacuguuccucacaacccaagauauuaaacacucagugaaugguagcuuacagcaucauuuuuauuauuaauagaaauucucucagccgggcacaguggcucacgccuguaaucccagcacuuugggaggccaaggugggccgauuaccugagaucgggaguucaagaccaaccugaccaacauggagaaaccccgucucuacuaaaaauacaaaaucagcugggcaugguggcacaugccuguaaucccaacuauuugggaggcugaggcaggagaaucacuugaacccaggaggcggagguugcggugagccaagaucgcaccacugcacuccagucuuggcaacaagagcgaaacuccaucucaaaaacaaaaaaaaauaaaagaaauucucucagggcuuaacugaaauuuaggacuugaacuucaguauguacaaaaccagaguagaguucuaggcuggaucuagguauguguguugugagcagcauucagauuagaaucaacaaagaacaacccucccagugcucuucacucccccagccugucuaagccagugauggcacauaugcauaugcuaccccuauucggguuguccacccauggcagacauugccagucagucaccgcgcugcuuuggcugagggcucagauccuucucaaaacagggauccucgcuacuacuaccaguugagaggauuuggcacuuaacggaaaccuauuuuccauccuuggucuaaguuugcaaaggauuauuuauuuaaguacccucaggacaucagccagucuuuuauucugugaaguaaaauaacauaaggucucuuugucucugauuccucauggucccacacauuaggcaguauuacauucaguggaaaaccaaaggucuggagauaaugccagcaaguccuaaccuaugcaagaugccuuuucuagacuuggcuauggacugauaaggugaucaccaagggaggggugacaccaggacuccacacauaccucauggaugucuaaggaauaaugguuugaccaucuuugcaguguucuccacuugccauagggguauuuggagacuaaucugccaacagugagggcucucugcuuuuucuguugaugcagguccucugugacauugucacagcaacuugaaaaugagggauacggguaugaacuaacuagauccuggcugguacaggcuuccuuauccucugacagaauagcagugcuccuuugugucuccauacuuuccuaccaugaccacaacaauccaggauugccauagauuuguccuugaccugcauuaaguugaagaguuggaagauagauagcacagugccagcagaagcacuaaagaaagaacuaggugguaacacaggcugggcacaguggcucacaccuguaauuccaacacuuuggaggccgaggcagggggaucacaugaggccaggauuucaagaccagccuggccaacauggcgaaaccuugucucuaaugaaaauacaaaaguuagccuggugugauggcacaucccuguagucccagcuacucaggaggcugaggccaagaauugguggcagagguugcagugagccgaaaucgugccacugcacuccagccugggcaacagagccaagacucuccaaaaaaaagaagaaaaaaaugaaaaugaaaaagaaaaaucuagguguuaaacaagacugaaaaggauaggaaaaggccuccaagaagaagcguuugggucacuguagcaagaacagguaccucuugaaccgagaaugaaagaaggaacuggaaacugcuucacugugcuguuuuccuuuucagcuuaacauaugccuuccucuucuccccuuucccuucucuugaugcagucgaauucuuuuuaaugguuaccagaaaaggauuuggcauuggguguacagcuagagguggaagaucaugcaaauaagaccaacaggucccuccauuccccaccagcagccugcaugugccauuucacuucacacaucucuauaaugcuugcggugcuggggugccguuaccucuccaguuaaauaaaucucaaaccaccgacccaggguuuucauagcagugcugcagccauauaugaggaaaugcaacaaacaguccauuagcacugauuggauauggauuuuuggccuggccaccugccacuugguaauuuuagaauagggucacuuuuggaauugaagaugccuugugggaggggacugguguuugcuaaauagcuguaucuuaccaucaugcccuuucacagccaagcucccuaccucuggagugaggggcuggucucguggccugccuggcagagagggcuagagcuccuucuucaucagcuuccagggcugcagacguggccauuuccaaacacccagggugcacuuaaccacuuccuccuccuaaucucagcauuuccacucuaacacaucagcagcuuuguaacuuacuuucuuuuuuuuuuuuuuuugcccuauguuuuggcccuugauguauuugugggaggaagauggguagacuggcuaacugugauaucaacugauuucugaaugauacaguuauacccugagucaguuucuggagauuaagcaagggugccaggagcguugugaagggcucucauuguuuuuacaugucagugacugccugccuugguuuugccagcugcaaaauggaagaacuaagcccucuuuugccuagagaaugcuaaaaggugaauacucaggugugguggggagguuucuaaggacacccagaccccagaugaugcacuaagagugcugugugaccugaagagggaccucuggucagaacauuuuuuucugucaccagcaacugaauaauuaugcccaguugguagaauaggagaacuguuggccugggacccugagaucugaccaugauguuccccauuggacuaaacuuuggccaauauuuccuuuucucuaugccaugaaaucuuuugcauugccuuuuucuggacaugaguagaguacugacuuuggcuucugauaagcagcauauccuaaagagaaucugucccagaggacuuagggguuccuucagucuuugccgcucugguugcacuauuccugagcuaaagaugaaaacagacaucagauguucaucuuuguguuauggguuguuauccccagccaucauaaccgugugucuuauuuccugguugucugcauaaggccguauuuacauagaguuugcaaucuugccuguguggucaguauccguuucacccuagguuuacagccagaccucuaacauuuggacccaggccucugauauucaugccaugucuuuugcccagaguguuuaaaaggacaggccugugcccuagcugccguaaucuuuguuauuuucaaguacgaagcaagauagcuuugccuuauuugcugucugucuauauuuucugggcaugucagccagggagugagguuaguaagguauagcuagagauugcccuugaagcuuuugauucuugcuuuccuguccagaauuauagucaguuguugagauagccuaucccaacaccacuaacgugugacaacuucaaaaauucaugaggccuugggauucacagcaccucucaauaaucuagccuuguaucaagcgaaguagcccuguuggagcauugccagcaugugaggugcagaggggcccuccguagccagcccuucagcccuuccaggugugagaaagggcucuucaugccacacucacaugugcacccacgcaugccuaacacccagugacuggaagacugccuccagggaaauacaugcaggcuuacaccgcccagacagucuuucaucuguccuuccucuuucauucuuucacccgcccccuuguguuucuguaauuuguacaguaucguugaaagguguugaagagaucaauagcaauucaccuuuucccuuauugauucaagugauggcaagaaaaaauggcaggcaguaccaauucauuugucaugagcuauccauuuccuaccaagccaccagugaccucucccaaugccuguuagguugcugauuuacaguugggauuacuucuuuuuccaaccugcuuugauaggaaugagagaaccacuguguuugacuccuguaaucaaagcugggugaagaaggagacugcagguacugaacaggaaaacugcuguggagccuggucuccaacuccgaggcuugcuuuauuugaggagcuccccaccugugcugggcucucuagcagaggcaauacggcaucagcugauggagcugcagucucccccagcacuucucaaguccccacccccagcccccgaccuuuuucuaaaggacacagccuuccuuuguuaucuuuuuccacagaauguaaaaugagugugcugagugaaaaguccaugaccccugugaacuggcucugcuuuugccaaaggugcaaagguuugucauucccuucaugagccuucaaguaguaacuucagcugacccugggggaaugugaggugcccagggucuggccuuagcagggcugugggugaaggaaguguucuuguucuuagaggguucuguauccaccaggaauguagaguggagacaguucuucucagcuucuuuuucugcccuagagaaacaagcaugggaagggugcgugcgugcgugcguguguguguguguucagccucacugggaacaguaucuugacuuucacuuggaaaagguaaugguggauccuugugugugugugcgugcauguguguuuugaccagccucacugggaacagucucuugacucucauuuggggaaagguaaugggguauccuccccccaccucccaaauaggacaguuagcugccacacacuuacaugcacauuuuaaaaacugugcauugcgaauggcaaauauguauuaguucacucaccuggugggaggaccaggguucuuugaaucccaggacucuuaagagggaaguuggcacugacuacaaagccaaagcuuggcuaacccagcugcugcuucuccuuuauguaccauauuuugaagguuguugguucuuacacagaagcaacuguugucccccacacccaguguggucaccaggcccucucaacucccaucagugcugaaguuugcugcuguggcauaaagugagccaauucccagaaacuccugccuauguagacuuuuggcagagaggcugcauuuggagggcuaccuggaagagaacccugcucagccacuuaccugagugggcaguuaauggugagcagugggaguggcaguucccagggcugguuguugccagcauggaggucgcagucuuugugucagcccgagcacacagccagccuucuccggaggagcacugccaucucagucuuguuuccugagcgccgaguggguugaggucacuauuuuagaugccccucucccaguagcgagauuuuguuagaaacccaguguugcugugucagguagcucugcaguaugcggaugccaggccuggagaaggcagccagcucucugugaagcugguuaauuacaugugaagcugccagcaggacaauuguuuuuuuucccauggaucauuaauaaaccauucuggccuggcaauuccaucaucuuccucagcuuugucagacggaucuuccuccuuuuuaguauaaagcuuuaaaaauggcugggaguggcaagagggagggaaaagaagaaucuacuuccauuuaaugcacauguuuuucccuaagcugaaaaguggcucccugcuuucagaucaucuuggcagccagaauacaaaggguucaaggcuugccaugggugggaaguggcucggcuccuaguauuugcagcaaacuacagaccaggccugauauggagacgaggcaacuagugcagcagauggcaaauaguccugcuccacuggggcuccagauaugcaccaucuucuuccuucagccaaggcagccucauuccugcuaugccugaguacagaaagcauuucugguuuuuuagaaacuccuuuuuuaggcaaagauggaagaaggcaaagcaaauauuauaugggaaacucaaucuaguuauagacguuucuuugucaaacaaacuaaaauagagcuuuuccuuuguugguuagaaaaauuuaggaauggaaaucuacauuucuccaaagagcauugagugcaaagauaaaaaccaaauuauaaauagaagugaguaugacccauucaguuuccaaggacuugagcauacagccuucauaauacugaauuauagccuuucauagauagaagggaucuagagguuauauaguccaauccaaacauuucacaguaaaugagaaaacugaggcaugaagaaguucaucacuugaugugcacuuucacaugguaaauuucaugguagagccagucuccacauuccuacuguauugcucuuaccuuuauccccacagugccucccagacaacagccucaucauccaccugaaguacaaguaauaauuugagaauaugacaguggcauauaaaagggaguaggugaugugauggaggcagacagaagagguaagcgggugcauucucuuuaaauuguauuauuuuagugagaaaaggaugggagccuaaguuagagaagucauccagggcuuuggccuucuguaaggaaacuccuccuagacaggguugcaaagauaacugcacacagauugagaacgugugcuagaggaggaguacaggugucugacagaccuggaauuuuccaucgcuuucccugauauguaguuguagaaaagcugcugucuauucgugccaaauccaagcuucagauaagcccggaggaaaccaaggagugcuaaacucuuacagguugggggcuuuuucuuuccuuuuuuuuuuuuuuuggagggggguugcauuguuuugauuuuugaauugagagaguuguggggaggucaaaaugcccauccacgauugcccucgaacucccuaggugggacuccagcucaagcacucuguucuggucaaguugaggcagggcacagggugggcccaugagugccaucccuuuccucugguaucccaugccccuggacccacucccucuacucucccaugaggcugaugcaggacucaugccaugcugucagggucuggggguuucucccacccuguagcagaggcagguuacccuucuuguuagcagugaugucuguucgucuuuuaagggguuguccaagugggggaggaacaaaucauauuuuccagcaauuuaauuuuauuaacucugauuuuuuuccccuuuuccaaagcacagcuaaauggagcuaaacauagacaugagggcuauauuuaguccugauggugugguagaguagagaaggcacaaacacagagguuuaucugcuaccuaguaaauauggggaggugucaggacuguagaauucaauaguaauaauaagcauuuuuauggugcaaugacagcuuugauacagggcauaauuuucucaggauugcuauuaauugugcuucugccuaugagcggcccccuggugaggggcuuggaacaccacacaaguuaagcuauauuaaacaucaauuaaaacagcauaaaauagaaacugaauaaaauaugcaaaggucagaguggcugugaacaugcagacaagguacuggggaaagaaggguuagggccuggugagccuggugcacuggcggauucauacucccagcugcuguuagcuucuuuggagcccagguuuaguagguuuguuggagagugaauuaugggacccucuagcuuuuccaaguucaauuauccucaaagggguuucggaaacuacucauugcaggcagcaagagauggaaaaagacaaccagauucuaccagugcuguccaacagaacuuucuauguugguggaaauguccuuugucucugcuguccaguacaguagccacguaauggauauugagcacuugaaauaugguuuauacaacugauuaauagaaucuuuauaaaauuuaaauaauuucaagguaaauagccacauggggcuaguggccaccuuauuagacagcauaggacucuagacaaguccccugcacauugugcauucuggcaauguuagguuugcauuguguucuucugaaaaagucugcaccuucccccaugccagugaguguguuuucucaauaacuuuuuuuuuuuuuuugacccuuaucucucaugcucuugacacaaacuuccacauuuuuucauaagggucacacacgaugccaagaaaugagaaaggagucaaugccggaucaagucagacaaccuuguccuuauccuugccuccuuuucuccugagagccccuagucaaucuaauaccaaguguuucccacucccagagagaaaagaagggaauggcuuuggaucucuggcuaaagaucacagacugcggagucgucacuguucccacugaacaucugauuaaguugcugagucugacccuugaguuucccagaacuugccaagauucagaauucccagaucauccaggcagcacgcuccugacagucuuugguccuuuuggcaccugaacugaaaaucccuuuucccauagcucuuucaacacuuguugaaugcuuauaaugaauccauucauuaggaugacacaguauaguggaacaaagcacuacaccuguaaucagaaaucccauguuuaaguccugacucuuccauuuacuaucucugugaccuugacaaaaucauuucaccucccugaggcuucaucuuccccaauaaaaaugaguguuuuggacuaaaugaccuguggguacuaagaggaugaagaaaagagagccagagaaagaggcccuuauugcaaagccugucuuccacauagccucccccuucugaugucagccugcauuuaaagcagcccuuuccugaggccacggagaggcuuccagugagucuaguuaccacucaccccacccacagguuguucagcaccagagacaccaugagccagacugcauggcauuacugccucuggugguuauuguacucaugugaaccucagggaagucaagacugguccccuauuacuuuggcauccucagagaugccguaagaaggcaagagguuccuuggcuuaggcaguggguccauaaagcaagagggguuuuguaguuaccugaaguaugcagaucuccaugcuggcucaagggcuguuugccagccuuccuuuacccaguagucacuagucacugcuccaaggauuggccccagccccccagagccccuguggagccgccaacacugcacagcucacaaagggcccuguagcaucucuaacugaggagcuggugagcggacgcccucagcagagguauuuuuagcuacaaugauacagccucaucuuuuugcaggacguuuuguuuaguuauuuuuuuaaugaaauaaauaaguaaaauugaagacugugguacuuacaccccagugccaacacccaagaaguuuuggcgcacacugucccccccacccccaaacacacacaccacaggccuauauaauuaauccucucuaaaaccaggugcugaggcucagaguuugccagaauauuaggccacagagacaguguguacagaagcaagaagagcuagaaauagaguggaggaaugaugcagacuggcccagugcagaggugcuugagggcccugugagcugcccaggcagcugguaacuacccugguuccugguguucagaccuuugauggauuugguggcucaagugagugggccucaacuccuggggagagagugcccuuguaguauacaaaggauucaguucuaugccuugcugacauuuuaaugcuuuuguuuuccuucucuucauccugucuggcaugucacguuuuccuuggcucuuuuauuguguaacaugugaucaggggcuaaaggacauucgcagagcuugcuucagaucccagagcaggaucaggguagugguucuuaccccagcugcacauuggaaucauggaguauggaggcuuaggaaagcuacuaaugccugggccucccuccaaagauucuggcuucaucaagcaccagcuuuuuaacuuccccagauuuauuaguugauaccaaggaauaacuuugauaauuuugguaggcauaauaauggcauugugguuauguaagaaaaugaacauauuuuuuagagauacauauuaaaugaaguguuuaagguugaaaauggcaucaugucugggauauacuuuaaaaugcuuccacaaagaaaagggggauagagaugaagcaaauaugacaacuuugguaguuguuggaucuggauggugguuauauggaaguucauuaguauccuauuuucaguauuuugaauuuuucacaucagaaaaggguuuuaaauauauacauacauuuuauauaaauauauauuaauguugaagcuccccaggcaauuuuaauguagaacuaagauugagaaccacuaguuaguuuaggggauuaaauuuggaucaccaugcccuaaaagauguguuuugucuuuggacuuugucuaaccuaagccugauuuuucuggauaaguuuucaugaguaaucuggacucuugguaggugggggacaggauggcacaaagaucaaauuagaccuguaucuggaaucugacuucaggagcguacaacuagacaauauugucucuuccacuggaugaacucacuguaaccgcccugagagcuauuauaccuuggaguuuaccugccucaucacuugccagcacugcaugucccauccuauggaccucucuggcuacaccagggcaauggaagacagcugcagcugcauuguaacacaugccacaagaaagccccagucccuuaagagugcucagcaguuugccaagcgguauuugccuaaagcuggggcaagaggacugaaacuuguaccuccccccauucccaggaguccacaugcccucagcucugcauccguauguguaugaggccucuuuugugucuucagugccuauuccaacucccaagcacuauuuugcucuggcuggucagcaagugggacgagcagcagcuugcugcagccaaccuaaauggagcucuggagcucaggcuggaagcuuccaugcuacauuuacauaccacauccuugcucaggacccuagcugagcaccuuuucauucagggguaggcugcuaguucuucuuucuugggggguuuugugauuuacaccuaaacauuaagcuaugaauaguuuauguuuugcuaagcaauaccgaagcagaggaagcguuauggacugcccaggucacucagccagcccaaagguucgcaugacacccucccuucccauugccccuggaccccugagacagcccuuuccgccagugccugccagugcacaagucacccccugcaccucuguagaagggccuggcucaucuuuguuuuccucacacagucagagucagcguuggucccacacuguccagugcuacauccagacuccaaaugaggggguugcuuccucagcccaguccuaagaacaagccuacuguguggccucaucuguguuucuucaugggacucuggacaggaggaggcaggggcuucuccugacucuggaucacucuccagagugcucccccuuuauauaccuccaccuucccacucuuagaccacauugucauuguguccgcccaagugcugagugccuugagggcaaggaccaagucuuucaucuccaucguuccccagcaccuggcagggugcggaucacuauacugguucuaaauaagcaaacuaaugaauaugugaaucaccgaagggcuauggcagggaaugccuuuacacuaagggucggaauccucagauuuaaaaauuaguuucucagucauuuggaauuaugaaccuaaacugugagaugaucuagagcagcaguccccaaccuuuuuggcacuagggaucaguuucauggaagacaauuuuuccauggacuggucgggugaggcaaugguuuggggaugaaacuguuacaccucagaucaucaggcauuagauucgcauaaggagcacacaaccuagaucccucgcaugugcaguucacuauaggguucaagcuccuaugagacuguaaugccacugcugcugaucucacaugaggcggagcccuggcaguaaugcuccccgccuaccacucaccuccuuaggcagggcucuagaucaggggagaccucggccuaaguuugcuuguagagcagccugugacugaugagggacagccuguagcugguaauggcuagagagaaauaaccuauuugauauucuuacuacuugccuuuggaauaaaggguaaucucucugugccuugguuucucccacuugauauucacaggucucugagcagucuauccucucuccuuccuugccuggggcucugaggagagugaccugcuuguaggaggguuucccuauguuuuuccagggcagucagucaauuaacaccuggccacuucuuuuggaaguuacuccuccugaaccugaaugaaacuucaggaacagucacucagcuuaagcacaaccauguacaacaagcgcuucuggagucaguggcaguacuguccugucuaucagaaaccugucugaucaguaagucuucuugccucccuuuugagucuagaggcugucauccuggguauaccuuugaaucuccuggauguuuuuuaaagcauugaaggaaguccugucaccaccccuagagauugcaagguauuugauauagcaucuagauuugaucuacacugguauuuuuaacagcaacagugcugauaauacgagccuggcgcugagaagcacugucuccaagaguccucacuagaaggagcuggaguggcacuugucccccgaacaguccacugcuggccucccuuucccaaaggcgggugggaaggcagagcacuugugucguccuccuuagcuaguucugagacaggacucccauauugcgcaguugguggugcagcuucccacccacccacaggcccacauacacaugcacacaaagcccacugcuucuuaacuuugggcagaucuguggaggggagauagaucuaucuguggaucaagauucaguuuugcuuuggcgggcaguugugagagagaacaguccacagcugugucugcaauuuguuaccagagaugaagauuuuuuuuaaauucuagcucaaagaaugcuucccuguauccaucccaccagcucccaagcaucacaucccacccauugguagcagaagagccugccuuagcagugagaggcaaggccagacaccaguugaaaucccagacagcuuccuacccucccucuauaucuugucagauauuucaagcuuuaaguccuuauucgugcucugccuacuuggcuggcuguucuugcacuugagcggcuuguuugccuggacagguccaagcugucugagccaucagcagcugcaccuccucccucgcgccuucugucugagccaaccuugauucacaguagugcagauggccccagccauacccagggaugucugccacucccauccccucuccugcccugcuuucccaagaugaaggggcugggucaggccuugcccgcaggucaacguggggcuaaaaugaagaccgcucuuaguucauguucuggcauauuaaucagggugacaugauaaaaagaauuuaucugaaacucauagaacagggcaagguuuaaguucauauuuugcagaaaacacuuuccagccuucaucagcgcuaaucuguuuuugaaaauggccuuaaucccacccacuuugcucccuaaguauuuauaggagcugagagucaaaaaagcacaugucagaaaucaccuuucuuccuuuuccuacccuuaccucauuuuaauauagacuuuggcaacuucucaaaguacaaugcucaguuuuucagucugguucaaggugcuuaaagguagugcccuguaauacaccauuauaaucaauuaguuucccuucuccuugucccuuuccaacagaaaugaaaugauugguaacaaguaugagaggggucaugggugaccuuguucaagagaaagauauggcugcagcagccccaggacaccacucugccuuuccccauugcuggcuucuuggugagcagcagaaauuuggagcuguacaggaaucagaugucccaccuagcaggcucugccggagccagacauagccauccacucuggcagcagccuaucgaagggagagaauccuggggcagcagccuaccaugcugccccuuccacuuuagauagggccaugcaauguaaauacauuauuuguauuuacauuugggucaucugcaaaccaaagcgaucucagcagcugcuggaaugccauugguacagccauaccaacauuuauauuauucacccugaugucuagauugcuauuacugacauuauuuuaaggcuuuuucucccuuaagagaaagcucuuccagcccuaggcugcuuaaauagggaggaacaacuuccuuuuuuuuuuuuuuuuuuuaagagacagagucuugcuacguugcccaggcuggucucaaacucuuggauucaagaguuccucccuccucagccucccuaguagcuaggacuauagaugugcaccacccugcccaacaaaccuuuuuuuucaauugaggaauauuaggauugagauauauuauggacuuucuauacaacuugggguguuuucuucaggauaaguauauuuuuaaucuuuaauaaugauaaaauacuuuacuggcaccuaaggaacaauaaaauacugacuaagaggccugaagaggcaucugcuccuaucucuagaauuugaaaccagucguuuggugagcucucaugcuggagugggcauggggccguguggguggcagaaaaucaaggggucucauuccacugaaaugucaugguuaccucagccuauggcugguguuugcccucuucucuccaauucgguaaggaagaaagcuccuuuaccaaagcguagaguaccugggcagaacacccaggaaccuuuuucuuucucuaaagucacaugauagaucucaccacagcagucaauuucuuguucuuccuaacugccccuacccuccuuguguagauuacaugucuuuuucucuuccuguuacaauuguuacuuaaccucuuaaccauaggaaacuugcuuucuuggauccauuauuuucuugugucugaccaaaucuuagugaucugccugcuuuuguuuuugauccagaaauucuagucauuuggaaguacuggacagagggucagcuauaggcauaggccagguucuugagguauaggucccaaggaccugaacugacaauauuugucuuaguccuuaaaguaaccaucagauucacugccagaaacuuuagccagcaacaaaauguggcagauacacuaccacccccacacccccuguuaugucagagaacaucccugaagcugcucagcacaguguagaggggacagcagagcuccaagagggauccugcuuuccucauccugcagugaggugugauucagaagagcacacagcacgccagagccuuggagguuaggguagggagguucuucccccuguucucauguggcuuaccugcaaaccugccuagauggggacuuacagagggcuaucaucaccccagagugcuuggacugcucagaucaacuagguagcugcuugcuaccaggauguccaggacaugagggggcuacguaaguacaacuauuaaucacccaggaagauguuuuccuguugucccaguacagggccaccucucaggcuccaugugucgcauucacugaaguuuuagacaugagagguggcucuguucucucugggggacaagucaggaaaagauugccuagcugacucuucccuggucucaguuccgaaugaaaagccugccaugcggccuucagcaucugcuacuccccgugccacaccugaucccaucucaagucauuucacaccagcagagggaagcccuguuccaacuccagcagcagcaccacucggggagggggggcaaacucuuuacccuugugguauuuuguaaacugcagcagcgaagccugaacuuccaggagggaaaugaaaugaccuuggcagguaacagguucaggacagccagcauuugucuugguuguugguuuccacauguuaaaugcuucuaguugcuccugaccuuccuugccugccuuuguuggucaaguccuauaggcacuguggcauuugugcagggagcaggggagaggaagcuuuucugcuuuacucuggcaccugacaagggcucucuauccagcauuggcauugccaguggggaacugcugaaguagcacucuagaguaucacccgggagaccccucugucuccugccaagcuaaacaaacccugcccaugcacucuucugaaucacaccucacugcagcuuuguuccuucuuccccaguacugcucagggcaccgccuuaugggaaaguccugugugucagcaaaagaagcacuugaggagaaacaaauugauauaggaagggggagugccacccagucaucuuuuaaguacaaagaaaggucaucggagcuguaugggguccagguuggauuauuguugacucugccuugcuguggcaaaagggccagcucucuggguccaaccuugggcauugccaaccccauccagcugcugacagcccagcacaaagaaaacacaugcuguguacacacagauggguuugcaugucagcaugagcccauuuuuagccuuuggccaggaagggcaguucacaacacaguaauuuaauuaaauuugccucccuccguggcccacauauuugaagagguuuggggggaaaugaaucuggcugaggaacauuacccugccgcucuggcacugccccagagccaagccacuguaccauaaagggucucaccauccugaauacgacccaggacaucugucugcacugcaggcucucuggccgggcugccugcuggcacaucuggcaaggcagccucuggaagcaguccgucucuaucacaggcaagccaccaggggcaaaauaagggacucccuacccccuacucaagaccugcuggcaacaacuuuagcaguaacucacaauauuagcuuucaucacagauuucaguguauuuagaguggagaggacagaauaagagaacccucuacccucaacuaacauugaagccucaauaacagcuaugauccuaacuucauugcuguuaaggccacauaccuguacuucuguccuggaaaugaccaguauuuagggaccugaaauugaaucccuuacccuuacuucccaugaacuuauuaccacauuucacaucucaaauguccaucaguuuuguccauuaugucugagcuuaacccacacuccaaacuccaaagaccugccccccuccccaccucagccagcuaguuccuccuugaacugaguucaucaacucaucaggaggccacuucuccuguggucacccccugguccagagaaucugcccaugauggguaguccuuucuuauugcuaacccguaaccucucaguccgccuuuucuguccuaagucagcuguaccaagccugcuagggaagagcauucucuuugguuaucuuucucucuccccaucaauagcacauccuccuggcuaacuaaugucucuuguguaaugauagcagcaccucugagagaaagggaauuucucuggcacaguucgucucaacaccagcauaacacaggcuguugcuuaggagugggaaucauuagagucaggccauuauuggaggggaccggucucuaggggagcuagcagaaauugccgcuccuuaauggauggaaacucauuugccugaagccccugcccuccucuuuauuuucucugcauuccucaccucccauugcuucccagcuuugaaguugaaaagagagguaacuccacccaaugcacauuucugcuaaauuaacuugguuagaagaaauccuugccugaaagcacuguucuuuuagaauguuucuauugggacuucacuugaaaccaucaugaagaagacaaauucuaauuaaauguaugugauaaaauuauagccagggccacucuguucccaagagaggauuugagaugggaggaagaggggacaauuuccuagcuuucuggaccccaguuucaggguagaccccugagucaaccugggcugccagagcuuucccucugaggguccccuugcuuacacaacacuaggaaggccagggagguagagcgggacuccaggcuucucugcuucuccaagggucugcaugaccuugaacagaccucuaacaugauuuagcuuucugcaagcccuccugucauguugggauagauguuaccuuacuacccugcacucuuguagagagaaggggaaggccauggaagcaacacaugccccuuuugguuuauuagccauggggcugccaucagagcacacaugcccugaagagaaaggaaaguugccugauuucucagcucuuccuguuugaaugaaaucaugagugggcaccaucugucucagagcauuaagcacagauaacaguacuggugggaaaggccuuccccccucccaaaagggaacuauaaaggauugcaucaaacugcaaacuccagggggcacuaaucacuuugccauuucuguaaauggcgcccccuggaguuguaagucaugguggcccugccggcgcucagcaauugcgcuaggucgcgaacccagagacuacagguaaggucucugcaucaccagcuaugugacaccugggcaaggcacaucuuccugggcuucauuuuccucauaaauaaaaugugaggguucaacuagauuuucugaauuaacuuggaaguucucauugcccucuccauaucccggaaguuaggaaccaugaaccuguguucugucucagugucaauugucauccccaggucggccagccucgauaacauacccagaaugagaaggcacccucggcugacauaacaccacuagucggaguggauguggacuuacacaugaagggggaaggauuaaggaaagggaaagccuccagcgggcacaauggaugaaacagcaagcgcacagaaugggccaaugccuuauucuucuuguauucauccuucucuguggcuucagagccuuuuuucugacacacaugcacacagcaccuccagugcuugccgucucucccccucaugagagaaacaaaaugaaaugcaaacaugcuuugaaagagcacagucuuguccugucccucugcauccccucuccucauuucuaaugaaaaaaauagucuucccuuucccugguuccuucaacagucucuuccuuagguuauuuuuuuccucucuccuuuccuacuccauccagacuucccccugccuaaucuuaaagagaugaauuggaagaauaugcagucgugucagaaggaugccauugucaguucacacaggcagacacuaauaggauaaaguauuaucugacuuccuuuaaguccagaaauuaagucuucuugcaauggcaauagauuauaacuuauaaccacuguggcuggcaggcugcagaaacaggcuguuaguaucugaggccucagcuccauuucugggccuauugugagggaugcacucagcauuccuccaaacacagcugcaugauccagggaacuggcacuuggcuccuggauggaacugccucuguggagagcugccuauaacucauucaguucaccugccgugggagaagcugucugaauggucuuaaugaaccuggaugagugggcagguaaagggaggaagccagggucuugaagacugggaagaaguagcccgaggcaaggaaaccaaacuuugcacagggaacacuuagugugugaaagcucuucucagucauccuugcugacucauugagcagguaguaacuuaucuagugacuaaaucagcaccagcuuagagacacagggaaaugaggguugagaccuuaaaggaacuguaaaagagacuacaaauuaaggaguugcccuggagaggaaauaucaugagaaauguuaggaagaaagagccaucauucuucaaaauggagggccucaugcaggauuuccuagguccuguuauggcagaugaguguacucaaauggggaauaugggacaggaaaccugauacaauaauuaauugaaggguauuuuuuuauuaguggggcuauaagaagguaggugggggcuggguacaguggcugacgccuguaaucccagcacuuugugagcccaaggugggcggauugccugaggucgggaguuucagaccagccuggccagcauggugaaaccccgucucuacuaaaaauacaaaaauuagccaggcgugguggugcgcaccuguaaucccagcaacucgggaagcugacgccaggagaaucgcuugaacccgggaggcggagguugcagugagccgagaucacaccacugcacuccagccugggcaacagagcaagacucucucucaaaaaaaaaaaaaaaaaaaaaaagaagguaggaggguaugaaagaaacaaguagaucaaguacuguuucuuuggcauccuauaauugauuuaaacuguaguaauuacucuaguaauguuccugaguguacagaaugaacaaaccugaaagccuaaguacuaucuugguccgucuagcucccacaccuagcuugagaguagccucucauaucaaugcuucccugcuauccuuucaaaacucuuuuugaugggauaagugggcaaagaucaugccaucgucucaaaugcuaacuuccuuugacaagacaguuucucccagggauaucccccacaggccuaggccaaaucucugacucacugcaaagguccauguacacugaacugauagacaucacuauuuuuauuggaaaacacaauuuauauaacacucuuccucuggaauaauacucuuuuuguggacaaauaccgaguugcucccucucuucuccccagcacaccccaccccccuccccaugacuguguuaauagaaaugaggaaauggguuuagagcagaucccugagugagccugucagggucaggauuaaauuacaucccugaaggcuggguugcuuccccaagcaguggacagccuccaggauagggaacaggacuguuguggguaggugguuuggcccaaguacugacagcaaagcuggcguguaccagaggauaaaaccugugaucauccuaaaaucuaauucuagccucucauuaggaaaucaaaaugcauucuuucuucgccucucuuggaaaguugaucucccugcuuuucuucuccucuguuucaugccaugaauuucgcacuaacaguccucccccauccaggguccagccagccucuugcuugcuaaggcagaggaaucucccuggcuuuccuccuugacugcauugcagccccuuagccuguguaucugccauagagcuccauucuucucucauuugcuccaauuauggugcuuuuugucugccuuucuuuucuccuagcucugcaauacugcucggaagccccaccggcccuuucagugcuaccuucuuccuccuagugccuccccacuccccacucccaguccugguaacacuuaauggucagggaggauuucaucacugaccugaguaauaaggcuaugacugcucugugccagagaaacauggguaggggagaagacauuaggaaguuuaccuucuugguaaaggaccuaggcuucccaaggucccagcccucagcuuaugcaugacuaucagcaccuuuacuuucuucuggcucaccacaaggaaagguaaucuauuccuggacuaaaucagugccuugggacagcuauagugcugguguagggaucagagcacaaggcaagguuuuccugggaggauaaguauaaccauguuuuucacagugaucgggcuuauagauacuauugucucugacuucuagaucaucauccuucuucucuggaguagcacaauaggcaugucucucuuuggacauauacaauguucaagaauagggguggugaugggggcuucucuguugaucuguguguuuguguguauugucaaauaacuguuaucuagcauuugcuauaugguguggagcacuaagugugagaucuaugucacacacauacauauauaauuauauauguaaaauuucaauucucacaaucugugaaguacugagguagauaguaauauugucuguauuuuuuaggugaagaaacugagucuuuuuccaaagucacacagcuaguaagugaugggaacuaggauucaacacaggaagacuggcuacagagucugugcuuguaagcacuaugcuauauugcuguguguguguguguguguauuucacugaucuaguugcugaagcccuuaucacugcuccaagaaguaauuuacuucauuuuaauuuaaagcaaagaugaaaacaacuuauccuacuguccaaaacauucuuccccuugcauaggagaggggugcuuccugaaaggagugagaccaagagaguugcucugagccaaaagcugccuugcaguuuagcugaggcaggauuuagaaauggcgugaacagugccugcauuagccgauggcauggagugcugagugccagcagaggagauaaaaucagacauauguuuggauauaaauguuccucucucucuucuaauuuuaagccccugcugcuuuguugcagugaaaugauggagccuuaauuauaggcccuggcccccugagguagaagccuggguugaguaaggcccacuuagcccucucccagucucuacccauuaccacggaaggaagccagagaccauggacucugacccucuucucagacaacaauaggaauugucuugcagggacucucugcugguuguuccacggcacucagcaaguugcuggccucaauacauguuaaauagccaugauaaagcuaaugucucuaggccuuagaaacuagccuaucuaccuuuaccuccauugacgauaggaugcagcugaaggguguuaaaaaguccuggagcacauuguagaaguggcagcuacagcauggcacuuaaagaguuagagcugggguagauacaguggagaagaggagcaaaagacccucccaguauucucauuguugagccggguaagcaaaaaccacuccauuauggggaaccucugugguccaguagguguuuuaagaccuccuccacacugcagaguuuccaaggcugggaggaggccaagccaccuuuucuaacuauaaaacaccaagucuuaccuacuucacuccuuccccuuagcugucacccucugugggauccugcaguuucugucugccauugggccuaagaaucaggaaaugguuauguagaguccugauagucuaaccccuuagcacauguggagccccuguagucaggccuuagagggcaguauagccaguucuaaagagagugaacagcucuaagggauaagagaacacagacguaucuuaggaaggucucauuuuaacuguuuugcuaguuaaguauguucuugauagccaauagcagccugggugagaaagcacauugacucaggagucaaaagaccugggcuuuuagucccaccuccuccacuagcagugugaccuuggauaugucuuuuaauuucucuggggcucaguuucuuugacuguaaaaugugaagggauuagacuaaaugauuuuucacggccuucaguucuguaaugaaaauucucuaacuccguaucaucagcaagagucuuuacauccaacguguugcuauaacuacccccuaaagagcuaccaacccguguuccauuccuagguaacaaaccuuggccuggccaaggaugagucacagcauucacggcugcauuuuugguacucacgggaugccucucugaaaagcugucccaagugccugcuacagaggaggauauaccaugauagcaaaggaagguuacugcuguaaaaguggaaacugcauggaucaaagggcaggccuacugggguaaggaacucucccugcagcucugaggauacuuaaaucuaggauccuagucuuagucucccccaacuccuuugagguuccuuucaaaaguccuucucccacagauugaagcugaauauagucuuccuugggacaaaugcauuuguccauaggacucuuucccgagauuguuuuaggcccauuucuguaccucuccccucagacuguuagccacagacccuuagucauugcaaaguuacugcauaauucccugucugcucaaauagcugucaaaaaaaaaaaaagaaggguguuaggaaauuggcuccucauccucuauuucugaaacagcaacuuccuccgcaauuuccucugaaugcauacccaggaagcuguuuuaaacagccugaguugugucuuguggcacuaggaaagggaguaauuucuugcuuuuucaccugguccuagccaagucccacccuuugcucuccugcaguuuucuuucuuuuuauuggggguauggugauaaaggagaggcaggaggaacggaucuuuggugccuagaacugugagugguaguuuauaagugugugcccauacauaugugcuggcacacugauacccagaaaugauguauauacccaggaggauuaagaauuggcccuuucuuagccaacugcugcaaagugcugccugccucucuuucccuccuuagugccaaagaguucacacccacucagucccaauucccugcauuaguauaaauacuagcacugaagaaaugcaggguccugauucacgcagccucucuggacauuauuacuugguaagcaucaggagacagacaccuaccaccaaaacauguuuagauuauuuagcacccagagaacagaagcaacacugccugugggaaauuuaagccaaacuacauuauugcaggccucugaaauccaggucccccagguuccucggguagagcuggugcugccugaccagcagcuucugcugagguggcauuuaacuuuuggccaggucccaggagcugaggcugacccauuuccccugcuuuuccagggcauagggaauuugauuauacccccaacaaagccagggacuaacacaguuagcuuguagaaggugcacuagaaucggggugcuuuuauuuaagcuaaggaaagguugacagcuuuagcauuuucccauacuugaaaauaauuuaacauuugucuuucccccaucauaccuguacccuccccuccccgcuuuuuuauuaaauagaaaugauuggcucauaagaaucuauagguucagggucuuacucaauuuaacccuuuggggacauugaauuaaaaauucaacaauauuuauuaaaauacaaaaauacacuuuucucacauuacaaucaguguucuuuuguuggcaauuccccucccccacccauaccacccccuuucaaaucugaaccccuuauuuccuuuuaaagcuaaaauaauaacugaaagaaguuacaucauuagauggaccagaauaacagagaucucugccuuccccacccacgcccacccuuucucuuccaccuucuccugagggggccugggagagggaagcuucccaucagugugcuccauucaacaguaccccauguggaacuccaugugugcaugcgugucacuuguaacuguggaucucacagcuuuuuugugaaccauccugguugggaaaggcuucauuacuuuacgugagccuguacccuuuucgucucucccuuuucuuugcuacucauguucugcccccaccccaucaccacaaccaguugacauccgcuguaauaaucccuaaugaaucagcauuuagaagagucaccaaaucacaagcaugagaaaagcuuccacucccaagcuccccaauucaggcuucuccucccucuccaccuuaaaacaaacaaaaucuuuuuuaaaaaucauaaaaugccaucauugucuacaaucaugugucagaguccaggaacaacagguggacauggcacaaugcuaauuuauggccuccugugaauacauucucucugcuuuacccucccuucccaccccccugcugccgcaccccuucaggggccuccuccuccugggaaacccugaauagacacaugccuugcagaguggguuaagcccaacugcaggaaucuggugcaaugugaaagcauuagacugagagcuacgccagcucccguccuucucugcuccuuucuaagcaauucugucaggcaaggcacauguguguccagugcacagacccccaagacuugugcacauggacaaagacucagccccuuuaaggguucguuugaauuuuggugguuuuccugcuuaaaauacauguacaggucuaucuuccccuuagccucugaagaaaaauauuauugccacuaucauuuuggcacaguacaaauucauggugcuuuuuuuuuguauuuuuuuuuaauaagauaauucugcaaagacagcucucggcuuaagaaagaugucuguagaaauggauaguccuguguccuaugaagcaucuucuaaaaaaugacagauucagucuaucccucuugcccccucagcagcccacacccuaccucuuuaaggauguuuguuguuuuaguuuauuuuaucucagcaauuucaaccuuauaccagaaaucccuucuggcagcauagcaaguuaacuuguggcuuguaccccacaacguucccaagauucccccccacccccuuuaaauagaacuuacaaguuagaaaauauuuuuguuuugacuuuuugucuuuaaauuuuaauauaaucuguuuuuuuuaaccagcccauagacuuaauauauaagcauauacaagaaaaagucucuccccacucuguacaaaaguugcugucuuugugugcauucuauugcauuuuauaaguuuuuugggggaggggagucauauuugaguuuccuguaccuuguccuugguaugggucugaauuauauaagguucagagauaguggugacuguggggugcagagaguuccccaggcuguuuucuguccagugggccccaugugcugguuuguagguguuguaguuaauauggucaugaauugugggcagcacuacugcccccucaccugauacaccggacggagcugcuguugcugcugcggauguugcugcugggaugucuucguccaccuggauuaucucaacaguccgggcggcugugacuguacuccgcugcuggugccgcuuacgaaguuuauagaagacaaucaacauggcggcagcuagcagagucacugccacaaagcagccaaugaugaucuugguggucuucaugacuucauccaggcuggucugcaucuugucaguggugucugucgcggguacugccaccugcuugggcacacggguagucugaaugagcaccgugguagaggugguauaugccggcugguaaccaguggacgugguaggaacaggcuuguacuuucgcguuguguccucaggcgagaucuccguggucuccacuguuacuguggugaagaagcuguaguuggagguguuaagcucagccgugcucacauugagguaggccgaggcguuggaguugccugcaacauuggucaccaugcauguguacaccccagugucugaaagcagcacgugggaaaaguucaaggugccgucguugaggacagagauccuuggguggcgggaggcguggcugagcacugucccauugggcagcaaccacuucacggaggacauagggggaguccgacacuuaaguucugccauccgacccucagaaauguugaggucucgaggugcguccaugaugaagggggcagagcacuggaaggaggccugguccaccuccacgagguagcggccucgcaugugcaugggagcaugacagcggccacagcagguggaauugguggguauauacucucgaagccaccaggcuagccacagaaugucacaaucacaguuccaaggguugugguguagaugcaacuccaccagguaccucagcgggguaaagaggucauggggcaaagaagagagguuauugugggccaaguugaguuccacaagugaagccagcccgucaaaagcauuccgcucaaucaggcugaccugugaguucaugacccagagcuucuugagggagcucaggccauggaaggagccaggccugaucucagggaagugguucccugacaucuccagcuccuccagccccaccaggggggugagauugggcaugucuuuaauguugcacaugcccaaguucagauacuugagguugaacagccccucaaaagcucccucagagauauacuccagcuucuugagcucccccaaguccaggcgcaugagggagggcacccgguugaaggcguaagaggggaugcuuucgaugggguuguugcgaagccagagcucccgcagcuuggacagguauucaaaggccccgcuagggaugacugucagccaguugucgaacagcuccaggguguugaggcuggccaggccguugaaggcccccaccucaaucugccggauggaguuccugcccaacugcaggaccuccaggugguggagguggcggaaggugucggccuggaucaucuggauguuguucuccaugagguugagguaccggguguucgagggaauacccugcgggaccucggagaggccccggcgcgugcacaccaccuugcugaacugguuacugcacgagcagacggaggggcaguucuggggcccggcugaggcggcagcagcgauggcugcacacagaauccacacuugcgccgugagguagacgaacgggagcaggauggcauuccaggugugguggugcacaguuaccugccacaagagcuucaugguguggcacguucauaauucaccaucgccugggauuuuggcucggaaaggagaaccagcccuaccccggcuuaagugagcuaggagcuccucuuuccaucuggagaaggagguggggagggggcgauuagagagacggagcggaucggccgaaaaaaauccugccaaacucgagcggccccuggucucccaacccacccucaaggcaagcccuccgaaagcuacgacucucccacacugcaaccguccccacccaguucgccgucaccuaccucggaaggaaggcaggaaagcacuggcgugguguccuuaagcuuucuccacgggagcugggcaccucguucccauuccgacuucuuaguuuuaauuaacaaaagggggaaguggugggggcggggagggcagaggggaggggaggggaggggagggaaggggugggggagacaaaauggccucuaguaaauccggagccggagccggcgaagccgcggaguugaggcgcgccugggagagccaaggcccggcgggcuaugcaggugcaugccccccccuccgcccaaggagcggcgccaccagcgcuucccggcuuuguccuuggacccuggcaccggcucgcuccagccgcgggggaaggcgcuucaucgccaaagugcgcuccggcggccccggcccgcucugcgggccgccgccggagggagugcgggggcgccccgaagccgcccaggccgcacucgcuggaugcugcgcucccucucccggcgucggccgcuccgggccggcggcagcugauugcggucgugagcucgcggagcggcgagaguuaagaggagguguucgcggcgccuucgcccuccccagacacacacccccuuucuccucgccucuucucggaggguggaagagacaaaaacggggggucaguucuccaguccgccggcugccggcacgcggggcggcgcuccguccggcccccgaggaccagcggcguggcggcugcgcucggacccgguccgccggccggaggagcgcgcggcgcccgcggucgcgcccgcaccgcaggccccuucagagaguccgggggcgggcgcggguccggcggcggcggcggccgcagcccccggcggcgcgcaaccgcccgucgccgcccgccgcugcccggcccccggcgcgccgccggcuccggcuuugugcggagggagcgaguucgcggcuucggcucccggcgcccucaguggccgcgccgccagcggacugcugcagcggcgugagcagcgggggucgcggcugcgggaaacgcuccggagcccaggaacauaguccccgcuggcuagcggcggcagcagcagcagcggggccccugcgcgcggcgcccaccgucuccuccucgcgccgggcucgcgguguugcaggcggcagccacgcagacugcucucucauccuuuuguccuucagucagaacgugaauguacugcugacgcauacuguucugggagaagauuagcgugaugcagugcucuuauguauuagcgccgcucccccuccgucgccugccucgcgggguuaacgccggcgccuuccagcgccgcgccggccggcgccgcgcagccccgcgccuccggccgcccgucuuccucuuuccuccuuccuuccuccucucuuccucucucccccuccccccuccccccuccccgggccgcuuccuccccgcccccucuagacgagcggagcggggccagggcgagcgggcgagcgagccggagugagcgucaagugaggggccgcgcgcaagucgcaggcguucgcagcuauuuugggccggucggagggagcaguuggguggccgcugauaggcuggagcggcgcggggcugcggcgggagagcccgcgccggcccccgcccuccggcccgcacccggggcccccuggcucugaagagcggggcucaggggcccggcggcccgcggcggggcugcugcauuuggccugccucucgcccggcccgcgucauccucacccccgcugacugcugacggggcgcggacucgcguucggaguucggaacugcgugguggggacucgggggacggcggccggggccacgaggcucccaggaccgagagcccgggcuucgcugcugcacugccgccagccccuccuucgcuuugccucaccccuccugugcucucacuggggcuuuaaaugaggguuuccuuaaugaggguugcgggggcgggaaacaguggcaggaaugaccaagugugaugagcuggggaauggcaaccugggacagcacagaggccggcaggaaggauugaggugaacucccggagcccacgacacagcccguucauucauggagcugcagccgcggcuucucagucuucgcuggccggagucgccccuugcuccccgcugcccccagagaacugggggaagggaggcgggcggcugagcccccugcccugugagcucgccagcccuuccuuggcuaggacucugagaagaacugcguagcagccagggguagcgauugggaguggggguggaauucuugcuccuauuucugguaggagacccuaaggcauuugacagacuaguguaggagaaggggacuaggucagcuuuuucccaccccccugaaaaaagacugccccuuucucugccgacugugggugaggcaaucuagcugagcccugggaagccgguccaguagaauauagcaugguuuaauaucccuucccuucaagagcugccuccagacuccucaacccaccccucuccccgugugauuucuggcaggcucgcuugauaaacccucaucaccugcgcgugggcuguugcuuaagaacgaggaggucccagauuucucagcucucugguuucuaccacaccuauuucugaguauugucuuuugcccaguaaccugaaccucuuuaaauacgccauggaauacuugaaguccuggaaacgguuccuuuguaggcaaguuggaguccccauucuuugccaagaccuuucuguuaucauuugcugucaaauaauaaccuuguuaguuucuguuuauugaacccuuacucuguauuccacugcaacccuauuauucauuuuauaugagucaaacguugccuagggucacuaguaagugauaguggauuugagccucagcacgucucagaugucaagaaacuuggguguggaagugauuccccaaaguauucuccuagugggaugagaacucagguuucauucauccacuucaauagucauuuacugggaugcuuaucuacuauguacuauccaccauaccaagaacuuauaucuguucuuguuuaaucuucauuuacccagugaaaguaauugccacacuugucuccauuucacagaugaaggcacuuagcuuaggcaggcaaauaacuugcccaaggucacacacuagaaaguaacagagccagccuuuccauccagccuucaaacccugaguccgauguuuucaucacuaacaggaaugcccgcugugucuacucuucauagaguaaaugguggaggcaaguggaggggggaggagagagagacuguaggaaaguucagugaaggaugugucagagaaguaagaugaaggguaggagacgggcugagaaaaugaacucucaucaagaaaaagaaugagggagacauggagguaagucaaacccugauacugggguuuaguuccaucugggcacucagacuuucuggugagagguucugcuccuuuauagcuggcaccgaccuaguagagucaucuauugccugaggagaccccuggccagggucuggauggcagcgauuaaguaugacuauccuucccuccucaggcaacagggucucugccugggcugguccucugcuacuguaggcaaacucaaacccugucuguucagcuccaggcuccacaaaugaaagcugcugccccgcacuauaaagguagaugaaagugggggccgaguugggucagaccaguacuuaguaaugagguugucucucaguaaguauuugugacugccauccaugaaggugacuaugcccaagcucugucgagcucuacaucaggcugcuuugcccccuguaagccagcugggccaggaaagcaccacugaaccuacuaacuggacuacagaggaggcuguggggccgucguugcacacagcccuucugagcugaaagugggauugcagccucucauuuugguaacccaaguaccaucuagcuauggcaucuugcuccucacagcccguggcucugacugcuucuuggauuuggaauggugccaccaaagaauaagaaggaaagaaggcuacuuacacccuaagaggaagagacaguggauucagauuguuuucacuugcaguuucacacagggagacugcugugauaacgccagagagagcuaaaaaagccagcagugauuggggaaggccugugucagcagccugguauuauagaaugagcccugugcuaagauugggauaccugaguucuaguccccuuuagacaugugacaaaucuuaaaauagcucuaaacaucaguuuuuccauuuauaaaaucaaggaaauggauuagaaaguuucuuaccgcucucuuaguccaugauuccugucccaucucagauauguagcucugugaagguugauccuuuggaauuguagccaagucuuggaaaugggccacaaaguuaagugagaaugcuuucuucauuuaaucuagagauccacagugcuggagcagagcaaaucggacuguguuuucccagcuacuaaaaagacacauagaucacagaauguuaaacuaaaguggaccuuggagauuaucuggauuuaaccucucacuuuacagaugucacugaugaagcucagagaggcacagugacuuaccuaaagcuacaugacugauuaguaucagagucuguccuuuuugaccucaguuccucuaaguaacaauguauggcuaauuggcauuuaaaccugggccuugaagauauuuccaaaugccugucuaaugugggcuuguaugccagugcaacuauacuuugcuggauugggauaaagaagagucuucaauagcaccagucugcacuuccuagugacuuugggucgccaauagaaaaugacagaaauggucaucuagaggacccaggacucucccacccagccaggauaauuggguuccuuaguaaagcccaaggcuagaccacucccuaaccugauaugcaucccugaggcauuauccugagcagccacuagauguccauaaugccucauaggguguuccaggagugagcuggguaucguuuugccaccaaauaggcuuugcggacucuuuuaaggguagguccaucaguggcaggaacagaacaggagcaaagacauaaaaggaauuugggaaacuagaaagaaaaaaguaguauggaaauugcccuccacaaagggaaggaaagauaucaauuggugaaucaguaauaauaaaaaguaggaauggucuacauggaaauagucacugccuucuuuccaagguaaugaacacauuugugugugugugugugugucuuaguuccacccacgugugcaaacaccuaucagggacaacuagccaugaauuuucuguuuaauaaguaaaaucagaauugcaaagggaagguuauuuuucuugccugugaucccauagugaggcuggcugugccauuacuacccacagucauaaagggaauggauuuuauuccuggagccugaugauucaaggcaagacagcuguuuuagaguuacccacucuucugagugugcuuugaauccacuguucuuuucccccaaggacucagcucuuuaaggaagucagaagggaguggacaauaaaggauaaaaaagcauucucccuccaggucccaucaagagcaauuuuuaaaaaccuuggcuaagaaaagacacagugcuuaguacaaacgguaaagagauagaauggagaggccuuucccucuccucuaagacuaaguuucuagggcuuacaguuucuuugugggcugucaggcucgagugauggggaaaaccucccagcuagcacucugccuccucuuuuggaauaguuugcauguggucuagccacagucacuuacauguucaaauugaaaagagagguucagccaggagcccugaaaaugcacuucugcaugaaaauacacuggcccauuccaggcccuuguggcuuuuccucuuuaauugccuguguauagcaguaauaaugguuuuaauagcaacauuuacugcagcguugauagguacuugguacuguguuaaguuacacauauuuacuccucacaacagcucugugagauggguaccaucagauuuccccauuuugcagaugaauuuaagaaguguucucaggaucacagaacugacuacuaaugagugacuaaauuuguuucuugaggcugccauaacaaaucaccacauaguuggugauuuaaagcagaaauauauucucucacaguucuggaggcuaaaaguucaaaaucuggcagggcugcacucccuccagaggccguaggggagaaucauuccuugccucuugccccugccagcuucugguggcugucagccuuccuugacuuacagcuguaucacuucagucucugccuccauggccacauugccuucuccuuuucugucugccucucuccucuuugugacuuauaaggacaccugucauuggauuuagggccuaccuggauaauccaggaugaucuccuuaucucaagauccuuaauuuaaaugggucuuugcagacaucauuucaaauucccgucacaggguucugggaaugaggauguaccccuauuuuucuaggggcucauucagcccauuacagugauagagccagguuucagucucaguacagagcccaaacucaaccacugugaugcugugaugugccauuuaacaugaaggggaaagggacaaugcaucugacaaccagcaggugacucuucccuauaccugugccugugaaggguaggggagccaagcaggagcuguguggcuguugggucuucccacugggaagggagagagucucucaaucaggaagcaucacaugagccaagagaagggggcaggcugacaagacacacucaggaaaaaucugucucuuauuuucuguuucugauuccauucuuaaugauuuucucacuuucucuuuacauugucucuagauuuuaucccaaagauauuggaacacuuaagcguuuaccaguaguaacaccaaaaguaccuccuggcauugccaccaaauuuggcuccacuguaucuaagucuuagagauuuugagcuucauguucauuggagauuaagggauaccuccagaucagggccagcaggugcagauguggaacugagagcuaugaauagaguggcuuuucagguaucugaaacauaaaugugaucauuaauccaugccuaugcuuacaauuagccucuucacagacacacaguguaugcuuaaaauuauucagauuuugguuggagaaaacccaaaacaauauuuuuucccaaauggacuaauacaaaauuugccacauaagagcacaugcgugucuguguauguggaugcuagugggcauuaugguguacugguggaugcaaagcaucucuggagucagacagaccugaguuuaaaccccaguucugccucuuacauaccgcguauauauagguuaguuguuuaagccccagauucuucacguguaaagugggauuaauaacuuauuucaugcuauuguugaacuagaagcaaguaaaggaaaucacaaucucagcaaauaguaauggucguagcaucuauuauuuucuaauacggaaaccgguauagaagaggcugucuuguucaaagucaguuacugaggggauucuuuucuucuggauaccugcucuuguuauugcaccuaauuuauaacuuucaauucuucauuuaagguaugagauguuuuucauuauuuguuuuuaacaguuacuggguuggguuuuuuuuuuugagguaauuuuagacuuauagacaggucaaaaauaguacugaguucccauaugugcuucacccagcuuucucuugugugaguuaauaucuuacauaaccacagaacauuuauucaaaacuaagaaauuaaucuauucaagacauagauuuuuacacuugcccucuacagucucuucuccauagcaaccaaagugaucuuugugacaguagaucagauuauguuauugauuugcuuaaaaugccccagugucuuccucucauaguuugaauaacaaccauacugcuucccauggcccacaggcccuaagucuucaucccugccugcaccucugcccucagguuuuaucgucuuccuccucauucccugcccuucagcuacacugaauuucuuuuccuggaauacucuuacaugguucuccccauuaaggccuuuacucuccccacaaccuaaaauguucccccauaucuucaggugguuguccuguccagaguagccccacucaucacaguuauaucacucagcuuuauuuuucucauuuuauuuuccauuaucugaaauugucuuguuuaugggcugucuauugugcauccccacaagagcagaggccccugcaucuuguuuccaauacuuagaccuagcagugaguuuauuauuucagagggaugaggacuguuuuugauaucccacguggguaagagcucaggccuuccuaauuuuaucgauagcccuagcccuacccugcucuacuuacauucuuugaagaagcaggugagaaauuacuagccugauuuuuuuuuuuaauacuggaaaaaugaaggagaauccuagugaccuuaaggugucuccaguucucaauuuuuagaauuccuagccccuugcugacagauuuaugaaggagaguuuuauggagguaucauaaaggcucacggguucuuggcaguugugaauaugugaggagugagcauaggugcacaaauacacauuaucugugcucauguacacauaagccugucauuuucaaauuggcuaaagugcauuuucuccaaagggagugggggcuguugagccugaaauagggaacaccaggacaguaagaucaaaugcuuugaaaguggcugugccaacgcuuuuugcuaauuaaagaauguuaggacaaucaccacuagcagcaguaaagggcgccccauuaccucgcuuuauggagagcuggguaaauuuaaaggcagcuauaaauaucccacugagugccagagcuauagcacagucggcggguaccugcugggcaaggagaggagcccagagcuucugguccccuuugucuaggguucucaucucuauuaccugucaguccccaaauuuugcuugaccaaggaagaauuccaucaacgaacccuuaauuuaaaaacacucagggagacagcaaacagcuguguauugagucugccugggagcccaggcuaccuggguccuucuccagcuuugucagugacuuucuuuuccuuuugccuggauggaagauauuucuucacguugugauuuuguuuccuugaaacacggggugugucacagaaauuuaaaaaaaaaaaauccaggugcagugcuuaugcuuguaaucccagcauuuugggaggccaaggugggggaauugcuugagccugggaggaggagguugcagugaccugagaucgcaccacucacuccaacucuggucaucaaacagagcaagguccuaucuuuaaaaaaaaaaaaaaaaaaaaaaaaaaaaagacaugguuugacaccuaaaaaaaaaaaaagugacaugguaagaccuuucuccugggaauauucuagagccccuuaacugagcaacucugugcuccagagaaaauuuuagcaucuguaaaguggcaacaaaaugggaacauacuuuuuauacuuauccuacggaauuucugacuaaauuaaagauuuuuacucaguuuggaacuuucuccauguuuuuaaucuauucaauuuggcuugaaaccuauuauguccuuuucuggguuucuucuuguaucucuuccauggccuccaagccguucuaaucccuugguuuguagaguggugccacauuggcgcugccuccucucuaccagcuuucuugaucuguuguucauuuucuuuaaacaucagcaucuguggccaucaagcugccuugcacaguuugcuaauuguuuucaauuguaugccuccagcuugagcuaugguuaggauuuuccuguucuaguaguccacucaguacuggccuaguaacgugaguuccuuggcaaguucauuugucucaucuaaggaguuccagggagggaauuaagggacccaugauggaaaugugggcuugaacuuugucucucuguagcugguacucuucaucccaccccuucccaucuuugagcaaaaggacaagcacuuuaccuuaagagcggagggggccccggugcaggggcuccugucuauaauccuagcacuacaggaggucgaggaugcaggaucgcuuaagcccaggaguuugagauuagccugggcaauauaaugagaccccccaucucuaaaauaauaauaauaacaauuuaaaaaauaagagguggagggcagcgcagcauugggaacaccgggaaaccagcccagcgcccacaccacuggcuaucccaugagucaucaaacaaccaaugggugaauuggcuaacauccagguuccuggaugcugcguuccuuuuuuauuaugacuugagcuucuucaggaguuagaucuaucaagccuccaaucugcucuugcuccacguuuuuagaggcaacucugucugcaaaugcuuccaguggaaaaucaccuuuauaucuagaggaauuggggauaggugaacaugaucuaaacgugcuagaacucucagcuccucuaucagauuuagaaaggaugagaauguccccaguuuguugguuggcuaguuggucuauucauguacauacucucucacauuuacauacugaguuucucugauacagcucugaauuuggcuagaacucacagguagauuuguuugcuuauuucuuuuuaaccacagguaacaugaccaccuugaaacuuguucugccucaucccaacaccacuccaagccaugaauccccaucuuucaauguuuaccucacuaccagccaagaaugcuaagcaggguguucuggggaaccuuucaucuuggucuacuuuaaacuguuucucugaugaacaccagacugaaauggcucugguucugauggggggugcuaaauccccagccuuugugcagcuaccagcuggggaucugaggggucuccuaccaugaugccuagacacuggcagccuggcuagaagagcucucauucucuaucacuuucuuggugacuagggccaguuuguauggcagcccagugaggcuacucgauuuguauucagugcacaaacccugaaaaaaaacccugccagccagcaacucugaaaggaugcuuugugugagugagcagugucugagauggacagggacucuccucccuccccugaaaacagccucucuggcccagcaacuuauuggugcuuuggaucuggcacagagcuccuggggaucccuccccaagaggagaccaucuugggaucccagauaacacugagcaacuuacgcccuguccuuccugcccuggcuucuggcagucagccuccaugagccagucagcaggauccauucaagguggugcccguguaugcaagagagacaguaaguggaaaaggggggagaugaacaugaacagaccaaccagccaacaaacuggggaugucgucauucuucucagauccugcgaaggcuguagccucugcucagcacugcugcccguccugccggacugguccuucacucucuccccaagcaagagcugugguacccugaaccuguuugauuuccuaacccauuaaagcuuucuuuugcaccuauuaucugaaaaggggcagaaauaagaauucugcuccugaacaucugguagcugcaagguaaaauucuuuaccaaauugagaccaagagguguuccugccugaugggagaccaggccugucagcaccaccaccaacccugucuuguuuuuaaugccacuggaggaguuggcuccugccagcugcuaucugaaucugucucuuuuaagauguuauuuguuauuaaugaguuuucuaaccacauaaccuugacucacuugcuuaggugaacaagaccauucucauuaaguacucuuuucugugaaggaaaagaauuaaguggguaaugaagaacuuucuaagggcucacgcauacaugagagccuagaagacagcaucacuggcacgugaauggcaggcugggcuuagucuucuacccccugaacagcuccaucuuaggccacaucucuuugugagaaaagccaaagaggguggcugaaguauguuuaaucaggugcccaucucagagguuacaccaggucucucuccccucucauauuucagugaugcuggguuuuuuuaauaccagccucaucuuugccaaauuaaaacccuccuuguaucuuguuugcccuaauuauuuugaauuuaguccaucauaaauaauauacauguaauaaggccaaggcaggcagaucacuugaggucaggaguucgagaccagcuuggccaacaugguaaaaccccauuucuacuaaaaauacaaaaauuagccagguguaguggcaugcaccuguaaucccagcuacuugggaggcugaggugggagaaucacuugaaccccagaggcagaggcugcagugagccgagauugugccacugcaucuagcugggugacagagggagacuccaucucaaaaaauaaauuuuuauauauauauauaaauuuauauaucugaaauauaugaaugguggugcugacaggccuggucuccuaucaggcaggaacaccucuuggucucaauuugauaaagaauguuaccuugcagcuaccagauguucaggagcaggauucuuauuucugccccuuuucagauaauauaucuuuauauauguauuuauauauuguguauaaauacacaauauguaaagauacaauauuguguaucuuuauauauguauauauguguguauauauauacacauauacacacacacacacacacacacacacguaauaaacguugcaacacuuagagugucuauuaaauaagacaauguaaccaaacaaauauuuuucuuccauuuuauuuuagaagccuuuagaagaggaauagugcggagagaaggguugugggccugagagaggcugugucuggggacagaagguagcagagugggaauaaagauguggccccagccaaggacuuuacccaagacucauugcuuucacaucuggguauguggaggagaagaaaacgcaacaaaauguuuccauuuggcugaacgagaguuuucuccagacccaccuccuaucuaaaguguccugucgccacacuugggccaauggcacuugugguuuguguguuaucacuucuccacucgguguggucaaggagcuuugcagcccugacuuguagcacagaaagauuuauucaggccgcauccacaaagggacaggcagacuccuaaagaaucaggcuuuguaggcaaaugcagcccugccugauuuccagagaccuuugucccaugggauagguaagaugagcagaaaaucugaaaccaguggcuugaaaacuguuuaccacagaauuuccuguaugggucccauacguguacaacacacuuauuuugaaaauuuuuucuuccuugcucuuaccuugcugaaaucauuguuuuuacaauaaagaaaaaaaucaaaaaguguuuaaaauaaaaaaggagcucaucuucuuccccccucccaucuccccccccacccccgccacacacacagacacacacacacaccuuuuauccgucuucucauuccuacuccuaaacaauuuaagagaaucuucaaguuuaagccauuuuugaaaugguuuugcucucaucccuggagguguaacagccuuuucccauucaguacuuuauuuuuccagauaguucauauggaguagaaggaacauacuauaucuguuucuguacugauggaucguguucaguuguguacauuuaucucugaggccugcuaaugccaucugaguuucuaaaauccuuauuuuugcaaauccauuuguguccuggguuuagcuccugauuuuaggauuagcacagauuacagggucugucugaugccuucuccaagcuuuguaucagauuuauggcuaugaauugagaagcuugcacauagauagcguggaaacuagaggcagauacgagcugaugggagaaaaaagcaaaaggagcucuuguaaagaauuggaguaguuaucaggccagauauuuggaucagaaccaguuaagaaccugaaaacgccaacuuucuguuucuugacuucacaacugugcugggcugccuguucccucuuuuccagaacaguuuuccauggacccuggcugugccuccuccccaccccacccaguggcugcccccagaauagaguucuaagccaugcuccagcccucuggguggcauccuuugcuaagagggcucucuccugucaucagcagucccuauggccuccauccugucaguucuuauuagacagcucuucugcucuacaucaaggagccugagagacuggaauaaaggacagagauggguuuggggcacagagcaacccaugccacuccuacccugugaugcagaaauauuagggggauucagccaccuaauauuuucuggaaguggaaaaagacauauguaacugugguaaagacucaugggucacuuuaggcuauauguguuuuaugcugcagcacuagaacauaggagcagcuuaaauaaucagauuuaucaucucacauaaaaugucagucccuaaguaggacagcuccaggggaggggugguugguuuaacuaagauauguccccaggucagaaucaggcaccuugguuuuuucccucuuucuaugcugccauucucuccccaugaccacaaguaccuuucuuggcugcaagaugauugccauagcucuaggcauugcaugcucauacaccaaucgacaaaggcaggagaagcauaguuucuuguuuugugccuuuuuaaaaguuuaaaaagaaaaaaauccuuccccacaagcaucucagcugacuuccuuuuacaacugauuauccagaucuggaugacacauccacuccuaaaccacuaugugaaaccaggaaagggaacucuuuuccuccaccccaaugauuggcugagacuagggauuuggaggagccaugaauuuggauacagaaaauuuuucucccugaagccagggucuugcucuaucaaacaggcugaagugcaguggcacaaucauggcucacuggagccucaaacuccugagcuaaagcaauccucccaaccucagccuccugccuagcugggacuauagaugggugccacuaugccaggcuaauuguuuuuauuuuuuguagagaugggauccugcuauguugcccaugcuggguuuuuugggguuuuuuguuuuuuuggguuuuuuuuuugguuguuguuguguuuuuuuuuuuuuuuuuugagacagagucucacuccgucacgcaggccagagugcaguggcaugaucucaccucacugcaaccuccaccucggguucaagugauucuccucccucagccuccuaaguagcugggauuacaggcauacaccaccaagcccagcucauuuuuauauuuuuaguagacauggggugucagcauguuggccaggcuggucucaaacuccuaaccucaagugaucugcccgccuugaccucccaaagugcugggauuacagacgugagccacugugcccugccucccaugcugguuuagaacuuccauccucaagcaguccucccaccucagccuccguuaagugcugggauuauaggcaugagccacagcaccuagcgugugucuuuauuuguauuaacugcuaagacuaacuauuuccuuugaauaugaauuaagcagcaaaucaaaguaaaacuaauuuaucuauucaucaccaauagaaauaaagaauauauucauaucauauuacaguaauuguaggaauuucagaauauuguuuacucuuaccacuucuuugaaaguauaguaguuuuuagagcugauguuagaucucuuaguguguugauaaagaaauacauguacuuauauccugauuuugauggguuuuuauaaauauuuucauaauuuucacuauaauugguuuccuuugcaauccuauauauuucaugcauguaaaaagauuauuauuuaaagggguccauaggcuacccucaacugccagagggguccauggcacaaaaaaugacuuauaccagucagcauuuuccugagucacauacgagaaaaaaggaugggcaccugccagcagggagaagguggaaauggcuguugaucaggcaacccguggaccuuuccacagugagugccuguggacucaggcagccuaagugccacucaguggucccuucccugcuauugcccagcuccauuuacagcaggaucuuccaaacuucagauauuuuuauaccaugccugugcuuuagccaaauccagguaccacugauuauuucacuaauauuuuucuucaaaucacucuguucuuucugaaaucucuuuuuuaaaggaagcuuuauuaaauggaaaaauaccacuuaccauaaaugaaaggaaaucuuaaaaauaaacacauagaauacagaacaguguuggugaauucuggcuaaauccuauuugccuguaagcucugcuccucuuuugugaaagagauacuaaagacagauuagcggcaaacuaagacauaaucagaguugagagaucuuugaaaaggguauaacuuaguuugugguuuccauuuugugccccgucauugacccagcuaaaauaauucagucccugggcagguuuaagauagacuccuuguuuuacagacuagugacccaccuacaaaggaaaugaguuuuguaugacuuauuguuuaugaaccugcaucuuuuuuuuuuuuugagacgaaauuucgcucuuauugcccaggcuagagugcaauggugugaucucggcucacugcaaccucggccucccggguucaaacaauucuccugccucagccucccgaguagcugggacuacaggcgcccaccaucaugcccggcuaauuuuuguauuuuugguagagacaggguuucaccauguuggccaggcuggucucgaucuccugaccucgugauccacccgucuuagccucccaaagugcugggauuacaggcaugagccaccgcacccgacugucuucuuccuuguucuuaucuggacuucagagaaugcaagaggcagaagcucugggagacccugagaccacagccucaauuuccaggcuccgaauuggaacuggcagugauuuuuuuucuuuuuuuuuuuuuuuuccaauucaggaaaacuuguugagaaagacaggcugacauuugcugacuacgcuuugcagacuuucuccuuaagcucuguuaguugugcauguuuacacauugagugugccuugugggcauuugugggcauguuugcaugugagugugcugugaugccagagcaggccucauguaugacgccucaauuuagucacuuuucuuaaugguuugaaacgacaaauguuacugucuuugaguuaagugguucaauuagcacugauuggaaagagugggaugaacugggaaaaacacgcagccuguuugguaacagccuugggacgggagagagggaagguguuaccccugaaaacagcuucucagugguggccuguccagcugcaguggcuguggagagugcugcugggaccaguuuuuguuuuggagggcgagacggcagaaagcuauuagaaaaggggccacagggagcucucaagugaugcaggguauauguguaucaucccugcugcuguaagagauccucaguucuccaaauaaaauauucaucacucccccaugugucuucucuaccccacuggcucuucugcagugcacuuucagugaguagagagagaauggucccucugguuuacagcuccuucuuccagcuguucacacggguguuugucugaucugucuuccugucuccaaaagagcaggacuguuagcagcauuacagagccuuuuggagcuccuucuaagcagccuuggcuauuuuggccccacagucaucucaagguagaaauggggccagaaccuuuccccuucaaggucugcuccuuuugcaguguucccucuaaccccucaugcuacccuuacuggagcaaaaccagcaugauuucaaccugcagauuuuuucacucuucucuucccaacucagccugaauuuuauaacaccguggaaggcuccacaauugaugaagucaagucugggggacuugauccacucugucaagugccccagaagauuuucugucuucugguuaaaagaaacaagucccugcuccaccauguuguuaucucccagccccucuccuuccuguccucuccucucuuaacugcucuuuccccgaaacugcccccacuccaucccuccaaggccucccgacaaggacaguuuccucuucaggugccauucugacaugaagcccaccaguucccccucuuccuuuccuuuccucucaaguccaucauaguucuaagagcacucaccuccccaagcaccaccugucauugauaagaccagaaggcuugaggagcuucaagucuagugaagugucagugcagcaggauggcauuauggucagcagcguggaccuuggaaucagagaccuguguuugaauucuggcccugucacuuaccagcugcauggccuuagaccuaaaccacuuaauccuuuaaccuucaggguccucauccauaaaauggggaugauaauauuaugaagaauuaugggaagaaauuggcuagagugucccagcaacguaugcaggagaggauagaaugaugagguccaggguacaguggaucucuggggcagugugaagguaaaagagauucugagcuaaugucuuagaaucaucaagugaaagcuuggcuggaauuggggaggcugggguaaacgcccacaaaggaaaggguucucagagagcacugcauucugaauaaaaacagaagugaccucagugacauucucugucuaaggcagguagccucagagacugcaugguuguuuccacuggguuuucguaagaagacugaaccagacaugcaagcacucgcuuacauguauguguguguaaaggagacguuaacaggacaagauauggagcacuuaauuuacccaguucucccucuucuuucucaccucccucuuuuuagcauguggaugguuuuucuguuugaacgccucuauggaggcauuugcaaaagucacuguuuucuggccaucuuuaaugcauguuuaugucauuugcagacaaauugaggcagaaggauccagcagguccuacagaaaaaaguacaguagaaaucccauaccucauuguucuucuccuuaccucuuuuccccagauaacuuauccucacagcauugagucugauacugagaaaagaaagccucugcaaguuuagcuucacugacgugagcaguucaguuacugcacuguagcaaggacuucauuaguuaucgaccuuauugcugguauaaaaucugggagcuagaccccaaaugaguuccacaugucccucagauccccagcaauuuugccauuggagcaauacuugagaaaagcucucuuuagccucaaguuucuggcugauuuuuuuggucuuccaucucuucccccagucuuagggcccaaaucucucuuccauuuaucaugucaccugcaaaucaaaucucuguucucugcauucccacaaccaucuaccuaugacccagccagccuuuuccagaaacauuccauacuuauuugacagaaccauuguuaauccaagaagauaggcagagcugccgugaugaagggcucugggaggcagcagggcuaagucaguccuccugagcugagaaagagcaucauuuccuagaugccucugagcucuuuucugugucgucuccauuuugaccguagacuccaccaaauccaccgcugggcccaugcgaguggcaguagcuucacuugcuugagugaaagccucagauccaguaacugggaaggagggggcucaggcuuuccagaggguggagugcugacugcuccuucucugguucugcccugugugcuugcuuccagagcuucccacagcuucccagugcaggaguuuuccuccuggacagugucaccaaauccuucccaugggguaucuuggagccacugugcaaguucauguuucugccccugaguccacccucccgaagacaaaggcagaggcccaggaaagacauuugagaugaacaagacuuuuuacuguuagaacagaaaaaucaaaguucaauaucuccuguaaguaugagagagagagagaugggcugcagcuuccaaugugagauggccacaagucccauguuuaaguucaaaaaucaguuacaccauuacaagaugaaggugaccuagcuugacagcaauuuacaugaaaauuaccccacaggguuuuauuuaccaccaacuguagcuaacagugugaagugacugauaaaaauugcauucauagagaaaucauauagaucaaaggagguaauuauucugcacugccuaaacagcaucugagauacuguguucaguucuaagcaguguguuuuuagagggauccugauaaauggaggggcauuccuaggaagggaccugggugguguagaauaugggauccagguccagguaauggaauucacucgggauggaaagaaaggacaaacacugauaauaccaaugguugucauguggaaggaggcaaggaacgaacacuuguguacuuacuguugcuaagugcugugcccauccuuugacggagcuucucucguuuaguccucaagguagccaguccucugagcuaagugauacuuggguucagagaacuuucuaaaagucauccacugguaaauaaaaaaaauggaucagauguguuuccaauugcuccagaguacaaaacuaagaccaguaggaagaaguucaaguuagagggcauucacuugaaagaggacuuuucuaacagugaaaugggcuucuuugaaggagaucgaaguugauagacaccgauaucagagguguaaggaugacauuugcuuuggggaggaagcauugggacagaugaccuucaguucaguuggagugcucuggaacucacuagggcuuucugagggcaacaucaggcccagaggagcugccaggcaggacggaaggcuggggcugccagugguccauuucuucugccuggacuuagggauuacaggccauuuauguccagcucuagcucagugccccagcuuuagccuaaugcccaucucagcugucuggacaagcucccauucuggcagcuuguccaucaagguuggaucugucucuccucccguuugugacuccacuucauugccacagcuugucuucccgcccaggaaaggguauuuggaagaagcuccauccugucuccuuuuccccauuggugcaaucuccuccuagcagcaucugcugaaagggguguagucauccuggccccagacagagcugucuuccaagucacggauguugacgaggccuguguguguaucugcaugcucacaccgcagccugaucgaugccugucagagcucagcaucagagugacagcugcauaccaggcuguuugcugaacacaacucguccgucaagggaaaucagaugaaauccaucuccuuguccaaagccuggcccgaugggcugugucuggaaugccagucuugugucccacccuacuuuugugcccugaaaaucauucccucggauuucaguguuacuucgaugggucccuuggggcagaaaaauuauaguuaagaaaauuaugugaaaagaccaauagucagcccuacccuucagggacuucuaguuuagagcugguaccuacuguauggauagugcaagucuagaacacacaagaauuggcauaugauuaucuuaaacugguugguauaaaaauagagcauaaaucaaaugcauugaauaaaaaaauuugcuuacauauauugaauaggcauuagccagauuaaauaguguguugcagacaauugguggggaagggucucuuuagagagucucauuagagacacaauuaugggguuuuaaggcuuucagaauugacaaggacaaguuuuggcagagguucuauguuuguaaaccauuuaggacugcaggaagcucugucaccccaugucuuggcaguaagccaaauagcugcuucuguuuccucuuccuaaagccucuuuuaucccauacaagcauguaccugaaacuucaagaagccccucucuagccucagccacuccagcacuuccauuucccaaggcuuugggcacuuaaguggagaauugcccuguuccagcucugugagaugcugugagcuaauucucuccccuuagccugcccugucuucaggagucugagugacucucaggguucaaaaaaaauggugcaggaggccagagauuucggaagguaauauuuuccccccacuaccuggaaaacuguggaacacaaaauuguucaaaagacagaagugagauaccugggcaaugggggaaagaaaucaguccaggagcaagaggauggaacauagcagcugagagagaguguuuucugggguggaaggggacuuacaaaacccacaagcagaggauggggauccuggauaaaugggagaccagggaaaagcccuaguuucagagcggcaccuuuuuccugcugguccucaaagggccuuucagacuagggaaggauucucugguauugcuucccuggagauacacuagccagaaucagccuccugcuugggccuccacucuccacgcuguccuacuccggcaggcugagcuuuuccccgaccccaggccuguggagugcagcagucaaagcuuuauugcccacacacuggagccgcucugcaauaaaagaaaauaaaacaagguaaugggaauggccgguacagggggcaggccccuggagaaaugggccugcugcugcccaucuucccagcaccacugaucgccgcuaaggccacugucaguaagucaucggcaguacccugggucuccuuucuggggcugagugaaugaccugcaugguggucagauggaguggcgguggcauguacacaggcuuacuuaugcagaccucuguagaccacaggccucagugccuucuccaggagacagcccuccaguggcaggaaggcagagaacagagaucggcaucucaccuccuaaggcaaaccagaguggggaggaaaagagucccacccaguggugccccagagguggccaggaacagagguugguguucuuaaagacagccuuggcuguaccauaucuaugguaagugcugguaacacagaacuaucuggcagaaggggaaucuggaaaugcccaaagggaaguggagggaggcacgagcaccuagcugccuauccuaccaagguccccaccucacacauagauuguucugcauagcagauaugaaugccuugcacggagguuggcauuagcaaugguucaaagucuccaguaauuuucauuuugucauguggcaugucuggcccuuugaccaaagagcuuuuaaauuccuccuccucagcccccuuuuucuucuuccucucccuggcuccucuauccccaggcuggauccagacuuguuaaugagccucggcuuuucuccccacacaugaggcacuaaaucuucccugccugccucgugaccuacaaucauuucccaagcucaccuaugcccaugaauacuuaauuuaaaacuucugcugccucucaguaguuuguaauucugaggccgaagucaacagaggaaacaaaaugggcugaugaauguauugaggaaggugagcagaaagccauacacagcaucucugugauguggggaaagccuuucuuaacgauuuaguuuaauaagauggaugucugcaguguagaguuauucuaauaggauggauaucugcccgaucuauuggccugcaggaugguuaugaguuuuaaauuuccacaucuccagggcaauaaauucucugggcuuuuaaauuauaaacuucgugguuuuguuuuguuuuguuucaguugggaaagcuggaaggauuuuguuuuggucagagcaugaaaaagguagauccagucaggggguugggaggcaggaaggugggccggguucuguucuuucagccuuaccuucuccacagccugugcuccucccccuggcagcucuguaggaccauggguucccauguucuugucaucucaguguggcugauguucccaccacagggaucuaaaggagccccuguagcuucaaaguuagagccccucucugggugucugcuguagcuuuccucugcagaguaauggcagcaggggaggaaggaaaugggaaccuauuggccuuacagcaaggggaugcccuaaccugaccaccucccagugcagguccaagaagaagagguugcagccaguggcucccagguagucagagaaguaaugaugaguuuuggggcugggcucaugcugagcaaccaacagagaauagaugcaacgagccccaaagguaaugagcccagaaugcugcuaacuggagugcuccgccugggaucacuggagaaaggagcuccggcaguucugugcugagggaaacugaagcuuccuuaaugacuuuuuuccuuuauacugacacaucacuccucggcccaagagcagagcaaccagggcuagcaggaagacagaugccucucccugggucugcuuccuggccuuucucagcaugccuucaucccccacucgcugggccagagccucuaccucggcugucucaaaaacuuagacaucugggagugugcugcucccagaugucagcagaaucaugcugccugcugacuagugacaagagccaggcucuggaauuaggcaggacugaguucaaauucuagccucuccauugaucaaaugaccuugggcaaguucuucucuaagccuccauuuuuuuauuaguaaaaugggacuuaaaacaaccacuucacaaaaugguuauaaggauuaaguaaaacaacaugcaugucuuugugaacuuaauucaguguguagcacacagcagauacucaauaaguguuaauucucuuccucuucccuguaacaaggagcuauuggucuuuccuucagauguggaauuggacaacugcagagccucuugccucgagcauuuaugaucuauccccugccaagccuggcuuuuggacagaaccuguguucaggggcaguagcuggaagggcgcagccauaaugagccagccuuugccccagauacuauaugccauggacugcauuuggaucaguaacaaaagaaaaaagggccuuguuucucugagauuauccucccuuuauguucuuugaaucaaacauucuuaaaagcaaagacaaaucaauagauaaguaccagugauuggcaucuguauuuccauuucauucgauucauuuagcaaacaugcacugaccuucuacugugugucaggcgccaugcuaggaguugggaccacaaagucaaauaguuuucugccacaaaaucaagcucuguuuucugccaucaaggaguuggcagacucaugagcucaucaacaaugagaauacagggugguacaguaguccccccuuauccacagggaauacauuccaggacccucaguggaugccucaaaccacagacggugccaaacuagacauauacaguguuuuuuuccuacauaugcaugcauauaauuuauacauaagguauaagauuaauaacaauaauaauaaaacagaacaauuauaacaauaugccagcaucacuacucuugugcuuugggguauuaagucaauaagaguuacuugaacacaaguacuguaauuccaugacagucgauuugguuacagagagggagaggguuacuaagugaguuacaggcggguagcaucuacagccuggauaugcuggacugagggaugauucaugucccaggcaggagggcaagagguuucaucacgcuacucagaacggcacacaguuuaaaacuuugaauuauuucuggaauuuuccauuuaauauuuucagacagcgguugaccacggguaaaugagacuguggaaaggaaaaccgcagauaagggggacuccuuuauauacucuguggugcacaacuggggcuucagaaaagauuuccuggaggaaggacugccgaggcugaaucuauaagaauuagacaucugcccagccaaggggagaggaaggacaugaauuccagugagagauucaaaugcagcaguuaggaauagcauuucgucgcugguaauauagaccaaaaacagcauucguuuaacaagauuaaaguuugcuucuuucucauaggaagcccagaggugggcaguucagaaccaauacaguggcaccugguaucagcagggauccaggccccuucauucuccugcucagcauuucuuagcacauggcuuacauucucaggguccaaggugucuacagaucucuagccauuuaccucauccuuccagucaggaagccaaaacacaggaagaaagcacaaagauagcaaaugcuuuccuagaagucccaccaagaaauuucugccgaaucucgcuaguguggccagugagaaacaagacuuggggauuguagucuuucagcugaccauacugaugcaugcaauaaaaggaacagaaaaaggagagaauggagccagggagauagaucucuaccacacacaguguguccaaaggcacagagauaugaaacuucaguguguguugagggaacacagagaucagucgacccagaucaaagagucccuguaguauaaggcaaguaggaggugguggaaaugagacuagagacacaaauccacauuucccugcagguacuaaaagugaccagugcucaggcuggggcugggcaggcagcaucuaccaaaggacuagucccuuagccuggcuaucaggccaggauucacaaccucuaguucaccacacccugcccucucucagaggaaagcucccauguaguucuagaaaucacagagaccugaccccuugccagugcuaggcaaacaagcugggcuaugcaucagccaaaggccugcaguguucucuuagagaacaacagagcucagucacucugugaccuagguacacucaacauacguuucuauucucacuacaugugcuuagcacaaugagaugagccaacaguuauugaguucuuauuguucuaagagcuugauauauauuaacucauuuaaaccuugugagggagauguucagcuuuauuacucccauguuacagcuugaagaaacugaagcacaaagucuuaaaauaacucccuccaggucccugaauggcagaggcuaaauuugaacucagauagucuggcugcagagcucucacuggguaccucugugcaguucugccaauugauaucacccugaaaucaagaggaaaauguuggacuagaggcagguaggugaaggcaggaccaggcacaaagcauuuugcuucucuuuuaugcagagaaggauugaaaauucaugcaucugaccacaucugguaaaggcugggccuucagccuuuuucuccucuuucugacuccuuugaucgcucuuguaaacauucugacucuaguucagcgugguccauucacaagcuuccacaugcaucauuucuucccaugucauucucccagccaucacaggauuuuuauacauguuguucagguuccucucguuccgucccuccuucccuccccuccuuccuuaaaaccagccccugauuccuccauccccgaucugucucagcaggugggugggcucugacuguuccccuugcccauccuucaagucagcucucuccagcuuuuccucugagcugcuugcaccuucuccuggcuucuguucuccccgucaucccguguuucucuaaugucuacuugcaccuccacugaccucagcauggcuuucugucccaaaauucuacccucguuccuucuucuacccugccacuuaugcacuauuucuaaagugugacccuagacauucccuaugcuggaacaugucugccuuucuccccaccugugaagucccauccuuuaagguccgauccuaccugaaagaguuucccgacucuucagugcucagagcuggcucucucccuugaaccccccuaguaccugcugccuguaccacucagcagucauguguuuuacauggcauuuugucauugacugacaggauguggcuuuaucgugucuucucaucuaaaucauaggcucuuugaagacagaagugaauucucucuccuuuuagaccuacugcagugccuaauacagugcuuuucugcuuagaagauaacaaaaacccauuucuuggucaguugauuaaagugaauguuaggucucuuuacauacuuacugauuuuuauacaugcacguucucucaacaugugucuucucacuuugaggaacccuaaucauuuuuugaauguugucauauguuucaucagcucaacuaggcaucccaguccuucucuagcccugcugucuuucuggagaugcagugcugaaccacaagcauccuuccuugcaguguacauuguacugugguacagguuuaaccugcauuuucugcuguuugucuggccuuggaagcugucuuuguuaggaaagcucuggacagcaaccaggaauguagccacacagaaggugcugcucagaaacaaaagagcccugccaagcacagucuuccccaggaauccagcacguucucuuuaugaagcacucuguagaaucgugcugcacaugccccagcuguggggacuggggcugaauuucaaacaaacaggaaaauagcccguucagagggcuuaacauguaagagguaauggauuaccaagagcaaguggauauaggacaagaugaauguugagauggaguuacuuguuaggaagaguggaucagggaaggcuuccuggaagacaaaaauaguggguguggguugccccuugcaagcaguugcagcuauuuucauuauguacuccuugauaacacauuccugaaggugauggcuuagcacuccuuuacugguugaugaacagaucuccuucuaagugggcucugccucccucguucgcaugugggaacugcagcuugucuggccuuugagccaugaugcaggaucaugauaucagggacuggcaggguuguaggggauggguugggcagcucacacaacaagcagaucaaaugggccagagcagaggguccgugaaggagagucagaggaaaugagauuggugacauggaagcaugacaccauugaauaugcucucucuuugagaagauacaagaugcugagaaucuccucugaguccuuuuuuauuuuuuccugucuucucugcagugucuucacaagcaccugcuuaaaauaaaggauggggcuuggccuuucccuuccuccucccugcuccuuaacuucccacucugcauuuuccugccugcugccucuaggcagcagcucaggagcagugggcaauugagagcaacuccugagagcacuaaaagaaaucacauugcuuaaauggcauuuacaccgagggguggggugguaguggcaggagucucaaagcuuuuuccgagggcacuguggcaagaaguccauggugggaagaguggcauccagguguccucuauccaaggaggcagcuguucuuauucaagggugggguccauuuucuuccuccaaagucaaagagauucucuuuaaaagcucaauugugacuucugggacaucuuagcaagagacacugagcgucuucauuuccucucuccauuucaggacacaccucccuuggaggagugcuuucuaccuggaaagcagugcauguaucaguggaauucugcuuagcacaacagaauugggagguggagcagggagaaugaggccacccuggccccacuggggggucacaagacagcuacuucaugccugagaacagggcagaaucaggcugggcaaauaguagggcugagggacuacccgcugcauccuaugaccuuguuaacggaauuguauuugggacauugguuugaaguggagagagaacaauaauugaaauuaaugaaacccuggcuccugucaagcagaugggcagagagucacaucaacacccaugcugcugacccauccuacagauuguucuuucccaucacuaauauuucuccguaucucaccucugaucucauugcaguggcuuugagaacuuuuaggagcugaucacaaggcccaaaaaccaucaagagccccuguccugggcaguggguaaaguggaagaaggaguguggucccuguguggagaagcuguggggucaagaugcccgggcuaggcaaggaccacugggucccacagcagaaugaggaaggccagaggcagcacugcucauugugaccuauacguuucuaggucacaaacugcagcccugcacuaggaguuugagagggcugcggcacauuagagcuccacucugaggguguaagccaugccauauuuuaauugucauuagcaauaaaaaacuagcagugaggaaacccaaccuccacacagaagagggcaugggccagggucauuaaccaggcugauccagccucugacaugcugcauuuauccuuauuucacguguauguguucaaaccuuauaauugguagcuuuuacucacaggcuuuuccuugcauuccugagaggccagagcaauccugggccccccaggucauaccgagcaagaauccaguuguacuaugcauaggagggugaaugcagaauagccuucuagcacuggcgcugcaggagcucagagcccaggcucaggggcucagcgucaucucaaaggccucuucacuuuccuugcuggguuauaauagguuugaaacaguuugggaacaugcacagucccccacaguguccagaucuucucucuacugugccuaaaggcagcuccuuagucgggugagaggagaagcuuggacuuuuuuauucuguguccgaucuggaguguagguuaacggggcugcugccucccugcaauggugcuuuuguguggaucagaaaaaguugcccucucugggccauuguacucagcauaugcuaugcaucgcuuggugaggaaagcaggcuucugucaggcuuucugcuuggcacauggaggcaggguagauuuaaggacagguaggagugaguuauguacaggggcauaggacugccucagaggggaugguaccuucaagccagccuaaugauaaaagaggcgugaggacaaaaggaaagagaaggggcaagggagucccuuccuuucacccucuggugcuuucagcugugccuuucaugcaguuaaucaaacauuagucagggagggaugggcauguguuugguugaaauuguuuggcguuucuuauauucaguuuuaugaagcaaguaaauugccugaucccuagcugagaguauagaauuaucucuguucaguuaucuguucaaacagauucuucucucuggugccuucuucuggccugcaagagggauuggcgucugugucccuuuugccaagaaaucagaugguaaaagagaaggugcuccacguccccuucccacccugacaugggacacuccugucuuauccuggcagcuuuuggccuccacacccacagcccaguuuugagaacucugaagggauugagcuagggguuggcaucccaaucuaagccccggauuccuucaaacccaacagcaacugccuuuccucaaagguuuccuuguuccagagggcucgagaccagcaccuggcgggugacuuguagcuuccagccgucucagcccguguacuuagaugcuuccugaggugacuguggccugaccagcaccaccuaaucccuugcuuggagggcuucacgcuagacaguggucugggcuccggggguccaggcuucauggcaucuguggccucaccccaccucccaccucugcucaacgucguuagcucaugcccuauccucacagcucuuccuaggcucucucauguccacuuuugcucuucaccccuuccuugcugagggauggguggugaggaggugguggaugcgugggagaccggagggaggcacacacggcugcugccugcacuccugccuggauaaacagaggaggccauccucacuccaguuauagucaguacaggcaaagccaagugcaaaacagccccuucuguucauggcgucugggcugugcugccucugagucaucacugcuggccucacugacugaagccaguuucugccccucugggucccacaagcaugcuugucguggcaggggcagcugagggaugguccucucaccuucgaggaguucuugaaauaggccuucuccagucaguuuggugccaugcauguacccaaagguaguauucuguccagggacuuuccuucucccacgucacugcuggcgaucuggagaagcuagaauauuuugccuuuccucaucuauuuauugaaugccuaccaggugccauuaauaaaugcccauuguaauacugucauggugauaugaguaaagugcugugagaacaagcccuacccagauaaguaauggagugguucaaauaaaaucacaucugugcagaauccaagggguaaguuggguaggaguuuacaggugaagucauaggacggaacauuccagccaaaaugaauagcaugugccaaggccuggaaccaugcaacuugucuguggagcugggaguuguguggccugacuaaagcaaaauaaugaaggccacaauggcaggacuugagagcaggaagagcccagcucugaggcgcuuauucugugcuguacugaggaauuccaacauuaguggagaacaaggaaaggauuucagcagaagggugaagugaucagauugggaaauuuuuuuuuuuaaguaacaacauuuauugagcacuuacuauucgccagacucuccuuaaguguuuaacuugaaucaguucacuuccucuucacugaagcccuuugagguagguagcauucauuauuauacccauuugaccacaagguaaaccuagacccagagagguuaaaaaaaaacccacucuagauuaagccaguaaguaguagagcaagcgcagaaggagguggucuggcccuagagccugcaucugaccauggugcugcacugccugugaugagccacacccuccaguaucauggagggguccuuagagacaagucugguacagagacagcagugggggaccuguuacucaaagcugggcauggcaauaaggauaaaaaagaggggaagaauccaagagccauuucugagguagaaucaguguguauuggugcggaccuaccuguggagcccaggggugauuccugugcuacucaugcugcggccugggaugagaaauggagguggaagaacagguuucauagugaaggugagagauucagaaugggacucauuacauuggagauucaccugguggagcugaauucugaagugagcgcugcacuagaggcgaaaguugaguucuauaauucagagagcagugggaugcagggacugucuacagcuuaaaauagccccuggggaacguucauauucaagggccauguuguuggggaagaauucacaauugcuacuaagaaagcagggagaaaaagccaagauugggaaacacaggccuaaaaaaagaaaguuuccaaaaggaaagggggugcuugacuuuuacagauauuuaaaaggucaaaaaugauuaaaucugagaagaaauuauuuaaauggcaauuaacaggucuuugaaguaauagugacauuggaguacugacugguagccagcugcauuggcuacagaagugaaaaggggcuggcaaugugcagaguacucucuggguaaagagaaagagguagacuugaugggauaugagucaaagcaagacuugcuaagaugggcaagauguuugcaggugaagaguuagaugccggugaaaaaggaaaucgggaaggugaugacagaaagagguaacugauggaaauggguaccugaggaagcagaagagguugugaucuggagccaaguucauuucuuuuucugcaagauggauggaagggaaugaaguaaucauggaugcuaaaugcuucuuaacagcaaagugugggucuccgugggaaacccacugugguucagguauaggagccugagaaucaagguccacaaagcagagcggacuggccccauugggggggucacaggucagcuacuuccugccugggaacagggcaggggucuguaccaucccacagcaggccuugaggucaguuauauagguacagguaccugcagaggggaacugacacgugaacuugaccugauuggacaacauuugguuacuuucagaccaagucagagauuuaauaaccucaugcaguuacuccauagaucauacaccgauuuuccccaagaaaagaggccaacugucuucucacaccccuagcuccaucccuuuagggcuuggguacagcucuaaagccauagagguucuuuggcugggccugggagaacaugggccacugcugcugacuccauggcccaaaccaguguucaagauaaagaacggacgcaccgaauggaaggcagccuucucuccugguuuuuugccugggacugcccuucacgucaacugggaacaugaggaggagcugugccauucaggcaugccugcucuggcuugggagaccuuugggaagauggguccgggacagaaugagggcccccugauucuagccacaucccuggcaccagccucagggaagaguguuaaaucucccuccagcuuccagcacggguuuuuccugggaagaugaacagucugcuuccuuauugccugcaccaaaggaacagauugcgucaguuuguaaacuguguuagcgcucgcaaaggccuggagucagcagguuugcauuucccagcagacccagaugaugcugauggcaguggcugcugccucacugccucaggcaggaccgaagcugccccccuaccccuaccaucccaccccucaucccugagguagggaaaaggcauuccaggcgggagagaaagccacccugagcuucuagagccagcucacccacagcacaggccuuuucuuuucaggagccucuuggccccucuugcuggugugccagcccaggccugauuuccaggcauuccuagcacuccaaugccagaaaagagguuuucuagaaaagcaauccacucugugggcugcgcuugaaagaguuaccuggucuggaggugaugggggauuaggagcagaggcgucaguggggaucagaaccacauugccacaguagcacauggaaaauccgugcugcugccugccucuagccagcccacuccccacgguugcagaugguaacgagacccaggagguauugcauaggcacagccucucgccuuccacagcaucgccuuauuaauugcauuguuaauguucaucaucucugaaagaagucgguguggcugugugugaccgggaguggaggggaugagcuggcuguguuaaacuguuacuguguuaaggugagguaucucuucaaguucacaguucuggcuguggcagcaugcuacagccuucacgcagcaucagugaugguagaaaacccagccuugggcaaggcuaccacugcauggcaggaaaggacccaagcuacaugcugguuacuccagaacacuacucacauucuugaaaaaagcugcagccaggaugaguggguugggaagaggcaggaguaccuugggcuccgagucauuauucaguucccgucucuccauuucccgcgccccccugcaaguucuccuacaggacuugaucguuagcaaauggggcuucccugcuugcccuucucuccuguggaacuguugcuuuucaucucuccuguuggcuugcaggcacagucugucagcuuugcugcccccauucucugaccucagagaaugcagagcagagagaaccuuggaaacuuuguucaacucucauuucccagauggagaaacuaagcccaaagagaggugcagugugcccagcccauaagaggcaggauuggcaccuggaucacaguucuagcccagggccuuucucugcuccucagcuccuucuucccauccaggccgcuugcugugauuguugcugguugcuuuaggaauauugaaagcaggaauauggccagacagcacauggaaaugauggagaauucugccucuaaagccugucuguggggacucugaugucaccuucccacagguagcccugagcagccccacccugcuaccuggaagaacuuacagccagcaccccacuuugugcagugacuuccuucccagaugccucagggcaguggcgcccugugcugggcucuuuucuacuugggaccugccuguccugcuugaggcagcccaccuuccuugguacgggagcauccuccacaacuguuuucaggcaaccuacagccucgcaacccagggcucugagguuggcugaggcucaguaauuuucuguacugccucaggcauugugcacugcaguaacgccugugcacuuggggaagacaguaucucuucuccauccucccagaaaguaaaaagggaaaggcuuguauguguguggggucucccuguccuccccccauugcuaguaaauccccugugugaacgcucuccuuugggugcccugagucaucaaggggaaugugcaucccccugcugucuuucucuagucuccauuucuuaauuauuuugcccccagugcccucggcucccuuauuuaagccagccuuaccagaagcagccuccagugcaccuucucccgccucacccuccccgcaacuucaccaugaccuggaggaggcuuuaggagagggaccuggaucuucagcuuugcgccuacuuggaagcacuaggcauccagcuuggcugcaggcuccaggcgaguuaaggacagacacagcuaaaucaacccccagggcagucagaauuuccuccgugguuugaaagcugaguucuuaaauaaucuuccccacacuuaccacaugcaugcacaugcucacucucucccuccccccaccccaaacccuucuuucuuuaggaaagauuucagaaucugaagucuaauugcagagggcuagaagaaguugagaauguugacauuucuaaagccaucauccauugccuggcuuucacuucucuuccuuucuccagaccccucagcccugcauuguaccccaggccaagaauaugccucacugcuuagagaaggagaaggacuugguccccacugccuguuugacugaaguaguuucuguuuuaaggagcugacagaauccagacaauggggagaagaggaacaguuugggguggggacagggaccaaguguauauuucuggagcccagggcacugagacugcucagaaaggggccgcaggaaaugaaacaaguuccuggccacccccuuccuccauguuugauuucagccacggagcugggggcugcuccaugcucuucuuuucuccucccccuucuccccuuccucaucccugggaagggugagaccacagcucggcugggugaucacugagguauguguguugccugggcauggggagcucuuccucgguaauuaggagacauggaaauuaacagccugugccguuuguauuaauuugguaaauaagccagaacaauuucauuaguggcauauuaaugugcuugggagcaggaggacacgucccacugugaggcagcagggcccacuggcugcucuagcccacagucaggccagguccagcgucgagcugcucuccugcagggcauggcuggcuggcagcacccaccgcuuuggcccugugauggggaaagaccuccacugaagagaaagggaucugugcaggugguacagggacagucacacacuugagcucauccuaucaaccccacuugccuuaccuucacucgguauuucaugggaggacuccccggguguaagaaacccaaagcuuucagagucagggagaauaaaggagcucauuaagcagggauuggccauuucugaugagaagacccuucucaucagagguauacagcucagcaaagcaggacagcugcugaauguaaccaucccaccagggcaucacuggcauuuguugaagggaagaggaagcaguuuuguuaccucauucagugcacaggaccccuccucauuuuaccauuaaggaaacagucuaagagaggucaagugaauuacccaaaaauucacagcuaggacugggaguugauaucugacuccagaauccaugcucuuucugccaccucaugggccagucagugugcucagcucuggagaaauuucacagucuggaacaagcuuccuuccccauggagcugacagucuacuuggagaaugaagacauuuagaaaugaaauaacugccccuaccaggaaguaaauaauuuaugaugaucguguugaagcauuuaugugcuaagcacuuuucuaagugcuuaacauauuuauauuaguucauuuaaucauaacauccuugagguagaugauguugcaaucccaguuuuacaguaaauagaggcacggagaacuuaaguggcaccccagaauucaugcaggucuagauagucuggagccagaguccacacuuauaaccuccaugcuguacacugccccacaagugccaaagggagggugaacccauaggcauucagagggugauucaugguaggccagggaucagggaagccuucccggagaaaguggcauugaagcgggcaaaggugcaguccagguauucagcaaccucaaaauccccacccacucugccagcaucaagagcagagagcaagagaugcuggcagaccagcagggcugcaagugaggcagacugcaauggcugucaacaucugaaggucacauugaccuucaagccucuaggcuguucgcuucuuaaccaguuaccaccaagccccuuccucaguguggcaccaccugccccuucuuauagucucucgggagguaccccccucccccagaaccaugugucuuccuaggucucagcuucagcaugggcacuaaguagaggggaaucgagaggagagcccucaucugucccucgcccaugcugcuuguguacaugcacacacauacucuggugcccucaaggccauauccacccacaugugcacgucagugcaugcucucauacgaagccugcucccagccuucuagcagccugugguagucaccuaagucaccuaaggccuaaagucaccugccauuauaggaggccuccuguggaagcuauugaguccagagcucuuccugaaacacuccaagaugcccaagagaugaguggcuauguuauagcaguuugcaaauuacacaacacuccaccaguaggaucucauuuaaugcuugcaguagccaguuggacaagaagaaauuucuugucuauuuacaggaaugagccuccccuaacgugucuucuguuugaggcaacuugugagacaugucucuuuauagucuccaguuugaggcaacuugugggaauuaacucuaugugucuauacaguauacagucgaucuucauuauucaccgguuacauauuugcaaauucaccaaaaucuauuuuuguaaccccaaaaucaauacucaugguacuuuugcagucauuuguggacaugcacagagugacaaaaaaaauugagucaucuggcggggcacauuuccauuuuagguggaacaggguagaacaagacaacacucugccuucuuguuucagcucugaugauauaaacaaguguccuucucacaaucuauuuagcaucauguuauugcauuuuucaugcuuuuuguuggugguuucacagucuuaaauggcccccagcauagagcugaagugcugucuaguguuccugagugcagaaauacuaggaugugccuuauggagaagauacauguguuagauaagcuucauucaggcauaagucauugugcuguuggccaugaguucaguguuaaugagccagcaacacauauuagacaaggugucuuuaaacagaaacacagaacaagguuauuuauugauuugaugaaaauauugugaccagaggcucacaggaacccaaaccugcauuuccccuaggagcaaugguucaauauuugcaaauucucucuauagaacaaaauuaccauaaauaacaaaauugaacuguauguauauaucucugugucuaucuuuuaauuaagagaagaugucagagaaauuugaauccuugaguugaacaaagaaauaauacuuguacaaacauagacccacauaauguuacaguuaagucauaacuuccuggcagucaauguaaaagagaaacaucaaaggaugaucacacacauacaaccugcuuaaaccucugcuuucaaucuccguaauucucccagaguucaagaagcgucacaccgaauuccacagccucguccaggcugagguuuguggagaaggagagacaccgcaugggguuuggcuagagaggagccagcccaccuuccccgagugccuuuguuugauugagaaauuacuguggcuguggcagcuguaauaaaagggaacagagccccaugggcgacagcuuuaucgccaucuacaacccaggauggauucgguggcagcacugugcccaaggccagagauuucuuucaucugcggcuggcugggcccagggacuugucaagcccaaguuagcauaucgauugcaggcgacaggcugguuaagugugaagcuggugcucaccugcgcaggagagcccggcugcacccugcaguguuggccccagguguggcugcucauugcuggguuccuucucauguaagcccuggagaaaggcgagcauguggauugcagccucagagagcgaggugugaaugugggguuugccauguggguuggggucugagcauuggcaccucacaggauagacagcaacugugcgugccugguugguugccucugcagcguaucucugacauucuugcaccaaccccagcaacccagugcuaagagccacacuggcccaccacaagcugucuaguggccugccaggccuggagagaggccuuguguccaagcagggcagacauccuugguuuuagggaaaggacacuuggcuacuaaaauuguggaagacgagaggucagggaaugcggaaacugaugugggccugggcucaguguuggcugggaacuguaccagccucauuugcuuuugcccagacauguguccaggaaccccuaaacacaaggcaagcaaccucucuguucuuccuucagcuuccccagaauuccucuaggaccugcugcuucuugagcuuagcauguuugauaaagcuuggcaaguuaagaugagcaagagacagucuucucauguaucauuuugccccucacaggucuuguccaccccuaccacacuacccccgccaccucccccagccccugcaggcaugacagucuguuccccauuccuggccucccacuggaggaggcgcucagucuuccaguggccaagcuucuccuuuguuccagcgcccugggcauuugcaagguggauccaagguguugaaaccugagcaaccucagauuuugcccaccugcccuucucuccuacaagaguagguccuucagcagguuaguugccaaaauuagagauaggagaaacugguuuuaacacccacagacacuggacucugucgugaauucaggcacugggucagcccagcccagaauuggggccagcacuuacgcccagacucuacuagugagcugcagggucccacgguccuggaugguggagggggcagagguauggcaguggaaggaagggcugcuccugaaacagaaggcuguggaaaggggguauuagggaggggcagggucuuuucugccaggaggcaguguagagaaggcauuggggaaaccuggauucugcucucagcucugucccuuaauagcuacacuucuccagugccaccuacagaaucaacauggacuggaccuauauguucuccauuaucucuuuuucguuaauaacucuaauagacuccacauauccccuucuauaccacacuccaacuucaguugucauugaaccugcauuuccucuugaaggaucaaaugugggccucaaggacgcagaggguauucaaggaugggaggaagcgaggguccugccucucgggcccugccuguuuuccuccccgcuaccuucucucugcacacccagaccaccuccuuguccuucuggggaggcaugucacccaguaucccucaucccuucuaaccuucugucacuagcuccagcuccgaccucgagaauucccagguauuuagacauucauuuuauugcuuaaucgagcuugaaggcauuuaaauuaauacaaguuuuuacauuuggcagcaaagacauuuauaggccccuuuagcagggaaagaaagaggucaggagaaaaucaaagaaggaauuuauccugggcaguggccuucacgaugugggagcagaucagcuaccacgagggccacgauccugaggcugcccuuuuagaaaagcagucagugcuaggucuguuauccuggguccucgggaugagacagucaguggaggaggccuugaggcccguggagauuccuugagggcucugggguucagccacagcccacacccuucuggccacuccuucugcgggauugucacucacugcccuugcgcugaugcauuuccugcccgcgucuuucugccucuccuguccucucccccucuccucuccugcuuuucaugcaaccacuuuaauuaccuucauuagacacgaauucauucagcucuaccaggaaaagcagccucccucuccccagggguugccucgcucccuaaggaccugccugucuucuagcacagagcuggggagggugcugaagagugggaggcaccaagaccucugccugcuucuucacuugcuccugaccuucagcugcgcucucucucucucucucagguuaaggagaaucccguuugccccgguagcuuucugccgcaaggaggggaaggggcucugagaagagagucgaguuuuggggugugucuguucccgugagaggcugaaauugaaggguucuggggguucccagagguuggcagcggcugccaaggccugugagcccaaggcuucggcgcugcuguccuccccacgggcacagccccugcacacucaggccuggcccccacaggcuuacgccugucucucugucccagguggagguggagguggagagcauggacaaggccggcaacuuuaucggcuggcugcacaucgacggugccaaccuguccguccugcugguggagcacgcgcucuccaagguccacuucaccgccgaacgcagcuccuacuacaagucccugcugucugccgaggaggccgcaaagcagaagaaagagaagguacauguggcagcccagcugugcucucccugcccucccguccuccucacacacuaaugcugcugccuccagagaacaggaggaaguucucucauccccacagaguagcccaggaagguguuggucucagaccccacaccaaggccacacacaggcgaggagaggcugccagcugagguguccucggccacagccuguugcagaccugaggugggccugggcugccagcccagaaugucaucagugaucccaggccugcucaggugguccugaagcagaaaucugucuaggugacuguggagccaugggacaaaaugcccggggcgccccucccuccccagcccugacccuucucugucagugcccucaggacugggcggcccaagcccacaucugaauuuccuucacauugccccguggggaaacaacccuaggagaggccucuagcuguuaggacaagagauuuauagcccaucagucucugugggcaccgcauugaagagacaagggggaugggguggaaaguggcuuuuggaaaccaauugacaauugaggaaugcagugauuuggaggugggagccgggcucacccagccuguugcuuuugacuuauagcccggcccugauaauggggauaaaucagcuggccaccaauuugucagggcuucucugagcuugaggaggauucgugggacagccgugcugagcuauaaauuuguuccaggaauaaaugcuuccuuccccauggggcagccaucuggcucaaaacucacuucccagagcuaaggcccggacaccugccaaaaagagucgggggcuuugaggccccagaagcaccagauucuucaccagccccaagcagcugccuccucauucagggcaucucuuguccccuugggacuguccuccugggucucucucuaucuauucuucccuuccccuggggauuggggcaggcaaccagccccuuggugguagaggagaguggagguggaaagacuccagggaaagguggaccacaaagcuagcacagaugaaagggacggucagugcccugcaggaggcagccaccaucagaccucagaggagauucccaccuccugcucacaucaagccuccuccucccagaaugagggggaagcaggcagccucagcuccuauaggaaaggagucacacggcuucuuccuggauuuccugcuugugacagcugaacuuaagacugccacccccauguccucugccugcugcagggagagggggggaggggcagcgcuggggccuccuguuuaaagguuggcacuuucacagaagaguuagcagcuggggguagagcggcaagccccagagucuaacgcccagaggccaaaagcaucuucguccuugcccugcuuccuggcuuuucagcagugaaccuggaagccaccuuuucagagcugggcgauccucuacccucuaagaguagagacucuagaggaacccaggggagcacagggaggggacucuggccugagauggaaggguggguucccugccaggggcugugcugaacucagcaucguuauuuacugcacaguggguuugucugaaagagcccaagucaccauuuugcuggugccacuugaugacgcugaggaguaauuaccagugauuaauuacuuacacggccugcguguuuuuauuccaguccaauuaaaaugcagugcacaacucucagugcuagggccugccgccuccugggucccucuccugcaaaucccagucugcucgucaaggauccugaggaaccgaggcuggcuuucuuccuccuggaggggcuguuucccaggagcagcacuagcagagcuuuguagcagcucuaagaguuggcugaacccugauaagagcaucugguggccggcugggggacaguaaccugaguaucugggguguacccagccuugucccacuugaucccacaagggcugccuuaccugucaagagacagugguuacaagauccuguuagcaucaggaugcaggaauguuugugccuguagcuaaccaaggaaagguaaugcugagggauucugugagaccaggaagugcagaaggcuuuagggagugugauugugugugcaugcauucgugagugugucugucugggggaaucugagaaugcugguuucccagcuacgaaggcuuaacuaccucccugcugaguguaauuccucccugugcccuguggaugccuccucagugaagaggccgauagggcucuccacuuccuuggcaggagguaacccccacuuccuccucagcagcccugggcagaccugaggaccaaggagggaaccacagauggcagaugccuguccccccuccuuaaccccaucucacacacgugcucagcagggcccugcacagggcuggauuggccaucgauuggcuuuuauugagcuuggcuucccugcugcaggccuaaaggccuccgccaccuuggccccucgccagccccaccccuggagccuugcaagcagcaauguuaaacaggauuuagaaaggaaagacuccagccaguggauucucuguccacaguccucaucaccugccaagagaaggaccugggacucccugaggaggaaaugcagggaagagagagagccagggcagggagaggagaggagagacagccuccauuccugaccugccuggucugugccuggcuugaugggcucuuucccucaggguggccgcagcaacagaacacaaggagccccaaaguguagaggggacccgagcaagacaggaacuugcauggcagagcagccuggagcagaugaacaggcaggaggggccuccauccacccuucccagucuugcucuguagcuggggccaccggggguaccagcagugccccaccaggggcagagcuccacccuggccuuggccuggagagacacuucccccaccugaccgcaaacccuggcaucagucagcugggacagccucuccacaauagcaggcuuaguaacagccucuccacaugcuuagaggugguccaugagaagggcagacuguccugugguuggcucucccagcauuccugggcccugcugcuuaggucaagcucaggaccccuguucucugcccagcucuuuggccauagaggcucuuccccagcuccuccaucuuucaagaggcugggguagagccauacagcaauaauuuucugugucuggguguacaacuacuguuucuucuggaguuuuccuugucaucuccccagagguccaggaagaggagcaucuacaauggggauucccagaaaccagcuucuuaugggaaaucugagcugugaggggcugaggauggcuguggaaaguggcugggucuggcaggugucuugccagugagugugucuccuccaugcaccccagcucugcagaagggcagccugagccaaaugcacccuuguucuaaggauggggacaagggcaaccacgccugucccagcugacugacuccuucccaccaaggugccaccuggccagccugcauggaccagcuugcccauguggcugcaagucccaaggaacagcuggucaccuccauccccacagggaaagagggaaccgucauggcugcacugccugaagggccaaaggucagccucuccuagaaacacaguuccuuuaucugaggagacagcugucucucuccuacccucuguaugcuucuuggcaaccucaagugccagccacuuuguguauggagacaccuugcuucugcugucuucucaauucagguggcagugugcaccaccccacccaccacgaagugagcuguggcaccuuguuacaggacuggcccuagugcugggggcugagggccauccccaaggcuuugguuugcaucuuccgugaccucacgccugcugcccaccugagccugcugggaaagaagcuccaccccacucuccccaaggaggacaccugaugcugucacccaaggcacuuuuacuugaggagucuuuagcaguuucugcuuucauccuguguguuccgaauucaucaacacugcugaggggccgccuucccccaagccaaaggagcaggguggggcuaggaugggagcccucaacagcuugcaggcucaggggccauggcccacucaggaaccagcacagaaugccggucucuguuaacaagcucagugccgggaaaggagggagcuggcaggaagagggaagagcaccugcaugggaugcagagcagaggacgugcugagggauucaggacugcaggggugccugcugguaggaaugagggagcagacuccugggucaggagggcuccaucccaguucacuuaagguagugcugacagucucgucucugaggccgagugagucccacugauccucagagcugcaagcgucccagaagggcugggagcccaggugucaauaggagugacuggcuaaguagauaccagggaacuuccagcucuggaggcccagggcaaaagccucaggcccaucaggacauaggcuuggcaucagaagcauuuauggcucucuccuggcccuuucacagggaagcccacaagcuagagacccacuuccccacaugggcaggaaggcccuugagggauuagggccucuguccugacuagaggcaaagcuguggguuaaaguccugcugccugccuccuccccucuggccagccagggcuuaggggacuagaagcagcaguguguacagaggucucuggugauggggacagguguuaggguaucaggagccuggaaggugagaaggggucaggaacuauuuggguaggaggccagaccccauaccaggggcccacaagcccagccauagaaggcacugcuugauguaggaugguggaaagcuugggccugggagaugucucagucauucccccauagccgcuccuucuaguggaagaacacacgcucaggccgcguuaaaggcagaaguguggggucuggguugacccaaggugguuccagaauuccagcauuccugccuuucugcuguguccugaagcuccugaggaaucugcauuucagcugagagagaagaaaggggacccagaaaaguuugaccaaugucaaauggcaaguucaaaaacaacagggacauaaguccucaucucccuccccaccccccaccaacaaacagcuuuuuccuccugguuggugguguuuucucagggauaccuagucaaugccaaagugccccuggaagagcuguagugccaggcugccuauguuugaauucugauuucacuacuucuagcugcaagccuguguaccucaguuuucccauuuguaaaacagggauaauaccaagaccuacucaaaggguuguuguaaggacuaaaugaauuaauauuuggagaauguuuagaaugguaccuggcaccuaauaagcacagaaguuuugggcaaauacuuuuaaucauccuuauuccugugugcgucugugggaccccacgcgugauccauucucugcacucucccacccacccuuccugcugcucagcuggaaagccaccucccuccccugcucugacagaccucaccauuuggauaaucuccuggcugcaggauuggacuugacacgcugucgcgucaaaucagcuucugagccacugcagcccugacagcacagggcuuuggggaaggaagggagagagggaaggguggagagcgcauggcccagcuucugggcugaggucagagcaaccugcuggaggugaggaggauggagaaagggaaaguugcugagcagaagcauucuuggugagcucuuccccagccuagggcuguggcuuggacugcuucaggagcaccaggagcccugugacagcaggagguccugcagaauucagagugcccugcagagugccacggggaagggagauggggagcuggagcaagagaggugcgggugugaggagcccagagccaaagaguucaugaaagcagggcucucacacucggacgugcaugagauagccugggaucugguuuugcucuuuuuuacucucugggaugcucagaacagauuguaauuugguaggccugggguaggaucuggggccugcauuuuuaauaaauucccuuguugguucugaugccugccagaauuugagaacugcuagaucaggacuuuagagaacucaccuuuccccuccgagauagagggcuucaggggcucagccuggugugaaucgagugccccacagucacucgcccagggccgaucccauuugcccaaaaccccuuucccagugucuuuuuuuuuucuucuuuuuugagacggagucuugcacugucgcccaggcuggagugcaguggcaugaucuuggcucaccgcaacccgugccucccagguucaagcgauucuccugccucagccucccaaguagcugggauuacaggcgcccaccaccgcacccagcuaauuuuuuguauuuuuaguagagauagaguuucaccauauuggccagucuggucuugaacuccuaaccucgugauccacccgccucggccucccaaagugcugggauuacaggcaugagccaccacgccuggccucccagugucuuuuaugacuucacuuccucgcccucuucucaccucugccgacugaacaugcaggucugggcccacuaugaggagcagcccguggaggaggugaugccagugcuggaggagaaggagcgaucugcuagcuacaagcccguguuugugacugagaucacugaugaccugcacuucuacgugcaggauguggagaccggugagugcucaggccgcuggcucgugguuccuggcuugguccagcuggcgcugccuggggguagggggccucugcccagugggugggaggaacaaugccuaggcaguccaggagccuccccugaagagcucacguugccgccccugucucccugccuugucccacugcuccucugggcuuggaguuacuucaggagccuucacaugagcccuggcuugggcucaggcauggaggugcugccggacagguccucuggacgcaggugagauaaccagguuuaucuggguggagcucugagucucuuaggugauuguuuguuccuacauaccccuggcuaugcugggcaggaugauuuguagcccccagaaucugucaggcaccagccaggcauugcucagcccguuucccucugggggagcaaggaguggugcuggguuugucucugcugggguuucuccuucucuagagguuaacauagcccugagugauagccaguuuccauggaaacaggcagcgcucuaggggaagacauccccgggcagucucugaaggaccuucuccuccuuccguccugaguggugugcacuguggccaggguccccugggcagagaccugggguuucuggaggccaaagggcaggagagagcucuggcagccgcuagcccgacuacaccuccaaccgcuuacgcuuuccacccugaccucccuuuucucauggccacccugugcagggaaacaguugaguuuggagcggaaggaaaagcucuuagagcugcuucuggaucccaggaaacaaaucaugguaggcacagguggacagagggggcuagaagugucagcagcacuugggcagucccccagauggcaggacacagcucugcccagccuccucagcccaccccagguccgcuccagccccgucucagccacuucccucuaaugcuguuucccaggcagcugccuuuguggcagugucauuucaccaggaaaaacuugaccauuccuggcccugggcuggcugugcuugaaaaaggaaaaacgcaagggggagggguagagauggagcccacgagccugcgggauuagguucucuugaggucagccacaguccugcugaaagcugcuccagcaguugccugaaugaaccggggcgguggccagccuuuagggcugggucaugugacagggaaggagucuuguagugguggucucagugggaacaagagccguuccugggcagaggaaccagcuggaauccaccaccccaaaauccccgccagcccaccagagaacuugagcaaaaggaugcgaucacucccaggcaggcucuacucagccucuggguccugcuggggaggacccgccuugacucagaacaagccccugaagucuuagagagcagaaaucugaggcagaaaacaagagaaaagagaaaaccauguguccuuagaaugcuggaagagaagggagugaggcccuuccuggcaggccaccuggggauuuguggugggcuccagagaggaaggccccugcccucugguggcuccaugguauccauggagaugaaccucaggauccacagcccccucucugcugaaaccuuucauccccucuuggguggcauccucucacccugucucccuucuuucaauuagagucugucuucaagagggaucugacgaaaacauugccauuagcugcaaaugaccagugaggcucuguaaggaccucccagagggcuuugccuguuggcaggagacaaaguccugcuucuguugccuuggagcaaaaaaaaugaaaguagaccaaguuagggaggaagcugucugucaaggcuucuuaaucccuggaauuucacugucuauggcaaggagcacugucuaaagagaauuauagagggcugaccacuggguagggagaggggcggcugcuaccuucaggccucugucguguggaugcaggaccaguggccucugcagcagcuuaagaguggacauacaucccugcaugcuuaugcaguuuauuuucaaugcagcugaauuauuaagcacccugcaugcauuggggauucuaccaggcuuugugcaaguaaacagaaagaagugagcuaugcucuaugcccugaaggagcucacaguauaguagcagggaacuuauaaggcugacuguggcaaguguaacaacagacauauguugcgcccuccuuacagcacugccuugggccugaagauaaagagaggagccccacacuuagaccacagauccacagucacccuccuugcuucugagacgcaaggggcaaaaaaggucugagacugagcuagaaucagggccagaagggacugaugccucccagagucagggugggagaauucuacaaggagccagggagagaaacugaguaggcccuggguguugcuaaaacaggcaaaagcagcaaauaagcagcaggaccacugacccaaggucagagugcuuagggaaagacaaggcagggaaucccuccuccuguggcgcaggggcccugaguagcagggugggacaguacagccccagcccagcagcacuggaaguccuguucagcauguaucuugcagggugacaagggucagaggggccaaguuugaauaauacugaggcucuaggcccugauccaagaauuccucccccaccuuccauggcuucaauucuggggccuuuuccacggugguguggggcccauccuucaucccuacuuuugcccccugaaagacaguagacaguggcuucugucaguuaccaccucuguggcccaggccaggagcuggccuugcaggaaugggguacgggcuggccagcucucacccuggaggaggcuguuuggauuguccuugcucccugucuacuuucuuucuccaccuccuuaaucaaagcucaggcacaucccaagggcucccacacccugggccagcagacuggagagcugagauggcaaggcugugugugccuuuaaggcccaacaugucagcaagucaccagucccacuucugaaggcagauggcaugaaaccucuggaguggagaccaagagggcuuccccgcauggguuggggacagagccagugcugcagugccccccagaauuuuacauugagcucccuccccaaccacucccagaaaaacccugcugagccgucgaggaacccagcacccaggucucacugugcucuuccucccuggcaggcacccaguuggagaagcugauggagaacaugcgcaaugacauugccagucaccccccuguagagggcuccuaugccccccgcaggggagaguucugcauugccaaauuuguagauggagaaugguaagccacuuggaaaagcaaggcagagucuugagcaggaacgauagcagggcuguccucaggccucagguguugccuuagcagucugguuuccccagcugguuaaugauggccccuagcagcucuccugggugucccucuucauugcccacagcccaucuggggccuugcucuggccugugcaccccugcaguccagccagacagaaguggcuccuuccuugucuccugggggauuccagggugggagcccuugcuggcuggcuggcuggccggccggccaggcuguccagcacaccccucaccccacccaggaagaaugauguuacagggggcugagguagaggcugggcuacaguaagccuaaaccagcugcccgacccucuuccccggcugucuaggacaugagcagcagugcucacaggccggaagaaggucgcugauguguaaucuaccaagggagggcccauggccuucccagggugacgaagugacuuggauauguucccugcugcggccucccaggcagaucugcuggcuaauuacagcugcuguuuagugcacuggguuuaaacagcagacaucaaucuagucauuagucuuguugcuuuaugccccaaggacacauuaaucugcuccacaugcuccuuucucccucuucugcucccagcuaugcucugauuccauuagguggugaccacaguggccgaggcugggccuagauggagugcaguuacuguccccugugacacccguugaacccaggcagggaaaugcugugccccugccccgccauugcugaggcucugggagcccagaguccucagggcugucucuugagcucugcccaugaugccauugcagguaccgugcccgaguagagaaagucgagucuccugccaaaauacaugucuucuacauugacuacggcaacgugaguguuggggaccagaguguuggaggggcuaucaaacacagcagcccccgagucaaauccaucugaucucuccaaggucccucugagcuuaccaauagaacaaugagcauuggggcaucucugcugugcguguaacaggccaggcccccucagugaccuggcaaaacuggggucuaugaccaguggcugcaagcacugauaggucccgcauccagaccccacggaugaguguccagccacacccacaguuccucuucugccugaggucucugcagaaugggggcagggccucuguagcacauggagggccuuuacacccacaguuccugguguucaagccaaacuggguguuuguuccaugcgcuaauccccggcacauccccaaacucagguuugcugggaagggacagucacaaggugacagugacugacuggcacccuugggagaaaaauuucuccggcugggccugggagucuguugacaacuccugggagauucucuugaggaacagcagccagcuggugagaaaacugucauucaggagggugacgcuccugagucauggcacugcuugucugcguaccucccaugccuuccucaaguacuaggacugaggaucuguuaguagagagcccagaguugggccaugcucccaacccaucuccugggaauacacaaaggaagagguccugccagacaagggugaacccagaugccugggccagaaccacaggcaggcccggugaccacagggauacuugucuuggugugcuccccuagccagcagcuggagaacccccuggccugugggaacguagucagggaacccaugucacagacagaagggcauugggaggaaauggaaaagcgauuagaguccaguuauacugcgauuguuuucaugggaaccacuaggugugccagcaccaggcccagagugagcuccccaucuacugcuggaccagcagggcacguucucuccaggcuucacccacuggggagccuuuguacauugcaaaguggaaccaagucaugggaugaacaggguggcccagaguuagcauucccagaggccuggccacagagagcuguccugugagagagcaagggggcagcgaguaugugacauguuggccugcugcuuccucugcagagagagguccugccauccacccgccuggguacccuaucaccugccuucagcacucgggugcugccagcucaagccacggaguaugccuucgccuucauccaggugccccaagaugugagucuggagucuuccuccuuccaaaggggacuauccacugacacuuagccgcugcagcagcccucaugggcugacaggagaagauggaaacuaugauggucucuuaguaauaguacucaagagaugggaaguugaggaagaugccaccgaggagguaguauuagagcauuccagcuaguucauagaagcagguaggccagggugcauuuggacaaagacuagaccaccacagcuggaucccagggggcuuuugggcaguggcaggaggugaucaggcaguggcaggaggugaggugggaaagggcuuggugucgugggguugucuacccuggcaaggaguuuauucuuugugcuguauaggcaggaggaauguggcaccauuucuaggagaagugugacaugguccaguguguuucugaaaguuaguucugauggcacagugaacagagggacuagaaugaaugggugggagacaauuguaacaguccaggcuagagacaaagguggugcuggguuucuuauguguggauguguugcuguuggccaagaagaaugagaaggagcgaauuugggcagugggaccuccaggcagccuuacaguuuucaguuggggagugagaugagaccuggaauuuaugggucuguguaguuaaaaccaugcgguguacaagauugcccagauugaguauguggaaggugugauggggaggagagagaguguuaggaagugcugggguccugccaucugagaacaggagcccagaggcagcauaugcagccagaaaggagagaacccaugcugagggucguggauacccucuauccccagaaacagaaagccagucuacaauguccagaucccccgggagcucaggcagguugaggcuucccaggggcugcccuuggcuuuagcuuugagaaggugccugguaccuggagugagagcugcgugaucaccaugguuggcacugucaccagauaaagggugcaaaugaagaauaagcaaauuuacucuuuaccuuuucacaaaguugcugaaggucaggagagaugcaacagaaaaugcugaaggcaaguaucacaaaacacgucggugaagacagacauguggagucaggugcaguggcucacgccuguaaucccagcauaggaggccaagcagggaggacugcuugagcccagguguucaaaaccacccugggcaacauagcaagacccugucucuaaaaaaaaaaaaaaaaaaaaaaauagcugggugugguggcacacgccuguacucccagcuagucccagcuauucaggagacugcggugagaggaucgcucgagcccacaaguucaagguugcagugagaugaugacaccacugcacucuggccagucccuaucucucuuuuuuuuuuuuuuuuuuuuuuuugagaugaauucuugcuuugucacccaggcuagagugcaguggcacaaucucggcucacugcaaccucucccucccagguugaagugauucucccaccucagccuuccgaguagcugggauuauaagugcccgccaccacgcccagcuaauuuuuguauuuucaguagagacaggguuucaccauguuggccaggcuggucuugaacuccugaccucaggucacccacccaccucggccucccaaagugcugggauuacaggcaugagccaccacaccuggccuagucccugucucuuuaaaaaaaaaaaagacagagacacaggaugucauggacauagugcacuggagcaagguccugcuggaggaaggaagugaaagggcaccaaguguaggugagcuuugagugggaagaagucacuuuuucucggagacacagggcaggugggugggagcacaggguaggaaagaaaggggucacuugcaaauagucucuggcugagggcaaggaaaagaaaaggggaaggcuuccuauccagagccuguuucugccucacuaggguucuuucugguuuguguuuuuuuguuuuuuugguauuuuuuugaggccaagucucacucugucacccaggcaggagugcaguggcgcaauauuggcucacugcagccuccgccuccuagcuucaagcgauucucgugccgcaguuucccaaguagcugggauuacaggcaugcaccccaugcccagcuaauuuuuguguuuuugguagagaugggguuucacuguguuggccaggcuggucgccaacuccuggccucaagggguccacccaccucagccucccaaagugcugggauuacaggcaugagccaccgugccuggccaaccucacuaggguucucuggggagaaaauuacaggccccugcuggccagacuuucuugggagucuauggacaggagcuggggcccaagugguuguucucuggcuugcucugaccugagugugucucugcuccaggaugaugcccgcacggacgccguggacagcguaguucgggauauccagaacacucagugccugcucaacguggaacaccugagugccggcugcccccaugucacccugcaguuugcagauuccaagggcgauguggggcugggcuuggugaaggaagggcuggucaugguggaggugcgcaaggagaaacaguuccagaaagugguaugugauguggagaggcggccccagcauugcgccaccacccucacagagaaagggacuguuccacaagccaggaagggagcagggaauccaccauccugcuguuccugcugaggaaagauaauggauuuggguuuguugguguuuuuuuguuuuuguuuuaaagcuaauuacaucccaaauuaauuggcugcggguuuggcugagaaugcagcugcaaacuagagcggaaagcuucccuccccauguacccccaggugacaggcgagaaagcuuugccaggggcuauguggagagggucaaggccugucccucccgcucucccagucucacuguccaacagacagcuuccaagucaauaaccaacuccuaacacccagugccaccccgagccagagcugucgaggaggcagcaccaaagggcccagaaagacugccacacaacccucuggcuauuuggaaagccccuuggacuuggaguccugccuccacuguucugagaggagaagccagccuccugagccccaucucccugcuuaugaagugaggggaggacuagcugccuugccacuucucagggcugaucgugacaaucagugcgcucguaccugagaaacagcuugcacugagcagccuuuggugauuagcuuugggcucuggauacaaggcagccccuuccacccaacacuauacauuucugagucccucucuacccuuucaccaagcagccacugaggcccuauugcagaccagcccugcgucccagcugggcugaaucagcgaaccauccaagagggccagacuuggggaagcucgggcccccgacagagcugccgucuccuggcagaaagugaugagagggcagcaggauguggccagcuucucccuauguuccuucagagacaggggcaagaaaggcggggcaugaaaaccaaacacuuuccuccucuucaucucucuuccauucgcccacugcucucccuucucccagcccuccuggccuuuccucucuccccaccacaccgcaagcccacauaaugugucgguggcugugcaggcugacgacucacuggaacaagacaccccuguggacugccgcugugucucaagagaagcccgaccccuaagccccucuggauagacccccacuuuccuuaggagauggcuccuaggaggucagcuucagccucccuauagaauuggagaucuuauuguaccccauaugaaacugcccauaaugccccugcuaucuagaaaauuccuucugccgcagucccugagauaaacaccuaacaugcucauuuauuuauucauucuaucagcagacauuuauugagggccuacaguauaucagugagcaagaaacagcaccccugcccugagaagcuuacauucaagcaugaggagacaacaauuacaaugaacauaauaaguaaauuaaauaggauauuagaagaugauaacugcagugaaaaauagaaguggaauccagggagucaggaaugggaggggaagguuguauuuguauugcucuuguuugguuugguuucuuuugagaccgggucuggaguacaauggcacagugccggaaucacgacucacugcagccuucaacucccuggcccaagugauccucccaccucagccugccaaguacugagacuacagacauucaugggccaccaugccuggcuaauuuuuuuuuuuuuuuaauagagauggggucagccuggucuugaacuccugggcucaagugauccuccugccuuggccucccaaagugcagcaauuauaggcaugagccaccacaccuggccuagguuguaauuuuaaaugggguugcccgagaccucauuaagagggagauacuuuaucacagacugaagcaggugggagagguagccaggaggacgugaccagaggagcguuccaggcagacagaagagcuagugcgaagaguuaagggaaaagccaggagacuaaugugauuguguuuuccguuuuacucugagggaacuaaggcuccauuggacaggcuugagcaagggagagcucuggcgcuuaccuaagcauucugcaggguccugcuggcugaucauuugagggcaacucugaccacucccuuucuucucucgucccuccagaucacagaauaccugaaugcccaagagucagccaagagcgccagggugaguucuuaccuugggagcccccagaggguaccgaguugagggguuuggcccucugaguuccggugggucccguaucccugaagagcuauugucuguuuuuucuuacagcugaaccuguggcgcuauggagacuuucgagcugaugaugcagacgaauuuggcuacagccgcuaaggaggggaucggguuuggcccccagccccgcucacgccagucccucuuccucugccgggaggguguuuucaacuccaaaccccagagagggguuguagauuggguccagcuuugcuucaguguguggaaaugucucgugggguggcaucggggcugcgggguggggaccccaaggcuuucuggggcagacccuuguccucugggaugaugggcacugcuauccacagucucugccaguugguuuuauuuggagguuugugggcuuuuuuuaaaaaaaaaaaguccucaaaucaggaagaaacaucaaagacuauguccuaguggagggaguaauccuaacacccaggcuggccgccagcuggcaccugccucuaucccagacugcccucgucccagcucucuguccaacuguugauuaugugauuuuucugauacguccauucucaaaugccaguguguucacaucuucgcucuggccagcccauucuguauuuaaagcuuuugaggcccaauaaaauaguacgugcugucugcagcccuuauugaucacagugugguccagagcauggagucuuggcagcuucacccaggaggagaccuggacacuugaaugacccccaagauagucauccaaaugccuggacauucucccuagaaauagagccagcuggggaaagcaaggcagaucuucagagucugagcaagcaacuccuggacccagugggcaccacuuggcaccauggccaucaugcaggaggcuacaggucuuuuuugacuucuugcacauggcuguuuucaaggaccuuagagaguuacagcagcuuggccagcagcacccaggacaauuuacccacugugaauugcugggucuggccuuaggcagacccugccagauccccaagaaaggauucaaaaggaaucagcugagagcaaugaggugauuucccuaauuccugcugugucugggauagaguggguuagaacgcaggcccccugguuccucuccggagaacagagcuaggagggccggcuucuccaagagggacccaggucccaggugagaggccugucugcuccagguuagccauugcucaugucugacuugauaagcucuccccaaaaguccucagguagaacuggcccuggagcucagaauccucaggcugcguguagcccaugagggaggagccaugguggugugaggccaggagucccggggagagaaagucaagugugagagucaccacuccccacacccaugguguccagcgccucauuauuccuccacugacggcauuaccugugugcccccgccccucccuggcacauacuuuggugaaacuugguggcacgucuuucugacagccccacaucccaccaacauucugaucuggggugaugcuccaagcugccauauaaaauugacccuuugaucuugggggcuacagggacagucaguggaggugguagggccuggcuggcuggaucucauuccucagcuggagguccugccguaacacacacuuguucuggccagggcucuuacgggguucucaugugugcugcuuauacucaaggugcgcuauaguuaggugaggguaggaagagccagggaggggccauggggagaaauguugagucaguucaacuccagaaacacuaguuucccuugguccucguggggacucacaguuucuacuugcagcgccuccggcuuagccagaacaagcgcuuacacugucugaaucagacccuuuaugguccaguaaacugugcuucccuugacuacaugcagccccuuagggggcccaggaagucaggagggguguggaugaugacuuggugugaaucucuucaucauccccacuccuggagaagcuguccugcccccagcagagaagcacacucucaccauggucucugauuuuauuuuuauccaucaagaagagaaugcccaucucacuuauuucuugaccuccaaggugcuucugguagggugcgauguguauucacagugaacacaaucggcagagggcaagaugccagcccacucuuuugugaaagggucugaaaucaucucacggucuucacaguugccuugguuacaucugcacccaaggauaaacccuccuuaguuuuccaauugaaauuaugccugagccuucccacuucugaguuuuuucucugccaaggcugguugagacaaaggucagaucagucaccaggcaggaaggcgcuaccgcagcuugucugguuuugaccccaacuugguguuucucucgguaucacaucugccaaguuccugaggugugaccuggauagggcugggaccagggugaggcaagccacgcgccaagggugcagauuugaaggaggcacucacagagugcgcacacauuggcauguucuauuuucaucuguagcuguccacucagcaccagcccuugcaccaguagccagaaaaagcucuccacagguuccucccacucccccugaguuauaaaaauugcaccuuggccucaggauuguggguucugcuucuccauccaccuuuccuguugaauagugaagucucuugagcaccuguuauccauccauuuaggcuuccuccaagcagggauuaagacccagauagugccaagcacaguguuggguccagugagugccaaggucaucucucugggcucucgaggaggcagcagaugcaugcuaucuauaacaagccacagcaguggguggugcccugggacuuuaagggacagaggcccuggcccagguggcugggaaguuucccagaggaaaggagaagagcuggggcuagcagauggugggaaggcaucgcuuaucucugggcagcuugaggagucuccuggucuccgaggguggaugcagcagagcccagggcuugggaaagccaccagggaaguauugguggcugagacuccuccgcagcgaccucaucucccuccucuugcugguggacaggauuaguagcgaaggcgggcaguggagagaagggcucccgugacugccuccauuuuauuuauugguuugauuauuuuugcguccuggggagagaguggaccccguuuuuugcauuagcccauauugggaagcaauggggaugggcuagaaagcuggugccucaagagugguuauugauguccuaauuacaagaggaugcuaauuuaauuugaaccuaauuacagugcacuacccuggguggcauguguuuuaauaauuaacguccuucagaugcguaggaguguaauaauauuuacacuagguuggccagcagccuguggaggcggacugggggcccauacaccaccuucucccuggacagcuuggcugugagcagguggggaagaaggcacauggguccuggcuggcgaguaucuugucauccuucccauguaacaugcuugggccucauuuccagccacuuccuugacccagcaggcagcuuugcucuguggggcaccaggcuggaacucuggaauacaucaagacuggcaggaucaggucucugggcuccagccccaaacccaccuccccaaccccagucuaccacacagggauguuucuggccuccucagccugccugguccuauuccgggaagggcuuguuuaagggggaguuuaggagggaggaaggagagcugcuugguuugucuucauuccuguaagggagguaacauuuauaaggaaauagacacauucgaaaaggugcacaaaugaaaaggguaccgcucaaauacaaagugaacauuacccacauaaacagcacacacaccaaaaagcaucagcagccccucaugcaccccuccauagccgcucucacccccaaaaguaaccccucuugacuucuaucccaguagaugauuuuggccuauuuuguuuguuauguuuuuauguugauuuguuuuucuugguuugcguggcuuuacauuuuacauaaggggacucaaaccauauguauucuuaugugccugaugucuuccacccagcacaccugugagauucaucugcgugguuagguucauuuuagcuugugcauuuugugugguccauuguaugaauacaccacuccuugauuauuagaagucagacauugagcugucugcuagggcugugucaggcccuaaaggagaaaucugcucauccuaaugaugcaacugggggcagaaggugacaugagaugagaaggggaagcaagaugacggggcaaggcaguuccguccccaacaaucccagaacagugugcuugucugugugaccccugugcccagccuuucugagccuccacagguagggacagggccuaccagcaaguccagaagccaagcagaaccaggggcuucagaaaugggccaugggcacuuuggugucgccaccagcucucacuaggcacuaaguguggcuggcaggccaacuacaucagaaucaccuggggugcucguuaaaauacagcuuccaaaaauagugccagaacuauauuaggagugguggggggguaagugagcugaguccuccucaucugucauagcaggaagacaauggguaaugucugaaguugauaaaacaagaacuagcuuauuauuuagcaauaagauaguaaccaucagaucaaaaacaugauuaaaagugguugccuguagguagcacacuagggaugggaagcgcugcuuuuuauuauaaucucuacuauugaauuuucuaaccauuugugaguguuuucaguggucuuuuuaaauucauugucauguaaauauacauguaucuaagugccacuccagaccuacuaccccaauccccgugggguggggccuggggauccacuuuaacaaguuuccuaggcgauucugaugaguucucaaguucaagaauuggcuaucacuguccaaacucauuuuauaggaugagaagggagacaaagugacuugcccaaggucacccaguuuauuaauggcagggccaggaauagaaaacagaucucccggccccaggccuaugauuuuucucuccgucauggcuuucgccuuggaggguauccaucccagcaggccuggcccucgggggccugcagggugagcuggggucccaguucagacaaaggaggcuagggugucguugcacagggcggaggagugacuccugucacgggcccagagcccucaagcaggcagauauuucuaaccacugcauguugacagugcccuggauuucugcagauccauugcaggaaccagcacaugcaaaaauggggcugcuccuguggcucugccagcagcaacaucuuugagguuucuuuccccaggaugggaaugagucugcccugagccauccauagccccugaacauucaggcauuuagcauuuccugagcugcuccaggcacuguucuaagggcugggagaaaaagggagaguuaucuuuggccucguggggcucacaguauacugagaacagauguuggugauagaaagaccuaauugauguaauugauguauguacaaaugcuguggccuuagcuuguggaguugacaguggccaugccccaucacccagcaauuuccuccugguucuguggccaggggcuauuugcauguguuaagaacaacccaccggcuggcgcgguggcucgcgccuguaaucccagcacuuugggaggccgaggcgggcggaucaugaggucaggagaucaagaucuuccuggcuaacacggugaaaccccgucucuacuaaaaauacaaaaaaacuagccaggccugguggcgggcaccuguagucccagcuacucgggaggcugaggcaggagaauggcgugaacccgggaggcggagcuugcagugagccuagaucgcgccacugcacuccagccugggcaacagagugagacuccgucucaaaaaaaaagcaaaaaaaccaccaggacccauaugcaagaaugggcacugcagcuuuguuccuacaaacagaaaugagacacuacaggcauggcaagguauucacacaauggaauauuacucagcaaugaaaaugaacuguagccacacaaagcaaggauaaaucucagaaauaauguugaaugaauaaagcacaucucagagaacuucauaucauauaauaccauuauucuaaagcucaaaaccaaaaauacguugcuuagauauacauguaucuaggugaucauuuaauuuauuguccaaauagggauguuuuugcgagcaaaaaggaacacaaauucugacauuuggacugcaaguguaaguugacacuaucuccaguaaacugggacauguggacaccccacauauauguauauaaaacauaaaagcaaagggaugauaaacacagaaaucuggaugguggucaccuccagguggggcagcggaccccaggggugagauaaggaaggaugcuggggagacauaagugacugggaauguucuguguguuggucugggaggugggucuauagauggcuauuacauuauuaaauuaauaaaguguaggaacucaaaggagaaagcucuuccagggaggugaggaagguuuugaggacagggugacaacuucaacaguuuaccugauaaacaaugggucugguugagggaacucacugagcaaagcccucucauggcugguggggcucuucucagaaggcucucugcauuccaagucuagcguguggccacaaaacuagggacuuuguucucaccagcccugggcacugaccagcugaagccccacccuuuugggaaaaagcagccauccaggacagggagagcugaccaggccugcacgagacacugacuucaagguacccugcucacuucagauuaaaguguaaguuacgggaagugcacagaucuuaagcauauguggauuuuugcgaauauauauagugaagcuaccauuuggaucgacuguagaacaucagcaucccugaaagcaacaacuuuuaccccuaucaccauaguuugggcuguucuuggugccagggucuuuuaaaggacauuuuuucccugaaauaguccugacgacaugaugggaccuuacaaucucuagguaucuuugccagagugccugugccuggggcuugaauugacacaagguaggauaggggcuucagagccccuacccccccaaccucuucacagcugccucagaaccuuaggcaaggccagcaggagacaagggucccucacccugcugcuugagggccuuggcugugucuagccaggcaauacagaccuauuaucccagcucaaucgagucauucuaggcccugggcccagucacugcuauggaucaggugauacugaugcaauucagugagcaggcagcuucaaucuauaggagucaucugggccugggagauaggccagcucccccuccacuugggcagaucucacucuccugcagccacgugaaugccacaggucuaagacagauccugugguguuaacauuuuguguucucaauuacguagaacaaaaugaggccaaagcuacuuacgguuauucuaaaugauacuucuguuuggcuucacaaugcguuuacaugcuugacucaccuguggucagcagucucagccucagagaugucacaguagaggaaaugguauugauggagccaaguccgcccuccagcccacugcagaaacaaccaagccugaguuggccaccucccuccagccuguccuaacacaugcucaggacaggaccugaccaguggguaaggaguuuggguuucaaagaagcagaaccauaggcugaguucagagacugaaucaauagauagauagaugucagacagacuaauaauuaucaggccaaguuggugcuggucaagaacuuggccaugagauugaucucaaggagucagugguggaggauaugguugguucugaaggcagacgggcugagcuugaguccuagcgugccgcacgcuagccgagugccccaagugggcuaauuaaccuuucugaggcgguucccucaucuguagacugaagaauaaaagauaaaaauuccuacaucguaagguuaauaaaagaauucagaggccaggcgcgguggcucaagccuguagucccagcacugggagaccaaggcgggaggaucgcuugagccuaggcauuuaagaccagccuggguaacauagugagaccccagcucuacuuuuuuuuuaauuaaaaaaauaaaaaaggaauucagugagauuuguaaagcacuuuacacagggcccagcacagauucuguguucaguguuugcuguuaucacccagggaggagggugcaggcauggaauaaccucucugcucuugagagcauugugggguugaggccagaagggagucaaggugucaggaggugggggguggggaggcugagaugacugggcugagucucuggcuguccaguuguggagugaugggaagcaggagucaugcacacccagggcaggggguuccaucccuucaccuugcuggcguggaacuaguccuguagcuaagguguucagcgcaugugcacugaguaccugucgugccaggcaccauuugggugcugaaguuacagaagcaaacagcacagagcuccuggcugcauggacuagggagaggacauaugcccauacucaccuggcauggaggacaccaugccuagccaaaacuuacacauagacacuuugccucagaccugaaaucuggauuuagacagcagaaggaaguuagugguagggguugggguguguguguguguuuguguguguguguguguguguguguguguguagaugccucuuggaggagccaguucugauucacagaccugaaaaccagcagcagaaaaugacuccucccugcugauguggguguaguucuggagaaaguccugugcuggggcugaguggaccaugggcagggagugggguggagcaggggcagugcuagggggcaggaugcugcagugcaccccacccaccaugggaagccccgagauggaguuuacuggggccuggaugcagggggagcagccaguaucacagcugcacuccugccucgacuccagcacauaggccucacuggcugugaacagggaaacacuagucucagguucccagggagcagagcuaugcagagggagcccuccagagucaggcgaagggcaucaugccaggcaggaaguauuagcacugaugugggggcaccuccuaggccguccucauguccacugugugaguggcacacagugcaugacaguuggggacauucccauuugacagggugacaaaccagaagaggugggugccugauuccaaguuacacagggugugaggagcugcacagaggccaccaugaugagccacuuacaugaccuugaccccuagugagaaggacccgugugggcaaagacagaucugaagcugcacuuuacucaacagcuggggagggccguuuccagagggggcuucacaaggugcagucgcacaggcacucggguuugcagggaggaggauguccuugggaacuagccuggcggccuugucucaucuggccugaucuguagagggcagcucccaggggggagacccgaggcagagaucacaaauagugccaugucugaucaauugauaguggcucccuggggugcccuguagucaaggauucuaaggucaugccagaaagucagcuguaaucaauuauuaaugucuaccaagggugugggaaagggggauggucaugugugucccauauauuugccauccugugucagugcuuucaugggaagaggguucaggaaucuuacuacaucaaaguagggggcacuuccacagcauccuugacgcaaguauccacuucugcuugcagagagggcuggaaacucccucucaaggaaguggcgcccaaaucaguucuuaccucguuacugcuaucguguuccaauugcaaauacuguuuugcaguucauaagcagaguuaaacaccuacucucugcugggcacaagggacccacagcugagccagucaaguccccugauacuaucugcagauacuugaaccugguaaacuucagugagaccacuuuucuuggggagagggagaggccccuaaaggcagggacaagagaguucuccagaagcaggaagaguuaaggcccugaaccuggagguggcuccuugggcauuuccugaagaccaagcuuccauuuuccucuggugccuuccaggccagcaggcccuggagcagcgcuucucaaacuuuaacuugcuugugaaucaucuggggaucuuguuagaaugcacauucuccuucaguaaguauggggcagggccaagaaucugcauuucuaaccggcucccaggaggugcuuugggccaaaggaccacccugaggagcuauccccuccccagcccuuucaggccagaggcuaccagcaggagguaguagguagagaagcccaccugguucccacagagggcuccugggaggucugaccaaggccugaguuuggaggcagggagcaaacaagacucaugcuaccuaaagccagaaauauaagggaaagagccagacccuggcacagcucugcaggagaagcugccugaggagaggggcuggggcugaggcuggugaagaaucucugcucuaggagcuccagggccaacauagagugcaggcagagcuaagcucuggaguguaggcucucuagacuguacaccuccaaaaugaucaugaugucagcagcagcucaagaucugugugcucccacaagggcuaagcacuuuauggguagucuuaucagggaaggacccuucccccgguuuuacagauauccucuggaagacaggccuagaguccaugacuugcaaguauucaauaaaugauuuaugagugaaugacuaaaagugcagcugaguccuggcagagggcauggggucccacccagagacaggcagagaaaguugaagucccaggauuggaggccguucuuccucaccuccccaccaggcccaggcagggcuugaucugaacggaggccugggaaccuguggccagccuuuacuuguuggaaaagagcaguccuuaagcucaauugcuccagguugaugcuucccuacuuuuuuuuauuuauuuauuuuuauuauuauuuuuuuuuuauugagacggagucuuacucuguugccagguuggagugcaguggcgcgaucucggcucacugccaccuccgccugcugaguucaagccucagccuccugaguagccuccuggguagcugggacuacaggcgugcgccaccacgccaggcuaauuuuuuguauuuuaguauagacggaguuucaccacuuuggccaggauggucucgaucuccugaccucgugauacucccgccucgguaucccaaagugccgggauuacaggcaugagccacagcgcccggccccuaguucuuuuuaaaaaacgcuagauccguccgcugcgcugaguggaggcggggcaggccuccguucuccaauuggccuuauccaccgagcucuccccuugugccgggcucugugccaagcacaucacacgcuguauccugcggccagguugcugugguccagggucguacccugguccaaggucgcaaaccgaggugggacuccgauccggcaaccacgcccguggcccggaaacggcguccccugaggcccaggagaggccgggcggugagcggcuguggagccgagcgcgggcagugcggaugcugccuaugggggaggcagccaaggacggagggcgagaggcgguucuuccaaggucacccucuuccggguugcaagcaaaggucaggggaucccggaaugguuagugcaggagcuucucugugccuuccacguccuagauccucagagccucagaaacggagaucaucguccccacccccauuuuacagaugaagaaacugagccgaggaaaggaagcgacuuggccaaggucggagagcucauucuuugcagggcgggguuuggaacccggggucuggcucucggcaacgcgcccucggcccgcagccuccugcccccugugccccgcuucggcccccagcgcagcugcagaggggccccccucgacgcauacacucaagagcccgaccgcgcggcugaaaucgcggagcucggagccgcggcuggcugagcgaucgcgguuccugggcugcgugcgcgccccuuggagcugaaaggagcgccaggaucgggggcgcugcaccgggcugggccccucaacgcucgcagaccgggccgggcugcagcuggagauggcagcaaucccgggaggucuccgggccucuucagggugcguccaggaggcggguuccgugcgacgcggcgcagcccacccccacgagaccgcuuaacuucgcgggggcagccucgggcgcucggagacgcggaggcccagacugcagccuccggaugcuggaagcccagacucccuggggucaccggcucucccgccaccccagcugcaaagagucccauugcuucaccguccggagcuuagucuccuuguuccucuaccagucccucccuccgcaggucucuggggacuucugaccgccuguucuuacucucccccugcccccauacuucccgcccuugucucaggaacggugauacagucaucggauugcucuccaucuccuguuagucuacacugcacacaacucaauaauccgcucccuucauccgggugacagagacacagauaaucugagcuaguggugcucaaaguaccggucccagaacagcagcaucagcaucucuugggaacuuguuaaaaaugagaauuugggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaugcgaauuugggggccccaccccagaucuacugaacagaaacucuguggagcccagcagaugauucccaugcacacuaaaguuugcgagccacugaucuaaacauucuuucauccauucauucuucaccuggcccacccagcauugccagugggagagacacccgcaaagcaccaggcugugagccccaccgccgugcacucugagacacuguccacuagcuuugggauggcaggcagagguacuccagcuuggucuagugcagaccugggaaucaggaccuggaaaggaggccccaggugccagccggcagguuagcuaauggcggccaaggguuaccccggaguggggaguggggagaagcugccugguuuggcccgugcugcugcacucaaagcaccuaccuuucaaagugcaagaacaggaaagugacccuccucugcccccaguaagugaugacggagucucuggaaggccagacagaugggaucuugcucuuugcagcagugagcuauccugacuggguggguaaccaaggagaagggcuuucugcaggagaggaaauucauuccucucuuccaaaguaagggcuucuauggcugucugccuggaaggaaaccaaggcaaagagauuaaauguggaaaaggucaacguucugaaagggaagcuuuaugggguccuucccauacaacgaaggaacuaggggcagccacauaagccagauggaucaggccaguggggcuuaaguagagcccagagcccagcuuuccuuggcugcauuccuacaggcaggggccagacacuuagagauacacugcaccuucccucaggucggaagggaggggacggagccccuccuggaaggcuucaggugaauauaaaacuagagcccucaccaccccaaucugugacaucacauggaaucugauguuguuugauggcauuucgggugucccacaaccaugccugccaugaagucauggcugauauuuaugcccuggccccacucugaucucagggagaauaucuuaccauaaauuggcaugccauggcaaacaauuaaaagagaaaaaccucagugcaaucucagggugcucggaaaugaggaauuacaaggugguggcaugaaaaaauuauauaaaaaucuauuuuuacaucacaauaaugugcuuuuauacggguuguaauuucuggaugugcaauaaaguggcuuuuacaucaggcagaaucagaguuuauaggcaaucggugcuuuuaucugggaaaauauagcucacccaucuucacaccauccauccugcaggcagcaggccuuaucuuccccagcaccagugucuuuggggaaauaauuaugcaauuaaagugucagcccaccaaccacccaccaaccacgcccccacccccacccugggaucuuccaaccacaucuuccagcuucugucauuggcuucuuccccaagguagaacaagccauggguccaggacaggguggcugagguaccagacagaugcuggucacugucuccauugggccagggaagauccuggugggcucagagaaaauaucuuagggccagcaagcacuccauaaacaccaaggaucugcuaugggccaggcacugugcugggagccugggacccugucacaauuuuguaacagucaugaugcaggcagggaagggaaaagcucuggcaaaggucaauccagggagcugaagggccacagaggaggaguuuggggugggggggaguguggcacuguacucuggaggcaggcaggugacacaggggaagguuugaagacaaguguguccuagaggggaggugccagcccaggucauguuucugauuggagcacugagacaggcauauuacaggacgugguagcuguccucagacacugaauguuagugccaaaacuguccuuaaauauuauguagucuggcccaucauuuuauguauuccuuuaacauaucagauacuauaucaucagucagggguccagcaggaaacacaacacauuccauucaauaaaggaauaugcacaaaagcauaugggcagaguuuagggaaaucaacaagagaugguacaguacccggggccagcaagagagagcagugguuaccacccagaggccugaaguagcagagacuggacacaguuaauggcacccuuugagaggagcugcaugagggccaucaggcagcugaccuggcuugcugucaccugaaaaguugagcaaagaaggccuaagugaaugagacacguuuugaggggagaaaggagccaggggaguaaagcccugcucuccucuccugcucccuuaccccugccagcgccucuccauacugcucccucgccccugccagcgccucuccauacugcucccucguccccugccagcgccucuccauacugcucccucguccccugccagcgccucuccauacugcucccucguccccugccagcgccucuccauacugcucccucaccccugccagugccucuccauacugcucccucaccccugccagugccucuccauacugcucccucauccccugccagcgcucccucauccccugccagcgccucuccauaaugcucccucaccccugccaaugccucuccauacugcucccucaccccugccagcaccucuccauacugcucccucaccccugccagcaccucuccauacugcucccucguccccugccagcgccucuccauacugcucccucguccccugccagcgccucuccauacugcucccucguccccugccagcgccucuccauacugcucccucguccccugccagcgccucuccauacugcucccucguccccugccagcgccucuccauacugcucccucguccccugccagcgccucuccauacugcucccucguccccugccagcgccucuccauacugcucccucguccccugccagcgccucuccauacugcucccucguccccugccagcgccucuccauacugcucccucguccccugccagugccucuccauagccaucaccaaccagaagccagagauggagggagucugcuggugccacccagucagaucugccugcagggcagagagcaggguggagggccaaucuggaugugcaaacgggagccugccagcauaggcacagauugggaaugaucaaacaaucuggucauuuggcaaaaauagaacaguacaccaauggcuguaauuuuuaugucucuauagugcaacuuuguagguuuucucaucgcacauuuuuggcucaccacaaccuauacucagugucagcuuugacaaucuuacaugacacugugcucuguuucacagcuagggagccugcaugauacaguggaaaagaauuccaugaggccauguagauggguuggaggcaggugagauggcaguccugacgcaagugcggaacaugcccacccugagguucugcaugucucuuuuugacauguaccccccgcaaauuccucacaugcucucauaaaaggacgggguaggacaucuauagcaauauuccuugagguggugggagauggagggcccacuccagggagacugguuggguaagaugcaacagaagcaaaccaugggacucaguagcaggaaggaaacugugguucacauagagcaugcaagaguucaaagcagagcugaguagaaagaggaagacagaagugagauuuguaauucugaaccacucaaauagguuaaaaauagcacucacaggcaacaaacgcauacgcaugcacacacacacacaccauuuugcacucuuacaaaccaaaacacuuuagaaugguuggcuuuugaaaggagagggagaggagaggaauggcauugaaaaaggauaaacagcccccuaaauaaaaagaagagagccuagacucaagagacagaacacaccugggcuuccaucaaagaagcuguacugugugugaccuuggguaggcguguuacugaguuguuucaucuugcaaacaggaggaaacgguaauaaauagaucccgaggcaugucaaugugaccuagcuagaccugucugagacgcugauccaccaagaccuguucccagguggguugacaaaggccugugucccaacaaguguagggcaaagggcagccugggccacuuggaggugacccagcagcagcuguguauauguggucaacauacgcgacacauccagagcucugacaaagccccucaauccaaaaauaugucucgcugccagcaucagggguuccuuucuuugagcuaaagccucuucuguaucgggggaacccgcccccaguauuucaacguaggcucuuucuauuuuccauaagugucagccagcugagaaauaaggagagaguacaaagagaggaauuuugcagcugggccgccgggggcgacaucacauaucgguaggaccgugaugcccaccugaaccucaaaccagcaaguuuuuuauuaaggguuucaaaaggggagggugucuaagaacagggaguagaucacaugcuucaaagggcaaaaaggagaaccacugauaagggucugucuucagcagugcacauauugucuugauaaacaucuuaaacaacagaaaacaggguucgagagcagagagcuggucugaccacagauuuaccagggcccgguuuuuccccacccuaguaagccugaggguacugcaggagaccagggcauaucucaguccuuaucucaaccacauaggauagacguccccagagcggcuguuuauagacuccccccaggaaugcauuccuuccccaggguauuaauauuaauauuccuugcuaggaaaagaauuuagugauaucuucccuacuugcauguccauuuauaggcucucugcaagaagaaaaauauggcucuuuuugcccuaccccucaggcagucagaccuuauggaugucuucccuuguucccuaaaaucgcuguuauucuguucauuuucaaggugcacugauuucauauuguucaaacacacauguuuuacaaucaauuuguacaauuaacacaauuaucacagugguccugaggugacguacauacucagccuaugaaaguaacaggauuaagagauuaaaguaaagacaggcauaagaaauuauaaaagcauuauuugggaacugauaaauguccaugaaaucuucacaauuuauguuccucugccacggcuccagccagucauuccauucggggucccugaguuccugcaacacuucugcacagaaaugcaaaauacacacacacacaccccaccccgccccuaggacucauuuuguuagcgaucauuaacaguuucagccauuagcucucaaguugguuugaauuuguugguaggauuagcucccuaucaccugaaaagcugagaaaagaaggccuaagggaaugagacacaugucugagaagagacagaaagagagaauguguguguguguguguguguguguguguggcaacuacugaagguggguaggaugcuaggggccuggguuccccagggaaggcccuggguuugaaaagagccccaaaugaagccaggauugcugaagacaagcaugugaguuugccaagagcugcccaggggucugaggugucaguccaccccucugcuccccacucagguaggggcagguccggagcugcagcaugacagggaauuucaggcccggaggucuucccacuugucaccucuguuucuucuucucugcccagguggugcacauucugaaaggcucagauuucuuucauucaaccuccuuucuuccuauuuuuucuuauugucuggcucuuuccugcagaaggaaggagaagaacuggguguaaaccuugacucugagcugagggcucagaugcuggcugaacuucucauuugcaccagguguaggagggaagugggcagcccagcacagaagcagcucucuggcaaacagcuuccucuguaggccucaugcccuccaacugcagugcccucugaccuugucacacugcagguaggggacagaacuaaggagcaucugcacaagcaccuggcuguagugaacugaauaguguucccccaaaagauauguccaaguccagaccccuaguaccugugcaugugaccuuacuuggaaauagggucuuugcaaauauaauuaagauaguacuugucuuaguccauucaagcugcuaaaagaaaaaaauaucacaaacuggguggcuuauaaacaacagaauguauugcucauaguucuggaggcugggaaguccaagaucaaggugcuggcagguucagugucugguguggauuuggauuugcucucuacuucacagauggcacuguugugcugugucuuuacaugguagaaugggauaguuagcucccuggggguuccuuuuuuuuuuucugagucagugucucauuguguugcccaggcuggaguggcccagucuuggcucacugcaaccucugccucccagguucaagcaauucugccuccgaagucucccaaguagcugccucuagucucccgaguagcugaggcuacaggcaugcaccaccaugccuggauaauuuuuguauuuuuuuagugaagacagaguuuugccauguuggccaggcuggucuugaacucuugaccucaggugaucugccugccuuggccucccaaagugcuggaauuacaggcauaagucuaugcaccuggcgucuggggucccuuuuauaagagcauuaaugccaugaggacagagcccucacgaacucaucaucucccaaaggccccaccuucuaacacugucacacgaaggauccaguuucaauguaugaauuguauagaaaacauucagaccacagucauaagaauuucaagaugagauccagggugggcccuaaauucagcgacugcuguccuuacaggggaaaggaaagggcgacgugagacacaggggagaagacugucugaggaaggcaggcagagccgcagagauuuagaguuaugcaaccccagccaagaaacaccacaagccaccaaaaauuagaagagguaagcaauucuucccuagagcuuucccauaaagagaacauggcccugcugauuuugcagaaaagagaaacugaggcaccaaacuacaucagcacucccugggcauggaaggcugggcgcacagcagcaccagccagggcagagacggugcuggaagucgaugcccugccucccagcugaagccuuccuaccgccucccucgggugcuuccuuucacucagccccuucagagccagaaggcguggcccacagcaguguaggagugcccacggccccgggaccccuggcuguaaccacacccucagcugcacccucaggagaccuugccuccugcucccucuccagcggcagcgagggcagugccaagcucacacccucccagaagugauuucaugccccauaagacgggcaaucaaaaauaauagacacacagcaaccugccuggggccugcugcugcggcgggcggcugcugagguggcuaccuggaagauaaaccaauucccagccccgguggggagaaauaacagcaucagugaggagcaggagcuucaucuuagucugcaaagccccagccaauaagcaggcuaaaaauaagcaccucucccagcugcagcagcacccucccuuuccugacaugagcuggucacgugaguuucucagacucugguggguuucucaugucuaggcaggugucugucugcucaguggccuugccucagaucuggcugggguggccucaauguggggagcacaggcugcggagugagccuagggaaaggguaugaggaccuucugacuccucugggcucccuguggguccuuggcucggucaugcagccccagacugcuuccugucugugcugagcaucugacugucacugcugaaggacauucugagugccaugccagagcugggcacccagggccaucugucugcacuuggcggggaggcacgugcagaccccucgcuguggcugguucucugcgggcacagucugugauccacagagaguagacccugggugggccuguguguccagcauguauuaugugugccuccaaaaaaaugaguugggagagguggggaugguuaauggguacaaaagaaaauagaaagaaugaauaagaccuacuguuugauagcacaauaaggugauuauagucaguaauaacugaauugcacauuuuaaaauaaagagugucauuggauuguuuguaacucaaaggauaaauacuugaggagacggauaccccauucuccaugaugugcuuacuucacauugcaugucuguaucaaaacgucccauuuaccucauaaauauauacaccuacuacguacccacaaaaauuuaaauuuuuuuuuaaaagaaugaaucugguuuaaagcaaaacaaaacaaagaaccaacauuuuaguaaggaauuggguaagugaggauucugcagaacacccaccugggguagggguuaggauguggauuuaucucaauucugcugcccuugaugagaaaacauuuuaauaaugccucuuucgaaagauagucaaaauaugagccucacagaaauauuccuuaauugcuucuugucacacacugcaugaacucucagggggaccuuuuggcccccucaccuugggaucaugcacacccaggcucccacuugagccauguccuugguccagcuggcuucagguuugcaacgucucuuaccuggagaaccgccaaagucuccucaccaucuuccugccuucagucgcugucuuccuccccuuugggaguuagucaguccacucuccagcuuaaaaaaguucaaagacuucucccacugcugggccugacccuuucuaaucuguggccaaccuccugcuucacccaugccugcucacgcaccuuguucuucagcaaaggagacugcauggagcccacucaaugcuccucauuucuucuugcacccuaugccuuugcuaaacaugguccccacuuucuagaacacccuguccaccuucguugucucuugaaauucuacuguauuuucaaagcccagccuguguguuacucucuauccccaauucuucucagagaagaauuggccacucccucuccuugggucucccuagcacuuuccacgguuuugucacagugccugcauuucucguuauuguuaguuucauguauaucuccauggcuggauggcucaauccugaagguccgacagaaaacagugccuggcacauaauagguggcuaauaaaugaagccaaacugcaguugaccugcagacccgugauacaaaugcuuuuuauugcaagccacugagauuuuugagagugcuuuauuacacagccuuaucaagccaagagcugacugagacaaauugcccagggagccuggggcaauaugggacugcacacuuagcacuggcagaacgcuauuccaaaggcaugguggggcugagugccgguguuaggugugagguaagguugcucuugacauggugguagagggcugaugucaugucagaccacccagguucaaguccuggugcugccacuugcugcugugugugugucucugauagaguuacccucucagcaacucauuuuuccuugucuauaaaauaugaaucauaauacaaggaucugucucacgggguugucgugaaaaacaggggaaaccaugccgagcccagugccuggcacacagugggggcuccaugagugucugcucucaguggucaugcaucguuaggagugacugucauuggcuccucccucccuguguccagccugccugcucccugcccaguucugugcagggugugcgugucugucgagagaagcucaaagugggggaugauguuucucuguucauuuuccauguuuccuccugaacuccaguguuucacaaggggcugguagcggccuguccugucuuccccuagaacugcucagcauggcuccagcuguucuccguagagcgaggauaggaagucacaucucagaaagcaagggauggggacagcagugacaguggugacuucauucucccggcucuuacgggucuuguggacccacuuccaggaccaccaguuucuagagauggacaagagucuugaaguguccacagucaccuccgugucggugacaucggcagauagucauucuaaccacauucccaggaaacggggacuguggggauucagggaugggguggcauagacuccgccuucuggaagcuucuggucuggcuaggguagcccgagggacauaggaaauagcugagugagucauagcaucguguacugacaggacucuugaaacuucccagccaaaugucccuugaaaaagggacaccagaaucucccaggaaacaccugcgaggccuggcacgauggcaagggcuugaauaaaugaaaaggguggcugagcugccugggcuuuccugggcuugcugcuguccuucuccugaugauccacccuguggaaagcugcaacugucccauugccaccaagggaccacagcggcuguucuuucacuggcucuuccugggagggagcagcccuccccagcagccuccuuccaggcuggguggcaaauggcucccaaacagaaagaccccuccugagcugccauuucccagggaucucagcgccccaaagccagacauggggaggagggaggaaucagcuccuguagaucucugaugcuggcaugagugggcaagcccccagcucccuggacuccugccccucucugcaaaugcaggaggagauaggaugauggcagaacaucugggcuggaagacugucaggcgaggagaguggggcaucugaacagacagguugaguagcuugcccaaggccacacagcuggugaguguugaggccuguugcuaggugcucaguagauucccccggagugacuggaggugggagcauuagaggcaagacuaagagagccuugggaaggagacaaagagagacaccuccaggcaaucuaaauggacuaacaccaacagaggcaccuggagcugagagcagaugccaggccaggggagaugggcuagacacggaggcggaggaaaugcucuucugaaaaugauguugaagggcagagaagagaaggacccuagagagacagauggagaggaaucaacagaugggcccgcugucccgcagggcgacggcccucucgccacgcggccccuaagcuugaagggaagcauguggggaauucgcagugugggggauggggcagugagggccgcauccugaccagaauugcccaggcuucuggugagaggaaccaagugcagcaggggcugcuggccaggccugggagccgagguuuuggcugccacuugccuaccacggacaccccccaccaaaaugccucucuuugucaggaccaauagacacaaccucaggggccauuuuugaaggguuucaaaccaccugggcaaguuccuucugugggugggcagcccagacagcaaggcugggcacagcugucccacccagcauggccaugcagccuugcgaaggcaagggcacaggcuccugucacgccugacagcuguggcuggugugggguggggaaggccaggcaggacaggagggcagcagcaggccaagccagaccccugaggccugugcuugcagccugugucccgaccucacaguguccugggaccauccaagcccacucacuccugucuggcagccagccuuggaugucacagagcaccacgccccauguccucggccagcaccaccguccggccucgccagccacaaagggccgcccagguuugaugggaggggacauugacucaaggucacacuguaaaaagagcagaugaaaugggagauagcauuguagccauccccagaguguguaaucugccacaccaggcuaugcccacaagacaggcagcccuuccuuccauguuccaauuaucaugaguccccacaaugccuuccuccagugucuuagucuauuucccgcuacuacaacagaauaccacagacgcaguaacauacagugaaaagaaauuuauuuggcucacucaucuggagacuuccaccacauccaagaccaaggggccacaucuggugagagccuucuugcuucaugauaacauggcagaaggcaucacaugggggagagaguuggggagaaagagagaggcaaucaggcuaaacuuguccucucaucagaagccuacuccugagauauggcauuaaucuauucacgagagugagcccucaugaccucuuaaaggccccagcucccaauacaucacaauggcaaugaaauuucaacaugaguuuuggagggggacauucaaauuguagcacccagguauauccgugagugucccaaagauacuccaugucucauuguccugugggaaaugaccucgaugccaugguggccucuguaugccagccaucccagagaucacaagacagggaagcucauagaugaagugaugauucucaaaugacacggcuuauuaaaccaauuaaaaacacagagcaggaaacaagggugagugagcacacaggcuagggugccccugggguggauggagcacacacaccccugacuccugggugcacgacguucccaugaccuguuccucucugcugcaucagcuuugucacuggugcuggggcugugaggaccagagccaggcaggcaaagggguucagcagacgaaaaugcccagagcaugcacgcacuugcugcagcagaggggugcaggggcagcucuggcuugccaauuagccugaugaacagcuauuagcuuuuuuaaagauuuaaauccauuuggugcucuauuuagauuaaagaaagcauuuuccacaguaagaguuaauagaaguuagcaucugggauguuuaaguaaugaauuuacuaauuuucuugggcauaggacacgugaagccagaaugugucacccguggguggccaauuuaagaucucaugaauauugaguguguugagugcccuguggguguugagugcaucauggauauuugaugccuuaucguuucuuccccccuuccuaccugccggugauacucuuguuucauucuuuuuaaaucucuguucaacguacguauauucuguauacucuguguuuacuaugcauguuucaccagcuauuugcuucuguaaguagcuucugucauguuuuacaucagaaccgaauauucuuaaaccaucuggccagcacacaguacauggagacacugggaaaggcugcugcagguguuugacccagacuucaucuucugacauauucuugccucuccuuccagucaccacucuucuggauuuccugcuacaacaacagaauaccacagacgcgguaauuuacaaugaaaagaaguuuacuuggcucacucaucuggaggcuuccaucacauccaagaccaaggggcacaucuggugagggccuucuugcuuuguuguaacauggcagaaggcaucacaugggggagagagauguggggggagagagauggggagaaagagagaggaaaucaggccaaacuugcccuuuuaucaggagccucuugauaccuuccuucuggauacccaggccucugcugguggccaugaccgaggaccucacuccagcaucaggcagggacuacuccuuuccccuuuagcccugccucugaaacccaggacaggccucccagcugccauuggaaguggcuacccuuguagcccacacaccccaaccugcuugguagggccagcucccuuacuagcacagcuugcggcacaggccagagaccagcucgccaaccugaaaguguucccagcagagccaagccaggcucaacaaagaccuccccauucucagcucugggccugccucguuuccuguggggcuagccauagccaugccuuuuaaagggaacuccaguagggugugguuggccccuguccuacaaaagaguccccacagcccagcaauguccuuccaggcccugguuuaugcagucacguuccugcauggugucacuaaccacccuucccacgcugugcugugcaaaggccaucccaguucuuaccuaggucuuuucuugagugcaagguaaagagggccugccucaccccuuccucaaccauauugccuccuaugagcaaaggcuucuguuuaauucagucaccugacauuuacugagcauccacuaugugccagacaccauucuagcaucuggugauucagcaguaaacaaaacagacaaaaucccugcccucauggccuuuacauucuagugggggaguguuaugaacugaauguuuguguccccuccuaauucauauguugaaauaaaauccccaaggugaugguauuuggaggaugccuuugggaggugauuaggucaugaggggagagcccuaaugcaugggauuagugcccuuuuaagaagaggccaggcuggugugguggcucaugccuguaaucucaguaccuugggaggccuagugggguggaucaccugaggucaggagguggagaccagccuggccaacauggcgaaaccccgucucuacuaaaaauacaaaaauuagcugggcaugguggcaggcgccuguaaucccagcuacuugggaggcugaggcaggagaauugcuugaacccgggaggcagagguuacagugaaccaagaucacaccacugcacuccacccugggcgacagaaugagauucugucuccaaaaaaaaaaaaaaaagaggccagagggcuagcucgcucucuuuccaccauacgagggcccacaaagucagcagucugccacccacauaccugaaggugcugggaaccugaucucagacuuccagcuuccagaacugugauaaauacauuucuguggguuacaagccacccaguguaugguauuuuguuaauagcagccugcaccaagucagggagaccgacaagacgccacauaaauacaugccauagcauuggaaggugccgaguaccaugggugggccggggaggacuauaccagggaaagggguggagauuguggggcccagaguugagcugcaauuugaaacaggguggucagggaaggcuuuagugaaaaggcgauguuaagcgaagucuugcggugcaggagagcaccugcaugggaauaugugggaagggugcucugggcagggaagcagccagugcaaauagcaugagguuuugugcaaaaacaaacauaucuucuggguuuuagauuuuuuuaaaaaauaaucucugccucugcaagggaaaguuuuucccaaaaugaguaaagggaggaucagucagcagaggccaagcuuccaccuuuggguuaggcucuuggguggguaggcguccaccuacccagacuccagcaagguccuucucucacaccaaacaacgaaauggcuucccagggggcuccaucucagaacaaagggaaaguuggucccagagacaaauccagauuucugcccuucaaggaaggaguugcuuuuaauccagaaagaacaaucuuuccaauauucccacauuuuaaguccagucuuucuuggacagccucuuggcauuuauuuaauauugaggggccaguucaccugugaaacccuuugaaguaugaugauuauuauuccauuuugcaauuugagaaccaagguucagagacaguaauuccuaugcccaaggacacacagccagcugguaauagagcugaugugcaaauccagggugcucccucugugguccuuucugaugcgggucccuuuccagaacuguuguuugggauucaggcagaggcucuggagggcccuagcccugacugccccucuggcugggagaggguucugggacacaagugccauggcccuucggauuccuugcugagcccagccccagcugcacccuccuuacugcagccagaugggguuuuucacacccgcuuccauuagaggcuguguauccuuggccucagagccucagguggcucuucugagagauaggaauaacgccugcuaccaagguaaggcaucuuggcacauagcagaugcuagguuaauuguuaauauuauacccuuuucacucuggggugggugaugagggcucugggugcaucagagguggccgugcccagccccccucccccaguaaaucuggccuugagaguccccgagggaacauacaggacacacgggggccucagggcugggcuggcuccuugaggcucuuaccauuuuccaucuucccuuucuucacgagcuacaauaauuuaacaaccucgggagcgaaaagauagcuuggggagcaaauguggacucacugaaauuaaaguuaaauuggaauaaauuaaauuaaauggcaacuuuccggugcucaucucucaggccaaauuauugugcagcguuucuggcugcagaggagagggcuuuggcgguggauucuggcacuuccuggcggcucccccagacgccagagugugggguggcccuggggaggcaacugccuuuggcaacuucuccuagcucagggaggaaauaguggagagcacaggcagccggaggcuuaagcuggcugcucccaccuccgccucuccacgcuuccugcuuccaccaugaagccgcugguacggugaggcaugaccgcgcuacuggcaauccccagcccugggcccuuuggcuuaaggaggugcaacccugauuggcagccauggggcuuagagcacccacuagguucacaaugaucgugaccccuuaggcuucuaaggcauaaauuauaguugggggaggugggagucccagccgcccuggcugccccgucucuccuaaccugcccugcccugcacacuucaggccaaaacaaaccagauuccagggcaggcuggggcucaugggcuguacuuccuucagcuucccauccaauucccccaggguucaaagaagaaaauucgccacaagcacagaauucuuucaagucccaguuuuuaaauucaugugcacgcugccuucugcucgguaauguauucauguugauuuuaauguguaauguuugacacuauuuaccagugaguaaaaccgacaugccuggaggcugugccccuuuauccuggaucuuccgggaggcccuggcaugaggccugacagccccuggguaagaaugaaccacagggucugucugcccuucucccccacaccccgucccccccaaugccccccccaccccccggccggcucccaggcuggacucccuagaagguaggaaaaucccaaauuuacaacaacgugugugaaccuugaggacagugugcuaagugaaauaagcuggucacaaaagaacaaacacugugggauuccacucagaugaggugcuuagauuagugaaauucacagacaaggaaaguagaauugugcuugccaggggccggggucuggagaggaacggggacguaguguuuaacagguguagaguuucaguuuugcaagaugaaaaacaguuguggagguggaggguggugaugguugcacaacaugaauuacuuaaugccacgggaacugcacgcuuggaagugguugagauggcacauuuuacauuacauaucuuguaccacaauuuaagaaacaaacaaacaaggccaucaaggggcagagguggccuggcguguuuacccacccagggucucacugcggggcagggccaaggucagggucaggggcugacccuccuauucuugaagaagaucccggaccugcccugcuuucuaaggagguggcggcagaugcaguagauguggcucucuagccaccuggguuguccccaacaucggggcuggaagaagcccuggagaacagucauuccaaucucugcauuuuacugaugaggaaacugaggccaggaagggggagcuaccucucgaagucacacagacagcgauggccagcuuagagggcuuauuucucucuucuggugacccagcagcuaugaaaggccagaguaggucacggaaagcccuuccucgcagcaccagccccuugucacugaccucuggccccucuucuaaaagagcaccaguaaccuuugccgcuccucaggcugcaagccggcugauuaauuaacuaacccuuguuaagggcucaggcacaggcuaaugggcaguagguauucucauuauuauuuuuaaucagacuaugcaauuuuauagcucccgucacccaaggcuauugcgugucucugugucucuggaaguuaauuaagacugccagggaugggcucacagagggauaggaggcccagggcugggcugcgggagagcgcagagauacugauucccucagggccccacuuaagggggagaugugagaggguuggcagagggcaggucaaccugugcugagccccagggucaccugacggagcccaccccagggaggcaggaaaugagcugcagcacucauagcggccccagguuccagucucuggcucucuuucacagagagcaucugggcuacaugagcuuaggaaacugcgcuccugcagggcaccccaguggcuggguagccuugcucuggcucugucauccaggcuggagugcaguggccccaucaggguucacugcagccuccgccuccugggcucagcuuuccaaauagcuaggauuacaggaaagcaccaccaugcccagcuaauacugauugauugauugauugagacaaggucuugcucuaucacccaggcuaaagugcacuggugcaauuauagcacgcugccaccucaaacuccugggcucaagagguccucccaccucagccucccaaagagcugggaauacaagcaugagccaccgugcccagucuguggagccucuuagaacaugccuuaucacaucacacuucucuaaagaucacgcuucauagcucuuccuacucugggaucagaaagauccagacuuuccaugaagggagagcuggaaggagccuuuuaugaagacagcaaaaggauucacugaaaacuacaggaaugagaccgcuauaugguuugcuauuaaccaaacacaauuauucacaacaaacuauggacaauauauaaauuagccugauauaaauuuauguuuuuuaugauuugaaguuugaauucauuucaauuac

SEQ ID NO: 14557 - RNA, 3712 nt, Homo sapiens
ucucuaaucgcccccuccccaccuccuucuccagauggaaagaggagcuccuagcucacuuaagccgggguagggcugguucuccuuuccgagccaaaaucccaggcgauggugaauuaugaacgugccacaccaugaagcucuuguggcagguaacugugcaccaccacaccuggaaugccauccugcucccguucgucuaccucacggcgcaaguguggauucugugugcagccaucgcugcugccgccucagccgggccccagaacugccccuccgucugcucgugcaguaaccaguucagcaagguggugugcacgcgccggggccucuccgaggucccgcaggguauucccucgaacacccgguaccucaaccucauggagaacaacauccagaugauccaggccgacaccuuccgccaccuccaccaccuggagguccugcaguugggcaggaacuccauccggcagauugaggugggggccuucaacggccuggccagccucaacacccuggagcuguucgacaacuggcugacagucaucccuagcggggccuuugaauaccuguccaagcugcgggagcucuggcuucgcaacaaccccaucgaaagcauccccucuuacgccuucaaccgggugcccucccucaugcgccuggacuugggggagcucaagaagcuggaguauaucucugagggagcuuuugaggggcuguucaaccucaaguaucugaacuugggcaugugcaacauuaaagacaugcccaaucucaccccccugguggggcuggaggagcuggagaugucagggaaccacuucccugagaucaggccuggcuccuuccauggccugagcucccucaagaagcucugggucaugaacucacaggucagccugauugagcggaaugcuuuugacgggcuggcuucacuuguggaacucaacuuggcccacaauaaccucucuucuuugccccaugaccucuuuaccccgcugagguaccugguggaguugcaucuacaccacaacccuuggaacugugauugugacauucuguggcuagccugguggcuucgagaguauauacccaccaauuccaccugcuguggccgcugucaugcucccaugcacaugcgaggccgcuaccucguggagguggaccaggccuccuuccagugcucugcccccuucaucauggacgcaccucgagaccucaacauuucugagggucggauggcagaacuuaagugucggacucccccuauguccuccgugaagugguugcugcccaaugggacagugcucagccacgccucccgccacccaaggaucucuguccucaacgacggcaccuugaacuuuucccacgugcugcuuucagacacugggguguacacaugcauggugaccaauguugcaggcaacuccaacgccucggccuaccucaaugugagcacggcugagcuuaacaccuccaacuacagcuucuucaccacaguaacaguggagaccacggagaucucgccugaggacacaacgcgaaaguacaagccuguuccuaccacguccacugguuaccagccggcauauaccaccucuaccacggugcucauucagacuacccgugugcccaagcagguggcaguacccgcgacagacaccacugacaagaugcagaccagccuggaugaagucaugaagaccaccaagaucaucauuggcugcuuuguggcagugacucugcuagcugccgccauguugauugucuucuauaaacuucguaagcggcaccagcagcggaguacagucacagccgcccggacuguugagauaauccagguggacgaagacaucccagcagcaacauccgcagcagcaacagcagcuccguccgguguaucaggugagggggcaguagugcugcccacaauucaugaccauauuaacuacaacaccuacaaaccagcacauggggcccacuggacagaaaacagccuggggaacucucugcaccccacagucaccacuaucucugaaccuuauauaauucagacccauaccaaggacaagguacaggaaacucaaauaugacuccccucccccaaaaaacuuauaaaaugcaauagaaugcacacaaagacagcaacuuuuguacagaguggggagagacuuuuucuuguauaugcuuauauauuaagucuaugggcugguuaaaaaaaacagauuauauuaaaauuuaaagacaaaaagucaaaacaaaaauauuuucuaacuuguaaguucuauuuaaagggggugggggggaaucuugggaacguugugggguacaagccacaaguuaacuugcuaugcugccagaagggauuucugguauaagguugaaauugcugagauaaaauaaacuaaaacaacaaacauccuuaaagagguagggugugggcugcugagggggcaagagggauagacugaaucugucauuuuuuagaagaugcuucauaggacacaggacuauccauuucuacagacaucuuucuuaagccgagagcugucuuugcagaauuaucuuauuaaaaaaaaauacaaaaaaaaagcaccaugaauuuguacugugccaaaaugauaguggcaauaauauuuuucuucagaggcuaaggggaagauagaccuguacauguauuuuaagcaggaaaaccaccaaaauucaaacgaacccuuaaaggggcugagucuuuguccaugugcacaagucuugggggucugugcacuggacacacaugugccuugccugacagaauugcuuagaaaggagcagagaaggacgggagcuggcguagcucucagucuaaugcuuucacauugcaccagauuccugcaguugggcuuaacccacucugcaaggcaugugucuauucaggguuucccaggaggaggaggccccugaaggggugcggcagcaggggggugggaagggaggguaaagcagagagaauguauucacaggaggccauaaauuagcauugugccauguccaccuguuguuccuggacucugacacaugauuguagacaaugauggcauuuuaugauuuuuaaaaaagauuuuguuuguuuuaagguggagagggaggagaagccugaauuggggagcuugggaguggaagcuuuucucaugcuugugauuuggugacucuucuaaaugcugauucauuagggauuauuacagcggaugucaacugguuguggugauggggugggggcagaacaugaguagcaaagaaaagggagagacgaaaaggguacaggcucacguaaaguaaugaagccuuucccaaccaggaugguucacaaaaaagcugugagauccacaguuacaagugacacgcaugcacacauggaguuccacaugggguacuguugaauggagcacacugaugggaagcuucccucucccaggcccccucaggagaagguggaagagaaagggugggcguggguggggaaggcagagaucucuguuauucugguccaucuaaugauguaacuucuuucaguuauuauuuuagcuuuaaaaggaaauaagggguucagauuugaaagggggugguaugggugggggaggggaauugccaacaaaagaacacugauuguaaugugagaaaaguguauuuuuguauuuuaauaaauauuguugaauuuuuaauucaaugu

SEQ ID NO: 14558 - RNA, 17738 nt, Homo sapiens
cacgaggccccgccccggcggccccgccccuccucgggacucgaccgggcugcgcucacugcccagccggggccccgggagccuccaggcucccgcccgcccugagcugcggccuccgcauggaggggccacucacuccaccaccgcugcagggaggcggagccgccgcuguuccggagcccggagcccggcaacacccgggacacgagacggcggcgcagcgguacagcgcccgacugcugcaggccggcuacgagcccgagaggugacgcccagggcagagcgcgcggggcgcauccggggcgggcggccgaggagggcgcggcggcuccgggaacccggcgacgcugcgggggaggggcaggccccacaaacccuuccccuauuaccgccucagccucuaacuucccgaaacgccacgcucccggcuuugguugggggaugcagacgggcacugugcgaaggguuaggugcuucguugcacgggggagcggaggagagggaacaggucguaaaaaccuucccuaaaaucuuagcccuagauuggaccucgcuacacacccgacgacaccccguucagguggcuccaacuccugggguucaaacagugcuugcuggaguccuguccgacugacuuggcuuaccccuccuuagcuguuuccuccuagaacuaucuucaguggucuuacuggcagguguugguguccagauggaucgccuucgcagggcuaggugaggacacucuccccuccucaccaugcacugagaucugagaggcugccagugcagcucaccucaaggucucuccgaagacgcaggcccccaugcuggggucuguaggggaaugagggacacuggaggaagaguaggguagugagcugggccccagggggacuggcugaaaaggagacagcagcuaaucucuggauuguaucgcagcuugaaaugcaaucccacuguccuuccgguccagaggauuuggacuucuuucucugcccaucugcugguguucagcagcuuggggaggugaccuggcagcuggguuagauggggguggucugggggaauuagcccggcagcucugcccagggguuggccgcuuauguaagaacuuuuaacggcuuaaggggcuccucggcaguggggcugcugaguuaggccccccuguccuggcaggcugccucucuagaauugacucaggcuuaggcaacucccagccuuucuccuguccuagaaauccagcuccugggguucaggccgcagggcgauagggaggggccacaggggcugaaugagccgguuggggcuugacagaggcagugcuugguuagaguagggguugcaaacauaauguuucagagcucaggccggagccaugugagugcauccuuucuccagauugcacuucugcaucaaggggccaucccuacccccacccccaaccgacccgcaccccccacuugggcucagggagccuguguaaaccugagccccagccaggugguguagugagauucaaaaccugcuggccagaccuccaccugccuucgccaaccuggagcugugggaagaggacaggauucugugagcaguccuggguuugaauccaguguuauugcucucuggcuugaacuuggacaggcuaugcccccgacccagcucaacagugcuaauguuacuaccuuuucugcccuucccccaucuuccccucaagaguguuuugaaaucuuguuccuucaaauagccccaggccugauagagcccucgggguucccugccuggaccucaguacccagcugggcacuguugcccugcuacccugaggaaggggcuuggaccugccuuccuauccccacagcugcuaggugggggucucagggaacaacagcccuuccucggcuucggaggccgacugguugccucggugucuccuccccauggaggaagcagcuggggaagaucaggaagaggguguaugagaguggggguugaggguggauuagcggagucucuggaaaagcacagccuaacccagggcugagcccagcagcuuagagugaugaggagcccaacacagguuaaagugggagguguguaggggagcaggagaggggaguggggccaugaagucuguaaucacugggaaggugacccuccccaugccucagccaggcagccuaagaaggcuggggcagaugucacagucaggucaccugagaugguaaaauccagcugcucuccugggcccuggcucugguugaauccugaauaguacucuagccauuccuaacucauacuguaggggacagugacccagagcagguccuuuagugacccaguaacccagagagaccacugggcuggucucugcugugugccaaucucugcucugugccugcaguuggcaugauagcucuguucuucuguggccagaaagguaccccagagcagcucugaauggucaggcacuuucuguggcuggucucacugcucugcuccacguggccagugaaagguccuagugcuggugcuccucaggacgcuccccuggucccccauguggcccgggcucccugcaugagcccaagaaugcugaagguucagaggugcuucccacacaucgcuggcaauccggccccagccuccccucugcacacagauggaacagucuguguuuuccuggcagggucccgggggcaucaaugggggaggcugggcaucccagggaaccucguggcuuggaggccaagccuccccugggccuagcugccaucacacugcugagaaguaaauaaacccagccucccagggccacagccagccaccaagccagggaggggacugugucccacaccaccuuauucucuucuccccaagugagcugugggagccacaggaggacacagggaggaggcuguggagucuggguggggggacccacucuuggucugggaagagcacuggcaguucuggucccauaagagggaaggggaucuacuuccuaccaccccaccuuuccccaugugaaccuaucuguacccagucacugcccccauguagaaaucuggaucuugcugggcacccagggccaccaacuucugcuuuggggauuuuucagaaguucccuagccccuguucuuauuuguaugcacacuugucuaagccaggcuuaugauccucccccaucuucccaccgcaggacccucccaaauaacaaaccgcucucugagauuaaaagcccugguaccaacaccauuuucucagccggagauagggcggugagccgaagcacugggccaugaaucagaagcaguaccccucccuuccuuuccgaacuauagauuuugccucugucaagggaauggguacccaauacuugucaauuaauagauuguggaguuaaugugcucauuuaugaaaaaugcuuuguaaacugcagagggccccaaggccacccaaaggucaaggagugucauuaugaagaaugccggcucccuaggaugucgggauggggcauagcgauccaaccucaaaguccuuagugcuggguagcugagagcccagaccgguuucucagggcuccgggccuugaucaggguccgcggaagaguauuggggauuggggaacggcagaaccguguuagaggugcccuggggagaagggcaagguggguggccccggcugggggagaacucggggguggggggggugggggguguggggguguggggggguggggccucugcugggggguccuggguggcuggauguagagcggcggagggggcgugucccggccugacccgguacucucccccgcagccccacaccuccuacccgguccgggcuugcggggucgcagcgccgcugcaggcagcugggggcgugcgcgcggcgcggcugagcccuuugugcggcgcgggcggaggcggcgguuuccgcgggaggggcgagaagggcgggaggggcgggaggacagggcggcgcccuggcccgcccugccgcugccgcagcccccgcccccgcccccggcccgcccggcccgcggcagcagcguggccgcggcgcggcgucagcaguagcagcagcagcagcggcggcagcggcgggcggccgcgcggguguuuaugucgggucgcggggucucgcggcagcauggcggacuaccugaucagcggcggcaccggcuacgugcccgaggaugggcucaccgcgcagcagcucuucgccagcgccgacggccucaccuacaaguaagcgccgggucucguaccccuaggugcgcgcauccacgcgccgcgacccccgggccggcccugcacgugcgcggcucccccggcguucccugcccggugcgagugccugcugugggcgcugggggcugggcacgggaaggaaggaggcccgcgccggagcagacggacguggcacggcgacaccgcggcccucagagcccugacccguuucuggccagauccggguucggccuguccccuuccuccucucagcggcauggaggggcccucgggcgugugggaacuggagaugugggcauuauggggagacuuuucccagccgcugguccaggacgcccccucccagccucaccacgagggcagaggguccccggagccaagcuuaagcagccgcuuccgcauggccccaggagaggcccagccaggugguugggguggcuucuuuuccaacugucuaguccagcgcuuuuuccaguugugucccucccugcccacagguugguauuggugccccucccaaggcgcgaauuauucugugacugcuaccccuaagcccacccuacaugggguuuuggaggaggacacagacccacccgucugccucuggcuucauuugccuuuuccguggucccuaggccaguugcccugcgugcugcaggccuggcacuagcucugccuccuggcugcaggacugugccccugccaggaaggagcaucagaaggggcagaguggggaugcuggccagucaaaagcaucccugccuugucuccugccagcccugcccuggcuuguaagcacuccugcuuggccagcaguuucccuaaacaccaggauacccagucacuccugaggagugucuccuccugccugcccguaggcgacggguguauagaacaccuagaaaaugcuaugaggcccagacuccagcauuucuucuguggccucuuugcuauacagaagaagggcugccaaaggcugggagcagccgaaauucuuuguuuuuuugguggucuuuggugaugagauugaaagcccaccuuugauacaguugucauugaagucuucuaggagaacacccuaggggaacgccuaggaguuucucuaggccuuagggcagauuaaugacccaccccccuccacccuguggcuuuuccuuccugcgcuagggaugccugcugcuuugcuuagcucaguucauaguguuccugaagugugggauauuugcuuuugggugugucucucaaggccugcugugauuuuagcagguuggggccccugagcugugacccugcaccuagauguacccaugcaggccugcacuucccuugcggaguuugcugugaccguggcccacccuaguguugguagcugccaugcuuuggcuggggacccaguguccuggucccaccucuaaggccucuuuccuccccuuucccguccuggccauuucuguucugcucugucagaacaugcccugcacucagcccccuggggucccuccaugcuguuccgagcccugugugacucagcagcccaggcaccggggcaugcggacuguccugugcugggucauguucauacuguguugagcgccacaaaauuguucucagguuuguucccaauguuuacuuauuuucucuccccaucaagauugagaaguuuucaaaggcaggcacugugucugcuguguguggcgauaugggaacuucugugucgcuugacaaacucugagacuuaaaggcaauggauauuuugggccuauuaccuugaugguaccccaguagaccuuucgcugucuuuggcucuagcucugggggcuggaguuugccagacucuagugaggugcacgaggugggaacugcccugauggggcaguagggauggggggcuguagccucugcuccucuaggcuuuucuguaccccccugcugccuccucuggcauggcaggcucugccccuuuggggcaccccuccccacuaauaacacucacuucucugucuucacagcgacuuccugauucucccaggauucauagacuucauagcugaugagguggugaguaccucuuccuuugacaaggggagggggcuguguaugugguggaagaggcugacuucuugcucaggggcagggcauggagagauggagagacuuuucuugggaauggguggauaggauauaguccuuuuuuuuuuuuuuuuuggagacagagucuugcucugucacacaggcuggagugcaguggugugaucucagcucacugcagccuccaccucccagauucaagugauucuccugccucagccuccugaguaacugggauuacaggcacaugccaaaaccccccgauaauuuuuguguuuuuaguggagacgggguuucaccauguuggccaggcuggucucaaacuccugagcucaagugauccguccgccucagccuccgaagacgcugugauuacaggggugauuccacccagcugguauggguggauauagccuuuauuguugccagagaaacaggcagagaucaaaggguuauaccugauggggcagaggcagcuaugggaacacaggaguguccugagugaggccuggcccagggcuggguggcucucugucagugacagagccugugggcagguucagaagaggccugggaaggggugggcuugggagugggaacggugggcuugggaguggcugccuuauuguagagaccauaaggauuggauuuugucuggaaugcugaacaaggacaugauagaagccagugaaauuauggagauuugaaaccgguagacagacuuguucacugauccacaauguacaagaacuggcaagaggguuuaaaagaguuacauuuuggauaaauacaaggaaacgcagugccuugcuuucccagaggggcucaucagugagccgaaucaaugaacaauuaacauaugauaaacucagagaagcccagauggguagugaugaugguguaagucauuucaagaaaaagugccaugauucaaugaugaauucauauacauuaaaaaaaaaacauuucuuuucuguugcuauuauuauugcuauuuauucuggucugauucucaugaaaggccagagggccugagugugccuggaucacuuacaugugagggaaguucacauccagcugguguuuagccagagcugacccagacagauuuucagggggaaauucgaaugauucugguuguuucccuuaugacaacaaccaggaagccugcuuggugcagcuguucaguuuaacaaaguuuacuggccaguguggcuuugugucagacccugggcuggcugcuaggaagggagggauugaaaagaccccuaccagcugggcgugguggcucaugccuguaaucccagcauuuugggaggcugaggcaggaggaucaccugaggucaggaguuugagaccagccuggccaacauggugaaaccccaucucuacuaaaaaugcaaaaauuagcugggcauuguggcgggcaucuguaaucccagcuacucgggaggcugaggcaggagaaucacuugaaucugggaggcggagguugcagugagucgggauugcacuacuguacucuagccugggugacagaaugaggcuccaucagagagagaaaaaaaaaaaaacccugccuggccggcaaggaucuccuuguccuguggcuucugucaggaaggcuguggcccuucuguggcaugacaaaagagaagaugguguuuucuagaucauggggccagaggucugaacuaggguuagugauggguuucagggacuuugaaucuaaaaaaauuacauagcaaagucugcacaaaugucuuggggacugggauccacuacuguuggccugacccucagagggguaugugcucuggccuuuccuccaugggcagguggcuuuuaaauggauacuugcaauccugaccacucuccugagcuccagaccauucguugcuugcuuuccuggaugccuaaaagacucuuuuccaugccuacccccaccucagcccuugucacccagaauccauucuccaccuuggagccugagugaccuuuuugaaacauaaaucagaucauuucucugucaagacccuccaguggcuucucuccgaaucaaaucugagcuucuguccguggucuucacggccaugcaugcugccccugccuuccuccugccucucccuucccuccacuccccuggccuucuuuuucuuucuuaagugugccuccgaaagaacuggacccugaggcggguuugcacucagucccucagccgagagugacagccccucugacuucuacuuaaucggcucccacuggucaccucccaggaaagaggcuuuccccagucaccuuguugccaguggucgcuuggccuuuuuguuuuucucugcagccuucauccugacugaagucaucuugagcauauguccugugucugucauuuuucuuuccaaguagaacauaagcuccauuagaugagcugggaacucauccaccuuguucacugccauguccccagggccuguccuggugccggugcauguaggagcucagugagugaguguccagugggugauaaacucuuuacgugggcugugccuccauccucaggaccugaccucagcccugacccggaagaucacgcugaagacgccacugaucuccucccccauggacacugugacagaggcugacauggccauugccauggcugugaguuacacaccugcauggggacuccagggcacacaggaacugaccauggugggcugugcugaggggcagggcugaggaggaaugggccccggcucugaccacacuucccuucuacaucagcugaugggagguauugguuucauucaccacaacugcaccccagaguuccaggccaacgaggugcggaaggucaaggcaaguaccaggccuguccccagcaagaugccaccuggcaguccccaccucagaggcccucccagccuccccugccagcccugcacugcuacacucccugcguguccuuccucucaguggagccuuggggccgagcccucauuuucccacuggcuccucaucccacugaggguccuggcuucucugcagcacagcugcauccucuguucccuguggccagccuggacaucaucccuggcuuucuuccagccuuuuccucccccaucucugcccgcagaaguuugaacagggcuucaucacggacccuguggugcugagccccucgcacacugugggcgaugugcuggaggccaagaugcggcauggcuucucuggcauccccaucacugagacgggcaccaugggcagcaagcuggugggcaucgucaccucccgagacaucgacuuucuugcugagaaggaccacaccacccuccucagugagguaccugcagggcaggggaagcagggcuggguguagagaggacccucacgcuggggccucagacuggugccugugaccagggaccagagggaggccuggcuccuucucucucaccugccaaccugcaggcaaauguuccuggccccacaggugaugacgccaaggauugaacuggugguggcuccagcaggugugacguugaaagaggcaaaugagauccugcagcguagcaagaaagguaccagggagcuaguugaaaacucaacccccagccugacucccuguccacagucccguuguuccuucacagccuuacagguuaucccagcaaccagacugagcccuggggaagguucgaauaaccucaggcaggccagagcacaacuccugccauccuucucuuagcuuagggaagcuugccccuagugcagcaucuucauaguauguuucccaaaacuaguccuaugcgaugcucaucagaaaaaaauccugagcaauaacuccuuucucuauccccuaucuugcauaaagaauugcacauucacuuauuaaaggcucucagaaguccugcaguuaaauuuauuugacacuagagcuguuuuuauaauauuuuccagcuagaaacaacuuuagcuuuuuuuuuuuugagacagagucucacuuucucacccaggcuggaguacaguggcgcaaugucagcucacugcaacccucgccuccuggguucaagcaauucucaugccucagccuucugaguagccaggauuacaggcaugugcuacuauaccagcuaauuuuuuuuuuuuuuuuguauuuuuaguagagaugggguuucaccauguuggccaggcuggucuugaacuccuggccucaagugaucugcccuccugggccucccaaagugcuggaauuacaggcgugaaccaccaugcccugccacaacuuuggcuucuauuuauuuauuuuugagacagagucuugcucucucauccaggcuggagugcaguggugugaucuuggcucacugcaaucucugccuccuggguucaagcaagucuccuaccucagccucccgaguaguugggacaacaggcacacaccaacacacccagguaauuuuuuuguauuuuuaguagagaugggguuucaccauauuggccgggcuguucuugaacuccuggccucaagugauccaccugccucggccucccaaagugaggaagcugugagccaccacacccggccaacuuucgcuuguuagaaaaaaaaaggaaaaauuaaauauucaccaggucccuguuggcuauacugggaaaugcuucccugguccauacuggaggguucuuuggugucuguauuggacagggcacaugcuucucccugcaggacagcaucacuccuggcuaggagauuucggccacuguggcccagcaggugaaaggcugccagugcucgggcugcccaucccaggccacggggaugcccauccacagacccccaggaaccugcugggcugaaagauuucuuugcucccuguuccuugggaagagggcuaggucccuaggaacacuuccugggggcggugcugucaccuaguggcugacugggguacuucaguggaaucucuggagugguccacuuucaucuucacccuccuaaacaucucccaaacuucuccccaccaagccugcuucauuucaccccugcauuccuugucagggaagcugccuaucgucaaugauugcgaugagcugguggccaucaucgcccgcaccgaccugaagaagaaccgagacuacccucuggccuccaaggauucccagaagcagcugcucuguggggcagcugugggcacccgugaggaugacaaauaccgucuggaccugcucacccaggcgggcgucgacgucauagucuugguaaggcccccgccugaguggugggggagauggaugagugguucagcagaguggagguuuaugaggacccagguucaccucugauuaagccugugccccucccuugcuacucuuccucucucuuucugagugcucccuggugucagaauuaggaggguggcagcaggauugccugagcucagagguucaaggucacagugagcuaggaucgugccacugcacuccagcccuggggacagaacgagacccuuucucaaaaaacaaacaaugguuugugucaucugagauacaaagaaagaaaacaaacaaguuaaaauucuccaguggcacagccauaagaaagaaugaaauccuguccuuugcagcaacauggacagagcuagaagccauuauccuuagugaacuaacuccaaagcagaaaaccaaauacugcaugcccucacuuauaaguaggagcuaaacagagaguacacauguucauaaagauggaaauaauagacgcuggggacuccaaaaugggagagggugggaggggaacgaaggaugaaaaauuggcuaucagacacaguuuucgauauguggguauuagguacacuugaagcccaauucucaccaguaugcaguauuccauuuaagcaacaagcacauguacccacugaauccuuaaaaaaaaaauugacaaauuguugcaagcaacaauugcaaaucaagacucucccccaccccccgauaaagggagguagaauaaagauaaaggcuuauugaucccuugugagugaucuggaccauacaucuagauucaucuguauucuauaacuaggaggaagagaaauuaggaaggucacuggcacccucucaacagcucacaacagacugcaaacaaaggccucugagggccuucuuggcucauaaguugacccugauaauuuagcucacguuuacugagaaccgccuguuugccaggcacugcgucaagaccuuaauguauaucaguccauugaggaacagucgccauuccauuuucagaugaagaaacaggcuuaaagaaguuaagucauuucauuugguuagugaguuggugggaacaggauauggcuccaggcagugucuccuugcuuuaaggaucagucuguacaauggauaggaaaggccuuauguacucuaagacugcauuaguugugguuaaccuuucagggaagcaguccccuuugagaauugacugaaaguugucaagugaauuuccagaaaaaaaaaaaaaaaaacaaccagaaggaaagagcauucucauaacaguuuucauaggauuugagggguucauccacucaggcucucccuccugccuugagaauccucagcugucuaagcccaagcucuuccguccuuucucacaggacucgucccaagggaauucgguguaucagaucgccauggugcauuacaucaaacagaaguacccccaccuccaggugauuggggggaacggugagugcggggucgccucccacccgccugcuccugccccuccaaugaguaacccuuuucuguccuucagcaucccuaggugaugguauggcuccuggcauggguggcagggagcaugaugggcuuuggucacuguagggggguuggggggugcuagacuggggucccaagaggcuguugggcaggcaggggcaucccauccucacauuguuccucugccccauccccacccccaguggugacagcagcccaggccaagaaccugauugaugcugguguggacgggcugcgcgugggcaugggcugcggcuccaucugcaucacccaggaaggugggugucaggaggugagcgagugcccgcuggccccggggccucgccuuuguuccccagauguauaucaaguacucucucugccaggcccuguucugccaugguaggcuccggggugacccaggcaugggccccaccccaucgggcccacugacuuaggggaaggcagguguaagcagggugcaagagcugcagccugcuucucagagugcggucaagggggcucugccuggggcuuggggccuggggcuggugugacuguccauggggcuuguuggaaccucaggguuuggauuugauuugugacaaggcagauauuuaagacacagagacgacaugucccugaauauauaaagauauguuauacaccugcuucaccaugugguugggcguggggaguuccacccaauuacaaagcccuuuugcaggguggguuccugaacaugaagugggaaggggggagccuggcaugugucccccaugugguuauugaggaggugcucccuggaggcugguaucugacuugugggguggcugccuggaagacuuggguccucacuuggccugaggagauguacccggccccuccugugagggcaauuucuccaaaacacugagugaugcauuuggccuuuccuaccccaaacagcucccccuuuugguccucagagccucugcuauuuagguuugugcccuucgccuuagguggccaccauggugaaaugagggcccucucucacccacuuaacaaauauucauuaggcaccuacuugucucaggcacuguucaaagcuuugagguagaguagggacaaaacaaaugagaggcgccaucucugguuuauccagcuuugcauccgucccuagacaggugugguuccuuguaguccccaccuaaaaccuaacacugaaggaccuuggacacuuagacuugaagaaaugcaaaccaguaucccaaaggggaccauaguaccuaacccugguaacgguuuuugcaaacaaaagccuugaaggggaacuugugccuugagagcaggugaggcuggggccaccugucugggggcauugggcucugaaggccgcuucugguucccccgucagaauccccugucaugcucuuaggggugggguggcccagaucccuagagugacacucauccuggugguauuugccagcaccuauguuaugccucagacacaccauccagcccugucccuuuuccugaguagagguagugcacaggaggaagagcugggcuggccccgcuccaggccccggaguugcuguugacucuucucugccuugugcaccccacccucccccagugauggccuguggucggccccagggcacugcuguguacaagguggcugaguaugcccggcgcuuuggugugcccaucauagccgauggcggcauccagaccgugggacacguggucaaggcccuggcccuuggagccuccacaggugaggggagaaugugcuggggauugggcaggcgagggcuggaagcuggggggguggcacuagugggcuggaggcacuaaucccuugcccacuguagugaugaugggcucccugcuggccgccacuacggaggccccuggcgaguacuucuucucagacggggugcggcucaagaaguaccggggcaugggcucacuggaugccauggagaagagcagcagcagccagaaacgauacuucagguucccugacccugggccccaccugggcagaucagcccacaacccuucagggcccgcucaugccaccgacuuccccagauggcagccaguccccauauggugguucuggaaacugaggcacagggcuuaaguagcagacccaggaucugucccugggccaucugacucagcccagugagggguggccugggggaccuuccugggcgguaucccguuuuugcccuuaagagguggggugggguccucugagcuucaagcugcugggcucagucuuccacccuccacgcagcgagggggauaaagugaagaucgcgcagggugucucgggcuccauccaggacaaaggauccauucagaaguucgugcccuaccucauagcaggcauccaacacggcugccaggauaucggggcccgcagccugucuguccuucggugagugcugagacuggggguggcuccugcuuccuuucucucgcucuucuccacccuugguggcccugaucugcuccaccuaccuuccuccuagguccaugauguacucaggagagcucaaguuugagaagcggaccaugucggcccagauugagggugguguccauggccugcacucguaagugugguggccuccuugcugucacuuggaggcaguggguugggcagguggggccaggguucugaggucaagcugagguuccagggaccccauggaccaccugcagcagggacagaugcugcugcaggauggccccucacccucucuucgggggcccagcccccuguuccuuguccuuuaguccccaugcaagcaggcccuccccuccccucgggccucucccgagcagggcacaggagguguggccagucacugcaccuggacucccagcccuugcuugcucaggaagcuugguggcugguggcaggggcugugguggcaccaggcagccaggcagaagaugcgggugugaccccucuggcggguacaagggcagagagauggacgccagggccagcgcuggggcaaccgugggcgggggcagugcucguuggcagcaguaguugcaggcaugugccccacccuggucaggagcccuguccccagguaucagcgggcgucuaaccugugucucuuuccgccccacccuuccguagcuauaccuuucugccguguaaguaaccgcgcugcccgggccaagcguagaguagagcaggggcagucugggugggaccugggcuggagguggggguggguauuggguggggguaggagggugcugggguguaaccaugagauguggacccuggguuugggcccccccggcccccuaacuccaacaccaugauggaggaaaccagcaguguccccucauccagcugaaacacauaucccuuucuggcugcagagagaugcccgugaccucaggccuaaggcugccccauuuuagacuggacccagugaccacaagcagccuaggccacugugccugcagggcuggggcugggugcggacaugggcagcagagguucggcuccagguuggaguuugcuccaugaggaugggccaugccugccugagcugucccuccacccugggcacugaggacauccacucagauguggcgauggcccaaaggagcauggccaucucugcacccagcaugguucuucagggaaugcuggccugggggaggacagaggccuagggccugcuccaggcccuccuccugcgccguacggcugagaucucagggcuucucagcucucuguucucuccuacaucugggggcccuggggaaaggguuuugggaaggagcaggguccacacacccacucuuguucccccucuugccuuguccccacaguuacgaaaagcggcuguacugaggacagcgguggaggccgaggugguggaggggaugcaccccaguguccacuuuugggcacagccucccuccauaacugagugguccacagauuugcacuacggguucuccagcuccuuuccaggcagagaggaggggagguccugaggggacugcugccccucacucggcauccccugcagagucaggacugcucccggggccaggcugcccugggagccccccuccgagcccagccagccaggcucucaggcccugcgccugccucaggucuuucuugcugcagccugcuccagccuggcccccaccccaggggcaggcggccccuccuggcuucuccuguagggcaccucccugccccuagccucccaggaaauggugcucuccuggcccugccucuggcccuucccgggccgcugccccucagccauguggcacuucugagcuccugaccuaggccaaggggaggucucugcccccuuccccggcccugggcuacccuuggguccugcuccucaggccgcuccccugucccuggccauggguaggagacugcccuggucauggccgccugccugucauuccugacucaccaccguccccaggugaaccauuccucccuucuccucagcugcagucgaaggcuuuaacuuugcacacuugggaucacaguugcgucauuguguauuaaauacuuggaauaaaucaagcaggucucaacgccu

SEQ ID NO: 14559 - RNA, 2375 nt, Homo sapiens
guauauggcaugagaauuaucagcuguuuauuuucaucuacuuugucuccugaaauaaauugccugagggcaaggacucuuacauuucuuugccauuuuugcuagguguucaaucaccguucacaaugauaacaguaggaaaaagugcgccuucuaguaaguggacaaacaaguuugaguacacugcucugccccacucccuuguuacgggguaacauaacaagguaaaguaccuccacaacgaggcaagacuagguccuguuccuuaaggagcccgcagccuugucuguucuguucguucccuggcagauuacaggcuguggagaucccucuccccgcucucuaacguggagucggcugagcacgacucucucgccccagcgcgggaggucugcggucugcggguaugaggcgcuccaggggaccuggcaucgucggcgugcaagagaggagcggaccugagacgcaaggagaagcccugccucuggaguccagcuccuuuccucuucugguuuuccucggaaggggccaggagacacuggaagguccggacggcagggaaggggacgggguucuuuccagucccacccguguagggacaccucucccccucaucccccgauguacccucgcugaaucugggaugggagagacgaaccgagucuaggcaucugcguagcagcgccggggagagcggggagcccagggcggagcccagucgacucccggauuccccugccccgcccccggcacgaggccccgccccggcggccccgccccuccucgggacucgaccgggcugcgcucacugcccagccggggccccgggagccuccaggcucccgcccgcccugagcugcggccuccgcauggaggggccacucacuccaccaccgcugcagggaggcggagccgccgcuguuccggagcccggagcccggcaacacccgggacacgagacggcggcgcagcgguacagcgcccgacugcugcaggccggcuacgagcccgagaggugacgcccagggcagagcgcgcggggcgcauccggggcgggcggccgaggagggcgcggcggcuccgggaacccggcgacgcugcgggggaggggcaggccccacaaacccuuccccuauuaccgccucagccucuaacuucccgaaacgccacgcucccggcuuugguugggggaugcagacgggcacugugcgaaggguuaggugcuucguugcacgggggagcggaggagagggaacaggucguaaaaaccuucccuaaaaucuuagcccuagauuggaccucgcuacacacccgacgacaccccguucagguggcuccaacuccugggguucaaacagugcuugcuggaguccuguccgacugacuuggcuuaccccuccuuagcuguuuccuccuagaacuaucuucaguggucuuacuggcagguguugguguccagauggaucgccuucgcagggcuaggugaggacacucuccccuccucaccaugcacugagaucugagaggcugccagugcagcucaccucaaggucucuccgaagacgcaggcccccaugcuggggucuguaggggaaugagggacacuggaggaagaguaggguagugagcugggccccagggggacuggcugaaaaggagacagcagcuaaucucuggauuguaucgcagcuugaaaugcaaucccacuguccuuccgguccagaggauuuggacuucuuucucugcccaucugcugguguucagcagcuuggggaggugaccuggcagcuggguuagauggggguggucugggggaauuagcccggcagcucugcccagggguuggccgcuuauguaagaacuuuuaacggcuuaaggggcuccucggcaguggggcugcugaguuaggccccccuguccuggcaggcugccucucuagaauugacucaggcuuaggcaacucccagccuuucuccuguccuagaaauccagcuccugggguucaggccgcagggcgauagggaggggccacaggggcugaaugagccgguuggggcuugacagaggcagugcuugguuagaguagggguugcaaacauaauguuucagagcucaggccggagccaugugagugcauccuuucuccagauugcacuucugcaucaaggggccaucccuacccccacccccaaccgacccgcaccccccacuugggcucagggagccuguguaaaccugagccccagccaggugguguagugagauucaaaaccugcuggccagaccuccaccugccuucgccaaccuggagcugugggaagaggacaggauucugugagcaguccuggguuugaauccaguguuauugcucucug

SEQ ID NO: 14560 - RNA, 33270 nt, Homo sapiens
cggggugcggacccgcuuccgguugggcggugcuugcgcgcgugagcugagccggugggugagcggcggccacggcauccugugcugugggggcuacgaggaaagguaaguacggugaugcccagccccuucaccacugccucaucuuuauucgcuuucuuucuguccccggucuuguucuuggcgcggcaggggacugccucacucggugccgcugucucugcuggcgcccgggucccaggccugaugcugcuggagaucccgggacccucugugugcagccugggauggaggccgccgcccgucuuaccgcgcgcucugggaagggggcugguccgguggaacucugucccguuggguacuguucugugccugguuugcugcguccugguccuccaucucuaggucacgccacucaccgagucucuggcaccagagggucauuuuuugccuccggaaggucggagggcauuuggauaguguuauuguaagaguuccuugccgccuccacucaccauccugcuuguaucugccagcuccgccccaaggccacaucccgacaguagggugcaucugccaaggucguguucacucaccuaaagggugcagaaacaaggggggagagaacgagugacgacacuaggugauaucuaugauuuuaaagaaaagcugaauguuuagagcuuccauauuuggcuacguacuucaguuagcgacggaaaauaguuuuuaaagcuuuauuggggaauuaauuuuuguuacguuuuuuguugcuucuagccccauauccuacugauuuuuagcaugcugcggucagaaauaaacuuaauucccuauagcugccgcgauuaagcguagaguggcuugcaguuucaaaagcugcuuuugcaucaaggcccaagcuccgugggucuccugcuaaaacuuuugagccugugaucugaauuccuaaguguauaaaauucuagaauagugucuucgagaauugaguugcguucauuuucugguguggaccaugaagucaacguuaaugaauugggaauaagguggcuucuaguuguuuuuuguucuaguagcuuauucagcuuggaggcagagaaccuuggaaucucuguuaaauuagucugccauagaauggaacuugacacaagacaaaugcaaguuugaccucacucaguagauuuaauuaaccaaauaccaaacgacaguaaucacugaagaauuuauauaguauaauccaaaugagggaccagauauaaccucuaaguuguauuugucaagaaaaugaguuugccaagaccuaaucugagguuuuacugugauugggggguggggggguuccaauaggauucuuuugagaaucacaaguaggaaagccaugagcucacaaaaauguauugaguaugccugagugaauaguacucaauauagcuuugaaaccaacucauugucacucucaauguaaucauuguuuguuuucauucauccagugaugugucaagaaguacuuauugauagcacuuaauauccauuagagcaguauugggaucuauauauugguguuauuuuuuaaaauuuauuuauuuuagaguugagggucucaguauguugaccagguggagccuugaacucccaugcucaagcaguccuccugccucagccucccaaguagcugagacuagagguauauaacaccacacccuaguacauugguguuaacacagauuuucuguaacguagguauaccagggauauugaaaggacagagguguagccaaggauagccacuggaaaugcuagcuaggccacaaggcccuagauucucacucucugaacucuuaaguauggauguugcugaugcaguaauuuauguauuagaguuaagacagcugaaauaacacuuuugccuguuccuggcugauugccagauccaguaaacggaauuggaaguuggagaacacaggcaggcaggaaccacauugcugccaaguaccgcccaauuaauucaguaagauguauuaauccaguaaaauguauugguaucaaaaaagugcaagacaauguauuagggacaauauagggguaauaauuuguauuagaaugauauguagacauucuuccagaaaugucgauucuaaaggggagcuaaggagacaacuuaagguaaccuauggucauuguuuuugagugguucagacgaguuuuauagaaguuuagauuggaucauacccuuuuuguccaaaaagagaaaaagauaacagaucacuuccagcuagagugaucauaguagguaggucuucuaggaucuuaaauuuauuuauagacaucuggcacugaaggaaguuugagcuaaaauaacuaccaaauucucaacagugucacgcauguuacacaugcacagcaaaauuacaacuagaaaccaaggcuccuaucccuacauuucaaauagcauuucucucacaauugauuauguauuaaggcuugucaacgaaaaggaaacuuuuuucucucagaauuucuagaacuuuuuucuuuaaaaaguuuuuuauucuguagccagaaaaauuuaaaguuugugcuggguugcuuugguuauagaacuaaugaagcuugaguaauaguuucagacauucucaggguuuuucuucugcagccagauuuuacacuucuauuaucucagcugucuuauaaauguauucccuccaucacacaauauaauuagaauguauugaugaacagauguaacuucaucacuagagagacguuaaauaaauuauguguugguaucaugacuuuuaucaaaucaugaaggaugccaucacuuuuaugugauaguccauugguauaguacuaaaguuuguaaguaaagaaugucagauagauaacaagauaacuucauuuucgagaucucauaaccugggccuuaguauaguuaaauugcuaucagucuguucccuguaaucuccaauugaaguagacaguuaaacaaugagauccugcuuuugcugcguuauggagaaauaaaugccuuuucuggugaauauccauccagcucagagaacuggaauuuuacuaccacacccauuucucccaauuguuaacauugagcaaugggucuuuggucaaccauaauaacuguuggaucacucaguguuaacguucuugugaaguugaauuuaaacaucuaaauuucccugaaacaauuuaaguauucugugaccaauggcacuuuaccaaaauugaaaguuugggccauguauugcucgcaauacugguccaauggauacacuauggacacuaaggacaaaaacuuccuugaaagcucuaaguucuuaccugaagggugggguagggagaagugauaagaauuuagagcuuuuaaggacauuuuuggauggaucgaagaaaccaauucuuaagacucauuauuauuaaaaucacacuuaacccaguuaggcuuuucucuuuauaaauuacuggaacgauucaugaaaacaacuuuauagaagaccauuauuggugacauacuaauacuacaaaaggaugauagcuacuggauauauuuucuguucuaaucuuuugguuugugucuaacaugcuguccaauaaaaauauaauacaagccacauauguaauuuuaaauuuucaggugaaaaucuaaaacaggugaaaguaauuuuaauaauguuuaaucuaauacauauaaaauaccauucuuucaauaugaaauguaacacuuauaccaaucgcaauucacacuagccacauuucaagugcuuaguagucacauguggcuaguggcuacuguacugggcaguacaggccuagauuuuuuuuuuuucccaagaaaaaaauauuagauguuacccuucguggaagagggacagaauuuuagagagagaaacucauuugagaaaugggagguggggaaauucaguuuucacaaccauugguuuacuuucuagaucacaugauaaaagcucauacagcuaagucuuuuguuuauguguaucauauuuuuccuaauauuauguuguccauuauguccauaguauauccauuggaccaguauugugaucaguauguauggcccaauggauacacaaagaucuuuccagcuggaagugaucuguaccuauuccucuaaacuuuuuuuuuacuuuuuggacaaaaguauccaauuuaaacuuuuuuuuuucuuuuucuuuuuuugagacagggucuuguucccucaccaaggcuggagugugguggcaugaucaugacucacuguaaccucgugucuccggggcucaggcgauccucccacuucagcuuccccgguagcugggacuauagcugcgccaccacacccagcuaauuuuuuguauuuuugguggagaugggauugccuaggcuggucuugaacaccagcauuccauccgccuuggcccuccaaagugcugggauuacaggcuugagccacugcugcuggcccagucuaaacuuuuauaaaguguugaagugggugaggaaaaugagaagggccauuaacuuuguaucauuugguuucaauuugguugaaaagacaaagaugcuucagaaaugaaguguacuggcuggucaugguagcucacaccuguaaucccgacacuuugggaggccgagacgggagaaucacuugaggucaggaguuugagaccaaccuggacaacauggugaaacccuguaucuacuaaaaauacaaaaauuauucgggcgugguagaccaugccuguaaucccagcuauugaggaggcugaggcaggagaaucacuugaacccaggagguggagguugcagugagccaagaucacaccacugcacuccauccugggcaacagagacagacucagucucaacaaaagaaaacgaagugcacuaaaguagauuuucaaaugcuguguaugaaguuauuuuuuacuguuccuuucacaucuucccacguaagauauccuuugucuuagauguccuuuguuucugcuugaacauacaugcuccauaccaaaaaccauaugguuuuagauaaaucuaguacaguuuuugguauggaugguguuuuuuguuuuuagugucuauauucauaaaacaagagggcuuuguuaaaguuucuaauagccaggaguuguuauauaugugggcacaaaggacguuuuguuuuuuuuuaaguagaacuucuuuaaagugcagauuuuucauuccucccugcagaaagauaaagaaguaaagauggaccauuggcuuuguccaucuggguccuugaugaccguuguaggcaguuucaucaauaguaaggaagccagguuucaggguagcauuggacagugaggaagcagaggcagcaggguagaaacugugggugagggaaagggaggagcaagcaugaaggaacagcacagucugggaaagacuguggguaguggagaccugagaagcacugauugacagaauggaggagccuguuuaagggaugagauugaaaguuuauucaggagaggggaaggaaggagaaaugggugagugauaaagcuaaaucacuuggcuucuacucuuuggaauucugguauccuuguaucaagauauuaagccugaaacauaaauguaguuuucccucuaaaucacagaguaaaccaaucuauuacauuucuguaugcuacaugucucaaaacuugguacaguauccuuuccaggaccagauuauguuagagugcauaaguauuuauucauauuguaauauuugggguuggcaagaauuguuaggguauuaugcuauauuuuauuuugagaauguaaucauuuguaaaauuuuccuaaagauaaaguccccuuaggcauaaggaaaauccuuuguugcagugacucuugauuuuacuugauucugcaagccucugucacuauacauauuguugggauauaucccaaaacaucaacaacauauaauucuguuuuuuguuuccaaaguuuuguuuaucuaaagaauuauuuguuuauaggcuggguaugguggcuuacgacuguaaucccagcacuuugggaggccagggcuggaggaucgcuugagaccagucugggcaacauagugagacucuacaacauuuuuuuuuuuuuaauuugcugugcauggugguacacacuuguauucccagcuacuugggaggcugaagugggaggauggucugagccccagaggaccagacugcagugagcuaucaucacaccacuauaucuagccugggugacagaguaagacccugucucaaaaaaagaauuguuuauaguuugagauagaaguuucauuuugcccugaaguaaaggcauacucacuuuaauguuguauuuauagagccgcuaaaucucggauuuucuguuuacucuuuaacugauuugauugaucaguugaauuauuggagggucagccagaguguuguucacccagagcaauauuuuacaaguggugcacacagaaagcuaauaaacaugagagugugcuguucauacaaauuagacaguacagcaggauacaguauuaaaguucacuuucacaccaaucuuaccagcccaccccauuccugucucuucucccaugaaccuugagguuaccacuguuuacacauggguauuugucuuugcacaccauuuaugugcauguuauauuuuauacaaauaaaaacaagcuggggagauuguuuaauuuuguuuugcuuuuuauguaaaugagaucuugacguuguuuugaaccuugcuuuuuuuguucacuugacauaucuuggugaauuuuccauuucacugcagauagaugcaucucguucuuuuuuuuuuuuuacauucuuuuuuuugaggaagggucucgcucugucacugaagugcaguggugagaucucagcucacugcagccucugccucccggguuccaguacuucucgugccucagccuccugaguagcugggacuacaggcgugugccaccacacccagcuaaguuuuguauuuuuaguagagacaggguuucaccguauuucccaggguggucucgaacuccugaccucaagugauccucccgccucggccucccaaagugcugggauuacaggcaugagccaccaugccuggcugcuuuuuuuauuuuuuuugagauaggaucucugucacccacgcuggagugcagugguacaaucucagcuaacugcaaccuccaccugguggguucaagcuauccucccaccucagccuccugaguagcugagacuacagguguaugccaccaugcccagcuaauuuuuguauuuuuaguagagacaguguuucgcuaucacccaggcuugucuuaaacucccggaugcaagugauccgccugcauuagccucccaaagucuugggauuacaggcgugaaccaccacccccggccucaugucauucuuuuuuuuuuuuuuuuuuuuuuuugagacggagucucacucuguagcccaggcuggaguguagaggugcuaucucggcucacugcaagcucugccuccuggguucacgccauucuccugccacagccucccaaguagcugggacuacaggcacccaccaccacgcccggcuaauuuuuuguauuuguaguagagacgggguuuuaccguguuagccaggaugaucucgaucuccugaccuugugauccacccgccucggccucccagugugcugggauuacaagcaugagccacugcgcccggcccauucuuuuuaaccuuuguguauuuuuccauaaucgagauuuaauauauuuuaccaauucucuguuuuuauuuguuuuccgauuuuuuaaucauugugaacugucaucauugaacaucuuaauacaaguaucuuugucuguaaauguggguauuuugaugggauugaaugaaacaauguugagaaacauagccaaguucuaacauugauaggaauagaguaauaaguaccaucuucuacccauuucucuauggguuucauggucuugcuuucacauugcuucuucugauggauuuuccuaagucuuaaccuucacgucaucaguaacaguaccuuauuugagacuggggcacuugggaaugacugccccccaacccccgcccccauuaucuccuuagguacuuuucuguuugucuuacuguguugucguauuuacucuagaacacuuuccacucucuacugauauguccuccucugccauuucaggaccucccacccucccccacugagcugccuucccagugaugaaagaaaaaauguaaaagccugaaaacccuucuucuugauuuuuaauuuuuuuuuuucccucuaagaccuuaaccacucuggauaguaucacgggguaucaguagagugugcuaaacagauguguacucugcagcuucuuugcagguuuuuugucacauuuuucagucaaguguuccagcuuugugcuuguucauuagagucaccugugacuacagagauucugaaaguuugaaucagggccugggaaucuguacuuugaacaguacuacaggugguauuuaugccuaggcaaguaugggaaacaacugugcagaaggauaaagacguucuuaucuaugacuagaccaucugaaugauuuggccuuugaaggugacucaagguugagccuggauguuggagacuuggugcuauagaccaaggaagcugccaaguauuucgcugguuccuaaucucaugaacaucagaaucaccugaaaaacauuuaaagcuacgaaugucugaauucagcuucagagacucuaaaucaauaggagaaacuuaaagcuuccuagaugauucuaauaaccagccauguuugaagaccagaccaccaaugcguacaagaaguaaaggauuuggagucaacauuuaaaccuugguucuuucacuuuuaauucuuaugaacuugggcaaaaggauuaaaauucuacuuugguaucuuuugaaagaaaacagaaaguggacauuuuaacuauaaguuucuuaucagccuacaaucagaugaaggaaacugguaaaaauuucucacuguaauaauugaagagucugauauuccaccauacuuauuuuauggaugaaguaauauuugggauaauauaaaagacuugcauagauauguauaucaaauuaauaguuuaacucggaugugagcuuuuaauuucuuauuuaguuauuaagcauacugccuccugaauuaacugcuuuucauuuucuucaagaucuaauuaucauggaccugcgacaguuucuuaugugccugucccugugcacagccuuugccuugagcaaacccacagaaaagaaggaccguguacaucaugagccucagcucagugacaagguucacaaugaugcucagaguuuugauuaugaccaugaugccuucuugggugcugaagaagcaaagaccuuugaucagcugacaccagaagagagcaaggaaaggcuuggguaagguaccaccucucaggggucuaguguggguaaugacauucuuuauaaaggcuaauucuuuucuuuucuggcucaguuaugaguaaaguuauauugaacuauuaauacaucuucugaaagcuaaccauggaauuacuaccucuaaaauuucauuaaaugccugauuucauacauuuuuaauugaauaacaguuggugccucauucuacaaagcaucauuuuugcauaaaaguaccaaguacugcaagacccaacuugaacugcauuaucuugcuaccagaagaacauagcauggggggauuucucaucucuucucaucucuacugcuuuuaauuuuuaaaaacuaucugugcccuacugaccuggcacaagccaagucuuugaugggcuaauaaacggcacauuggaucccuauaaaguuuaugauuucccgagguguccuucacccucuuuauuuucauucucagauauuuguuuaauuaaaaaacaaaaaucaaaccaacuuugucuuuuagaaaauuguaacuuaaugucugaguaugaguuacuguuucaguaacagcagggccauagucagguucuuuggcucucucgguagacaucuuuuguccugaaaaauggauuugguagaaucccaguugauuauuucuaauuggggaucugagaaugucuuuuuugguccuuccaaagccuuccuuuugaagaaaaugcaggucaauuuuguaaaaauauucuucucagugagcacuguuggugcaacuuccugauuguauucaagagauuuguguggaaaguugugccacacauagcaauuucuaaaaauauuuugccuugauggguagcauuuugaucauaagacguuguaggauuugcuuuggaagaugcugcagaauagauguauuuuuucauuggguuaucuacugacugaaggguacaauguuuuauuuuucaacauugacagaaauaauaaagauauuuugcuauguagaaugagcacugucacauagcauuugaaaguagauagauaugcaucacagaguuaguuuucuauuagguugcuuuccuuugggagaccauccucacuuucaguuuuaaucuaauaacuguacuaacauuccaggcugaaaauagaaaugcagaucagguacgguggcucacgccuguaaucccagcaccuugggaggcugaggcgguuggaucacgaggucaggagaucgagaccauccuggcuaacacugugaaaccccaucucuacuaaaaauacaaaaaaaauuagccgggcgugguggcgcgugccuguagucccagcuacuugggaggcugaggcaggagaauggcgugaacccgggagguggagcuuguagugagccgagaucacgccacugcacuccagccugggcaacagagccaucucaaaaaaaaaaaaaaaaaaaagaaaauagaaaugcagaggguauucuaagucuucaugucaugcccauuaauauugugcacguccaacccacauuuuggucugcacauauuuuuucacagaauuaacucuaaaauaaugaaaggcccuuagguuugguaucauuuaggguagaugguacuauaaugaggauguucuggcuccuugcagguagggagaaagcucugcuggcacuuuucaguugaaaguauuccuuuuugugaucaguggauauuaaaaguuugucacauaugcagauucuguauuugauuagaauaagaugauaaaaucauguuuuuuauggaauguaugaauagacuguuugcuucucccaaauuuuguugguaaugacaaauaucccuacuuuauacaguaacauacgguugggagcaagaaucccacaugaaacuuuuaaaaaacuuauuuacuguggcauuucaaaacauuguuuuggugggguaauguauaccagcugggaacaacagguucccucuuuuuuccaucugucuauauggcacauaauuauuaagagauaagucauuguucaugccuuuaguugcaaaaauucacgacuuuuugaaaucuuuaauaauaauagcuaaaagaacacaggaagcauuuuaaaacaauucaauauacaaguuucagguauuuuuucuuauuaagaauguugacaaauaggcgauuuuauguauccuuaaaaugaagauuuguuuugagguagugguucuuaauauuaaaaaaguucucuggcugggcgcaauggcucaugccuguaaucccagcacuuugggaggccgaggcaggcaguuuaugaggucaagagaucaagaccauccuggccaauauggugaaaucccaucucuacuaaaaauacaaacauuagcugggccugguggcgcgugccuguagucccagcuacuugggaggcugaggcaggagaauugcuugaaccugggaggcagagguugcagugagccaagaucgcaccacugcacuccagccuggcaacaaagugagacuccgucucaaaaaaaaaaaaaaaaaaauuccuugauauauuuacuauagaagugaacuagagcaguucauuauccuuuuggggaucacaggcccagacccuuugggagucuaaugaaagcuaaggacuuuuccucagaaaagugcacacuuacauauacaauuuugggcuaggcgcaauggcucauggcuguaaucccagcacuuugagaggcugaagcaggaggauugcuugagcucaggaguucgagaccagccugggcaauauagggagacccucucucuacaacaaauuaaaaaaucagcuaggcaugguggcaugugccuguagucccagcuacuaaggagguugagaugagaggaucccuucagccgggaagggcaaggcuacagugagcuguaauuguaccacugcccuccagccugggugacagagcaagacccuaucucaaaaaauaauaauaacaaaauaagaaaauuuugcacacugaaaauuucaggaauauuagucacccuucuggagcccauuuauugauccaaauucuuaaacaacugaaggguuugcuuuaugcuccuugaaauguagagguaugugcuaccuccuaaaagaaauaacaugaggugcacuaaugcacugugucuguccuagaauaaaggcuuauuuaguggcguccauaggguucuccccugucacaggacuaugacaccauuagcuucauaaauuuacacaggcauuuaaagaugauaauuuagagccuuaugccuaaaauaggaugugcccacuuccaguguacuuacacaacugccugcaggcuuggugcucagcaagauaagaauggcuuuuacauuuucagaggcuuguuaaaaaaaaaauacacacacacacacaccauaccauauguugcccacaaagucaaaaauauuuacuaucugucccuuuuuuaaaaaagaaguuugccuuguaaacuauauuucuguuuaaguaaaaaacaauaaauuuuuuucuuaaguuugccaaccccuagguuaaaccauuugaguuguuugcauugaauagaaugcucuucagucaacuuaauuaagaaaagcccaccuugaacagucauaugucuuuuuuuaucugggcgauccuucucuucaggcuauuuauaauaguuuaaaaauaccuuuuggggguaggagggguucugguugcccuuuuuccuugcccuuuauuucugaacuguacaguggcacuauugguagccaguaccauuugagcacaaacugcauuccauuauaaauaauguagaacuuuucaauauugguauagcuucaucugugaauaguguuaaaauucuacaggacuaaaguuacaacaacaaaaauuguccuuaugucuauguagauagaagaggauauuuaagagauaacuacuuuuuuuucugagacgaagucuugcucugucaccugggcuggagugcaguggcgcgaucucaacucauugcaaccgccgccucccagguucaagagauucuccugccucagccuccugaauagcugagauuacaggcaugcgccaccaugcccggcuaauuuuuguguuuuuaguagagacuggguuucaccauguuggccaggcuggucucgaauuccucaccucccgccaggugaucugcccgccucggccucccaaagugcugagauuauaggcgugagccaccguaccaggccagagauaacuucuuacugguuuaccuuuccuguuaacauuuuagagcaagauuacacauucucugaaggaaaaugcuaguuacuuacaggauuuaaguaauaguuguaucuaacaccugaucuguaucaaaaugagucucuuuucuuagagucacuaguacuuuucaauucugaucacuuuccuauguuguauucaugaaaugaacacaagcuggggaaagacauuauuugcuaccaagugacaaucuuuucaauccugcaaauaauagagcauaggacuauaccaagauuucucuucuguuggaaguuuugacuucaacuucauauuccaaacugggcugcuuacuugggugacauuacauaggaugacuuugccccuauaguuaagugauugcaccuuuaaacagaaguuuucauaucauggacauauuuuuaaauccauaagaugacagaucuggaagaaagacacuuauaaagcuucauaaagccacugauucuuuagcuuugugguuuugcuuuauaaucuacauacuaacccuuucagcuuauuaacauucuuauaaucagauauacauucuuaccacaucauuuccucagaguucucuguuuucauguaaaaauccaauucaacacaguauuuaaaagcugcuagccauuuuuuagacaagcaucuuccugucuuuuuaucuguuuuuuaaaaauaaucuugccuugagauauaaaugaucccagaacuuuucugauaucuuuguauuuuuaucaaaaguguuacuuuuucuaaaaucagcuaaauuuuugaagucugauguaacuauuuugaauuuuuagaaaaccaugauuauuuaccaagaauuggaguuucucuucuguaagcaauaaagaaaaauaaaguucagccacaucuucgcuagagaaaauaaaaaugaaaacaaggaaaaacaaaguuuuacauguuguuugaugcaaagaguggagaacuuggauaggaauggauauucacuccugaauucuaaccauaggcugaaaucuaccuccaaagagauaggcugaguuugcuuuuggauccaagugcaccagccaugacuguguugaccuuauucacguggcuuauuacagaccaguaauggaccauuuuuuucaguugcuggccuggcaguuuuguuuuggagacaauuuuuuauuucugugcauuagcccugggcacacaccuggcuaaguccagaguucugugucuuuuuaaccuuuugcuggauuucucugcauuuucuacagaaagauuguaaguaaaauagauggcgacaaggacggguuugucacuguggaugagcucaaagacuggauuaaauuugcacaaaagcgcuggauuuacgaggauguagagcgacaguggaaggggcaugaccucaaugaggacggccucguuuccugggaggaguauaaaaaugccaccuacggcuacguuuuagguaggucccuacugucugggggaaaaagccuuguggagcuggcaccuugaaacguaacuguuuugucuuguagaaugauuguagauaaaauagacgcggauaaagauggguuugugacggagggggagcugaaauccuggauuaagcacgcccagaagaaauacauauaugacaauguugaaaaccaauggcaggaguuugauaugaaucaagacggcuuaaucuccugggaugaguacagaaacgugacuuauggcacuuaccuggguaaggggcaagaugucagccuggcagggaccguggucuugagucaaagaaacaaaugggucacacaguaaaggaaaggaagcuuaucuuaaauaguucaauucagugcuaagcugauucccuuuauuaauuuuaaauuuguauauuauguauuuuuaaauuuguuuaauuuuuguuuucugaagucuggaagucugguaucuucuacauuuuuagcauuuuacauauauuuuaccauuuuuucuuuaugucaucccucauagagacaauuuuuggaguagauuucauuuaaaagaauacauugggcugggugccgauagcucacgccuauaagcacuuugggaugcugaggcaggaggauugccugggcccaggaguuugagaccaaucugggcaacauagggacacccugucucuaccaaaaaaaaaaaaaaaaauuuaaauuagccaagcaugguggcacacaccuguccuagauacucaggaggcuaaggugggaggaucacuuaagcccaggagguugaggcagcugcgagccaugauugcacugcugcacaccagccuuggggacagagcgagcucuguccaaaaaaaaaaaaaaaaaaaaaaaagaggcuaugaggcuacauacuuccaacagugcaaagcaaggggcuuugagauguuucuugacauggucccaguaaaguguuggaccuaaaauucaaaccaaauuagauuucuuuauaacuggugagaagucuuaauaaaauaguuuuccuuaauaaaauuuaacuauuucaguaugucugcuuacugaaguuuggaaaugaaaauuucccauuuguuuucucuggcacaugaguuuaucagccugcuuugcaagugcuuuaaggcaaauaaauguuaauuugauugcuuuuuguugauuugauagcuuguaugcuugggccaccuguuaguaauuuucuuuuacuuguaacacuugccugcugcugaauacuaggcagugagucuuauugaguugaugauccaggguguuuuuauuugugaaauuccucuguuguacaugguuacaguuuaagacaagaauuguauuaauauaaaugaauauaaaugguacuuucuccauuuuaauccuggaaauuaggcaaccuucuggguuaaagcaagcguucuccgccacugacuaacagugaguguauaauggaucuguuuccccacagauagccagcugucugcauuaauuacaggacugcaugcauuucuggugaagagacuuuuauuucugugucaggcuuguucucauuccuaagacuaaaguggcacucucucucaaugcuugacacuuagccaagaaccaaacauauccuucacccaauuaagaacacauguauuaaacagucagcacagauggagaggcauccugcuucuugcucuggcugagacccaacaccuuccugauuuauuuggaauuaaugauaaauacaaagcaaagaguaggcuauuggugaucuaaacaaaaugguguguaaauaaaucucagcuccgaccuaggcacucacuugcugcccagaaugauucuucggugcuguguaugauuaugugcauaaaaaucuguugagagcucuguugccucacaaggcagaugauucaacguaauggguauuucugcugccugagacugcauaagcugaagcacuggcugggaagcaaugucuuuauaaggcaucuuuccccagaggcaugaggguggacagcacugagggggucaugagucggcuuagagaagugaggaguuuuuguuacuguguguucuugauucaauuuggaguucagguauaaaucaucauagcucuuaguuaaaaucugucucaaugaauccgcuauccaugagagaaagguuaacacugucucugccacaaggaaaauaugaaauacugagaucuacccugccuauagcaaaacuagaucaagagccuaccuaaagcuguauacaggccagcuagggccaaaacuggugcuuaggauaaauacagcauuccaagcagagcuauaggaaaauagguuuugucauuaaaaauaaaguuuuggacaggcacaguggcuuaugccuauaauccuagcauuuugggaggccgaggcagaaagguugcuugaguccgggaauucgcgaccagccagggcaacaaagccagaccccgucuuuacaaaaaaaauauuaaaaauuagccaggagugguaauacuugucaguaguccuagcuacuugggaggccgaagcaggaggauugcuugagccccagaguccaagacugcauugagcuaugauugcauugcacuccagccugggccacacagaacaaggaccugacuauaaauuaaaaaaaaaaaaaauuguaucuuccuguuucccuccuuauauauauaugugcauguugcuauuaggcuauuugaguccagucaccauuuuuaccuuuuaccccaaggaggggaggagagcacuuauguaagaaucuagucuuaaaguauaaguugucuuguuauguuucuuauuuauguuacauaguccugaaaccuuguuuagaagagacacuuuaguaucugagaaaggcuuguuugccuuacguucuccaucucaaccuauuauggcuuugaguguguguguguguguguguguguguguguguguacacaggaucccaaagccuuaugacucguuaagcugucugacugaauuuuugacacucaauaaaaaaugaagcuucaaaaugcucaacucucaaaauaguacaguaguuuuguuuuuguuucuuuaaacugugcuuaaaguauggaaagacugaacaaucucaaaggucagcaguaaugauguuauucuuaaaggggcccugugggucuuuuuuauaaaagcagugucauauccuuuuuauguaaucaauauguugcaggaacaauaauuucuuaccauuaauguggugucuuuuacuuuuuaaaauaucuucaugucuguuaucuuaauuugguuuauacaggaacgcagauugaaaaagaauuuuauuuucugcaguuaacgccacauuuuuucagcuuaaaaaacuaaauuucacuuuucuauauucuuauauagagacuagauaacugcugcuuguguagcucgaugucauaacagauggguaguuccaaauucaauuugguuguaaucuaaggguuuuuuuuuuuguauaccuuugucaaguuauuauugacauaaagugaacuguauguauuuaagugcauaauugaugaguuuugacguauguauuuaccagugaaaccaccacugcaaucacgauaaugagcauauccauuacccccccaacauuuccucaugucccuugguaauccuucucauucucgccauucccccgucccuaggcaaucacucaucuguuuucugugacucuaaguuaguuugcauuuucuagaauuuuacguaaauggggaugaacaauaccugucacucuugguagauuucugcguugacugaaaaaaaacagaaugugaccuucaaagugguggcauucuauugcuugaauccaaguguccauuaugugagguagaaggccuuugauuucuaucuuuuuaaugagauccuaauguuuaauaaaaguagcaauaacugacauuuguugaaagccaacuaugugccaggcauuguucuaagcacuuagauauauuuucucauuuaaaccuuacaacaauccuaugaagccggcaccauugcuagcuccauuuuacagauaaaagagaccaagacacaggccaaacagcuagaaaaugguagaguucaaacucaggcaguaugggacuugagagccaccacugccuuccagauguaacuagaaaauucaagccuucuaguagccuuaauaccaauagugaagcauaacagugaguuacauaguucaggagccagaguuccaugugaacuuggagcugacucugagaucugaugccuggagcuguagcccaaaacuaaaugucuuuguacugcugcaguuuuaccugugucaucaauuauuucuuccuugcaugguuuuaucuuuauuggaaauugauuucccaccccacacauuuucauguuuucugaaagucuuuuaagauuugaccuaaauuuuuguuuucuagaugauccagauccugaugauggauuuaacuauaaacagaugaugguuagagaugagcggagguuuaaaauggcagacaaggauggagaccucauugccaccaaggaggaguucacagcuuuccugcacccugaggaguaugacuacaugaaagauauaguaguacaggugggugagaugaaggauucugaacagggacucaguuucucuuuuuguggcuuauucugucuuuccccuuuagccuuauauagcauaucuuauauauauauaugcuauauagcauaucacuguauaugcuauauaaguauuggccagauucagaauccaaggucugucacuguuuuucugugaccuugaucaaggugccuugggcauucuguuuaguaugauaauaccuucugucauauaauguauuuugccauuucauugguagcuucauauuguaagaauggggggaaaucccauuauuuaaaauaucccaugaccaauagucagacauugaguaauaacagugauacuaaagaacucucacagaaggcaguuacugacaacauagacuaucuauagcuaaacacauaaucacuggucacaucuccuguuagugugacuuuagcaugacuaaggcuaccagguagaucaucaugggcuugaugggauaguuugucauuaagcagugucaguguucugucaggaagacucaguuauuuuagauugaagcauaggaaauugcucauguuuuaccauuucuuggcuagaaaugguuuuaaccauacagacacacaugcauacauacauacauacauacauacauguacaaguguguuuaaugaauaauaaauguuuaccuaaacuagauacuuuacuuucuucuggcaaauucagagaccaacuuaauagucucuucuuauucuuuccuguuuaggaaacaauggaagauauagauaagaaugcugaugguuucauugaucuagaagaguauauugguaagucucugcuuuuaguguuuuucuuagaaaagcugagaagcuuugaaagguguauuugcuggcugggcacaguggcucaugccuguaaucccaacacugggaggccgaggcgggcagaucaccugaggucaggaguccaaguccagccuggccaacauggggaaaccccgucucuacuaaaaauacaaaaaaauuaguugggugugguggcgggcgccuguaaucccagcuacucaggaggcugaggcagaagaaucgcuugaacccaggaggcggagguugcagugagccgagaacacgccauugcacuccagccugggcaacaagagugaaacugucucaaaaaaagaaagaaagaaagauguauuugcccauagaaacaauuuacuccaagggucaauucucacuagcucauuagcugucaccagaucauuaaccagaccagugugauaguggguugugauaaaguauccguagccacauugcccaaucaaaauauaaaugugagccccauauguaauuuuaacuuuucuaauagccacauuaaaaaguaaaaagaaacagaugaaauuucaguaguuauuuaaccuaauauucuaaaacucuauaauuuccacuuaauguaaauuauugaggguuuuuuuuuaauacuuaaagcacaucccagccacauuucaagugcuuaauaagcaccuguggcuaccauccucaacagcacagauauaguguauccugcaugcucuauggaacugaugguaaagaguugcagggggcugggcacgguggcucacgccuguaaucccagcacuuugggaggccgaggcgggcggaucacaaggucaggagaucgagaccauccuggcuaacacagugaaacccugucucuacuaaaaauacaaaaaauuagccggguguaguggcaggcgccuguagucccagcuacuggggacgcugaggcaggagaauggcaugaacccaggaggcagagcuugcaguaagcugagaucaugccacugcacuccagccggggcuacagagcgagacuccgucucaaacaaacaaacaaaaaaaagaguugcagggagcccagacugacauagggaaacccagggaaaggagauagggaauagauuaaaagauggauaaauaaaugacggggaguugcugaucccucuuguagccauuccuuuuuacuguguucuguucauauuuucucucugauucucugacuacuuuccuuuuguuuuuuaaguuucucccuuuugacauuucccuuuuuaguugucuaaauuuuuuuaaaaaaauuguuuuggaugucacaccuucaaggcuaauuucucccaaguaaagcucuguuuuauuaucaucagacuaauuuuaagauauucucauugcuuuaaaaaaaaaaagcugucuuucuuaccaaguaguugagcaaauuguuucccaauuacugugacagaaauuaaaaugaguaaaggagcugggugugguggcauacccgguuacuugggaggcugaggcaggaggaucacuugaguccaagagucuggacuauagucacaaguucaucaucaauauggugaccuccugggagcagaggaucaccagguugccuaaggaggagugaaccggcccgggacagaaucagagcaggucaaaacugugcugauuaguagugagguugugccuguggauagcaauuguacuccaaccugagcaacauagcgagacuccaucucuuuagaaaagugaguaaagauggaaaguauaagacuguuacuacaaaugucauuguuacaaauacuuuguuuagaaagauauuagauauuuuaauauuucacauacuuauugucauuuguaauaacuuauucuagcacaccauugguuuuguguuucagauaagcccguuuguuuuuagaccucugauaguuaccugaaauguuuauuugaagccugaaaggaagacuuaauccuuaccucuaucaccugucauuaaacuguauggagcaagucacugcuuuacuuagauguugucuuaucauaccuguuguuuacaugcuagaguuauuccaauugaauuacuccuugacuguuuaccucccuuuucuuagguucaguggcauacuuugaacuuuuuaaagaaggaugagcaauggaagauaggauggauguuuuccuaaacugauuuuuuuuuuuuuuggagaaguuuaucaggacaguggauaagugccuaggugcauuuacugagcccacguugauguuacuaggguuuucuacuuuuaaaugauuuaucuuuuuauucuuggcuuuugccauuuuauugccauugcuaaaacugaggaacucauuugaaccucccaaggagaggaauuuuuauaacuguuaacuacaucacuuaucaagcauugaggccaaauaaggagauauuucugucucccuguguaucauauagauucaagggcagaggaguuauauuuugaagcuaccaaaacuaucuugugcaugugugcuuuuuuuuuuuuuuuuuacaagucaguaacuaaugcaaacacuuuuacaucugggaugcugggcuuuguaaaucuaaaauucucccaaacaguaucuuucagcuucuagugcccuguugaaggagaucaugaagaaacaaaguucuucgccucauaaauuuagcauuaaaaagaagccccaucagugccuguggaaacauagggaaagaaaaaaaaaaacacccaaaguugugcugauaauuauuuuuauuuuuaaaauuuauuauagagcauugcagacguacacaacuuauuuguuuauuuauuuauguuuuuuuugagacagucuugcucugucacccaggcuggagugcaguggcgugaucuccacucacuacaaucucugccucccagguucaggcgauucuugugccucagccuccugaguaguugggauuacaggcaugcaccaccacaccuggcuaauuuuuguauuuuuaauagaggcgggguuucaccauguuggccagggugaucuugaacuccuggccucaagugaucugaccaccuuagccucccaaagugcugggauuacaagugugagccacugcaccugcccccaaauuagaauaguauaaugaauccccauguaccuaugccuaaccucaacaacaaucaacuuacagccaguuuuuucucagccacauccacuuccuugcuuccuucuuacuuugaaguaaaucccaaucauuaugucauuucaucuguaaacauugagguauauaugucuaaaauauauauguguuucuaaaaacauuuuuuuaaagauaaugucaacccaagaaaauuaauaauaccuucaaaucaucaaauagacugagucuuuuaaaaauagaaauucggccgagcaugguggcucaugccuguaaucccaacacuuugggaggcugaggugggcggaucacaaggucaggaguuagacaccagccugaccaaccuggugaaaccccgucucuacuaaaaauauaaaaauuagccaggugugguggcaugugccuguguaaucccagcuacucaggaggcugaggcaggagaaucgcuugaacccaggaggcggagguugcagugagccgagaucgcgccacugcacuccagccugggcgacagagcaagacucugucucaaaaaaauaaaguaaaauaaauaaaaauagaaauucaaauaguuuaucauggucaccuagcuuuaaaaugcgcuuacguuguaguguauuguguauucuagcuuccuuuaaaaccauaucuuuuaagcaugugucuauuuccuaauucagaacuuuccaaucuguauccugugaguaagucuucuuggcuuucaggacagcuagggcaggaaccugauccaguggaccguacaaacuacauuuucugaaugugcuguagcaugggaaaaaauuggcaaguccugcugugaggaauuucucuugugaguuuaagacagaggaguacuucuacccuuaacccucaaggucaggaaaauggcagcacugacuaaauaauuaccuuugcuuagaacuugcaggaacuauuuagauuucucuuuagguguuuucccauaccuuacaugcaaugcagguacacuuaacuuagaugucguauaacucaagcauuuucagacuuguucacuuaaauaacuccugaaagaauuugaccaacagcauucccuuauguguuuuaaaguuggcaucugaaauauuuaauuaagaaauuuaaacaguuguaaagaauagucucuguugggccggaugccguagcucauuccuguaaucccagaacuuugggaggcugaggcaggugaaucacuugagcccaggaguuugagaacaaccuggacaacauggcgcaacccugucucuacaaaaaauacaaaaaaaaagaaaaaauuagccaggcaugguggcgugugccuguagucccagcaacucaggaggaucacuugagccugaggguuugagguugcagugcaccguuauuguaccacugcacuccagccugggcaacagagcaagacccugucucagaagaaaaaagaauaaucucuguuggugauaagcauugacauuuugaaaguaauucggaaagaaaucuauaaaauuuaaauacaagauaccauagcaacuucuuaccugccgucuuucauaugaauaauuuggacacgacaacuuuaaaaagauaaucaagaaauuuaaauucagucuggguauuagaugauaccaaggaauugauuuuguaaaauaugaaaguggcauuguggguauauaagaaaauauccguaauuuuuuacauuucauaauaguuaaaaaggaaauguuucuuugguacuuuuuuuuuuuuaguuauggcguuugguuagcaacaaugugaccaucacuuaauugcccuuuuuuuuguuuaaauuuauagggauuuggggauauuuauacuacuuaucagucaccacaugauauugucuuaaaaaaauaaaugaauaaacuguuaaccaacuuggacauuuuacacgcauccuguuucuucuucuucuucuuuuuuaaaaagacaagagucucauucuguugcccauguuggugugcaguggcacaaucacagcagccucgaucuccaagguggggagaucaagugauccucucaccucagcugggaccacagaagagcaccaccacacccagcugauuuuuuuuauuauuauucuuauagacaugggucucccuacauugcccaggcuggucuggaaauccugggcucaagagcucuaccugccuuggccucccaaagugcugggauuacagacaucagccacccgaccuccuguuucuuuuuuuucuuuuucuuuuugagacagggucucacucugucaccuaggcuggagugcaguggcaugaucaugguucauugcagccucgaucugcuaggcucaagccauccuccugccucagccucccgaguagcugggacuguaggugcaugcugccaugccuggcuaauuuuuguauuucuuguagggauuuugccauguuguccaggcugaucucaaacucacaagucagccuucuauuuguuagauucauuugcaguuuacuuccucaacagaauuauauucugacauauuuuaucuugaagccuuagucacuuugacauucuuauuugcaagaacauuguguauguaaauugaaauauggaaaaugguguucugugauauggcucuuaaguguuuuuagagucuucuguguuaaguuacuauuacaauuauuaauacacaauugaacaaaauaacauuuauuacagacguuuuauguuuauauauuuuuaaaugcauuucuuugacacauuuuuauucaaauaguuucauauccauggaugacaauuacuuaucccuagagugaaaugggauucagcaccaauuccuaauuuuuauuuuuuagaggaaguacuaacagaccuuguuuacauuaguaaauaaguugauggaagauuugucauagcaauauugcuuaguucuuggaacuccuuuugaguuacaugccagaaaucauguaaucuaucaucaaaaauuauggguuuuguuuguuucaagguggagucucucucucucacccaggcuguaguacacaggcacggucucggcucauugcaaccucugccucugggguucaagcgauucuccugccucagccuccccaguagcuggagauuacaggugugggccagcacgcccggcuaauuuuauuuuuuauuuuuaguagagacgggguuucaccauguuggccaugcuggucucaaacuccugaccucaagugauccacccgccucagccucccaaagugcugggauuacaggcaugagccacugcacccagcccaaaaauuauguuuaaugaucccuuagcuaaaacucaauuaggccauuuuucaagguuuuuuuuuuuaaagcaaagaauuuaaaaccuuuugacaugcaaacgaauuuauucauuuuuuuucaggcauuugcauucucaagacugacacuaguauuucuuuuucuuuuuuuuuuuuuuuuuuuuugagacggagucuugcucugucgcccaggcuagagugcagugauaugaucucggcucacugcaaccucugccuccuggguucaagugauucuuuugccucagccucucgaguagcugggauuacaggcacgcaccaccaugcucagcuaauuuuuguauuuuuaguagagaugggguuuugccauuuuggccaggcuggucucaaauuccugaccucaggugaucuggucucaaacuccgaccucaggugaucugccugccuaggccucccaaagugcuggaauuacaggugugagccaccacgcccauccagacacuaguauuucuaauuguuucuuuuucauuaucuuggagcuuuuuacacucuaguuucaaaaugguugaaaauaugccuuucuuuuauaaagugggacaagggcaguugugaaaggggggagaugggaaaaaagccuugauggccagagguacauucuuaugaagaucaauuuuuggaaaaaucuauauguggaacugaguaucuggaauuugauucucucuugacugaccuuucucaguguacuccuugacaguguuccuguuuccccaggggcgugcuugucccaacugaaggccacugguauaauggacucuuuguaguaauuggcuacaccuuucuaaaacaaguggucccguuuaauuagcuaccuuagggugaaaugaaauguagggaacgagucuaagucuuucuugaugguagcucucuccucuuauuucugcauuuauuaagguauaagaacucuuugcucucaugugacuuaaaaucagcagcuggaaauauucuuguugcaagauaagugauuaagccucaggaaaauaccuugcuuucuaaggucugucuggccuaaaauacccuuguagcugcuguuggguuccaaacaaauggaugaggaaaaaggguuaggccagauuagcaugaggcaguuuuggggaaaagacaaacccuucuuuuguauguaugucuguguacccaggugacauguacagccaugaugggaauacugaugagccagaauggguaaagacagagcgagagcaguuuguugaguuucgggauaagaaccgugaugggaagauggacaaggaagagaccaaagacuggauccuucccucagacuaugaucaugcagaggcagaagccaggcaccuggucuaugaaucagaccaaaacaagguaagucuggcgaggcccacacgcucuauccuugauugaaguaugcuucuaggggaucaccugaacaguuucuguuaaggugcauagagcauuuaaggucuuaauuagucuaagucagccaaguaucugaaucuggcgauuaaaaccuuucagggcagcacuagcuaucugaucucauuuuagaaauccuuuugcccagugcugauagcauuguaggaaauuuggcuucagaaaagagccuuuguguguagccugugcccagcaugcaucaucagguauuuuuagauccccaggaauuuuuuuuuuucuuuguuacuucauuuguuccuuuaccuauuacaggcccauucugucuacucaaagcugguuguuuccuucuuaaaucaaauaggcuuuuuuaaauuggguccuuuguaugggcuauaaaucagcuuuucucuggagccuguucaaauuguccuugaucaauuaauuaucugagguauuuuguuaaaaguauuguugucccuaagcccagucaccugcuucagagauuacuccugcccugcuuggaguaagcugaaaaucggucuaaagauggagauuuucaguguucugaguauauuuuugucuaagcuaaucuucaauuucaaauucaguuuuuuauuuuagagccuuuuuaaguguugaucugcuuuaaguucuugcucaaagucacuuuaguagccagguguuguguccugagauguaugagaaaaggaaaugcauguagucaucccuaucuaggagauguuccauauuuuccucuaaaaggagaguuuucuccucaugaaacaaaccuuuaucucuagcauugaguuguuguguuauauucuuuccacccuuccacuuuuaacuuucuugauaaaagaaauguuuaauuggccuggcacgauggcucacgccuguaaucccagcacuuugggaggccaaggcaggcggaucaccugagauuggguguucaagaccagccugacaaacauggagaaaccccaucucuacuaaaaauacaaaauuaccugggcgugguggcgcaugccuguaaucccagcuacucgggaggcugaggcagaaaaaucacuuaaaucacuuuaacacgggaggcggagguugcggugagcugagaucgcgccauugcacuccagccugggcaacaagagcgaaacuccgucucaaaaaaaaaaaaaaaaaaaaacaaggaauguguaauugcuguuuucuucccucuucguauguauguagggggaaugagggcugaguaguucacacuuaauuuaguagaaaugagaaucuuaacuucugauuaaccccaauucuucuauaacaguguuucugaauuuuuaaugggaaauauguucuucuucaauucauugcuaucucuacuuucaggauggcaagcuuaccaaggaggagaucguugacaaguaugacuuauuuguuggcagccaggccacagauuuuggggaggccuuaguacggcaugaugaguucugagcuacggaggaacccucauuuccucaaaaguaauuuauuuuuacagcuucugguuucacaugaaauuguuugcgcuacugagacuguuacuacaaacuuuuuaagacaugaaaaggcguaaugaaaaccaucccguccccauuccuccuccucucugagggacuggagggaagccgugcuucugaggaacaacucuaauuaguacacuuguguuuguagauuuacacuuuguauuauguauuaacauggcguguuuauuuuuguauuuuucucugguugggaguaugauaugaaggaucaagauccucaacucacacauguagacaaacauuagcucuuuacucuuucucaaccccuuuuaugauuuuaauaauucucacuuaacuaauuuuguaagccugagaucaauaagaaauguucaggagagaggaaagaaaaaaaauauaugcuccacaauuuauauuuagagagagaacacuuagucuugccugucaaaaaguccaacauuucauagguaguaggggccacauauuacauucaguugcuauagguccagcaacugaaccugccauuaccugggcaaggaaagaucccuuugcucuaggaaagcuuggcccaaauugauuuucuucuuuuucccccuguaggacugacuguuggcuaauuuugucaagcacagcuguggugggaagaguuagggccagugucuugaaaaucaaucaaguagugaaugugaucucuuugcagagcuauagauagaaacagcuggaaaacuaaaggaaaaauacaaguguuuucggggcauacauuuuuuuucugggugugcaucuguugaaaugcucaagacuuaauuauuugccuuuugaaaucacuguaaaugcccccauccgguuccucuucuucccaggugugccaaggaauuaaucuugguuucacuacaauuaaaauucacuccuuuccaaucaugucauugaaagugccuuuaacgaaagaaauggucacugaaugggaauucucuuaagaaacccugagauuaaaaaaagacuauuuggauaacuuauaggaaagccuagaaccucccaguagaguggggauuuuuuucuucuucccuuucucuuuuggacaauaguuaaauuagcaguauuaguuaugaguuugguugcaguguucuuaucuugugggcugauuuccaaaaaccacaugcugcugaauuuaccagggauccucauaccucacaaugcaaaccacuuacuaccaggccuuuuucuguguccacuggagagcuugagcucacacucaaagaucagaggaccuacagagagggcucuuugguuugaggaccauggcuuaccuuuccugccuuugacccaucacaccccauuuccuccucuuucccucuccccgcugccaaaaaaaaaaaaaaaggaaacguuuaucaugaaucaacaggguuucaguccuuaucaaagagagauguggaaagagcuaaagaaaccacccuuuguucccaacuccacuuuacccauauuuuaugcaacacaaacacuguccuuuugggucccuuucuuacagauggaccucuugagaagaauuaucguauuccacguuuuuagcccucagguuaccaagauaaauauauguauauauaaccuuuauuauugcuauaucuuuguggauaauacauucagguggugcugggugauuuauuauaaucugaaccuagguauauccuuuggucuuccacagucauguugaggugggcucccugguaugguaaaaagccagguauaauguaacuucaccccagccuuuguacuaagcucuugauaguggauauacucuuuuaaguuuagccccaauauaggguaauggaaauuuccugcccucuggguuccccauuuuuacuauuaagaagaccagugauaauuuaauaaugccaccaacucuggcuuaguuaagugagagugugaacuguguggcaagagagccucacaccucacuaggugcagagagcccaggccuuauguuaaaaucaugcacuugaaaagcaaaccuuaaucugcaaagacagcagcaagcauuauacggucaucuugaaugaucccuuugaaauuuuuuuuuuguuuguuuguuuaaaucaagccugaggcuggugaacaguagcuacacacccauauuguguguucugugaaugcuagcucucuugaauuuggauauugguuauuuuuuauagaguguaaaccaaguuuuauauucugcaaugcgaacagguaccuaucuguuucuaaauaaaacuguuuacauucauuaugggguauguaugaccuucauuuuccaagaaauagaacucuagcuuagaauuauggaugcucuaaaaugucagaaugggaacucuccucgaaguucucccaaacucagagacagcacugccuucuccuaaaugauuauucuuuucucccuguuuucugguauuuucuagcauccuucucaccacagccauaacccuuuuuuacuuccauuaggccguauaacuggagagaccugcugcucguuauauaauuaucugauaccaaacacaagcgauucugaauguacacacacguuuaucuauagagcauaagguaaaacaauuuuguuuaacauuuugguauuguuuacaaauguuauuaaaacaugcaaauucauuuugagaaccucgagagaauuaaacuauuaacuuuaguaaacacacaguuuaagacaaauauaaagguuuagccaaaugcaacggggaggaagcaccuggaauaauuugugcuugcucaggggcuuguggacauggcuguuccugccaaagcuguagcaguuauccaaaaguucuuucaaacucauauuuggggccacugaguuuuuuuuguuuuuuuuuuuguuuuguuuuguuuuuucuuuaugucucucccauuucuaaaguguuuucuuaaguuuguucuaauucagcauauaucaucucagaauggauccccagcaggaaaaaaaaaaaaaguuacuaaaaaggaaaguauccauacacugaaaacuuaaagcauauuccuuuuugguugccuuguauguagaaaucaguucuccaagugcugugaauggugccacuuaggaguagaaacugaugauuguugaaauggccuuuggguggucugaaauagaccaguggaaacaguagcuuuguaggcaagaaggcaauaguaagaaaaugaaaaauugacuccccaaacugccaucacuccuuuuaccaucuuuuuuguguuuuuaguaguuugguuucugacggagacaauagaaacuuacuuaaaaguaaaauuuaauucuagcuguugcaaacaggccaauauuggguccucaguuggggccaacuuggguagacgagacaguagaaacuucuguuuucugggagcug

SEQ ID NO: 14561 - RNA, 28979 nt, Homo sapiens
ccaacccucugcgacagccgcacuuuauuuggaguuuuccaccuaagcagcucccagcugagcugcaugacaugugcaaaaguccccuagaaagcugggccucgcaguguguaaaaaaggccccccauggggcagagccgugcaaccauuuuaaaaaaagagacagugagagagaaaucaggcccccugggagccuggcuuggguggagugcacaucgcucaggccgguccaugugccaggccacuccugcugguucgggggcuguuuucuucucugauugugcuuuccuuuccaaguccuuaaaacucugggguuguagccaccagagagaccagaccaaguccucggggucaggaggguaucuggccggcggugcaguuugagggugaccucacacacagacacccacaacacaaugcucccccacugcucagccccgccagaaacucagggcuucccuggccucgcagcccucgccagccccuugugucccagccucugccccugagccuggccccagucggcccucaugucacauucccagggagggacacuguccugacacagacaagguccuccaaccccuggggcgcggugggguggggaggcugggccuucacuucacccccaaggcagguguuuguagugucugauucugugcgugucuggguguggcacauuuguguguguguguguguguguguaauguguguguggcuggaggugggggcugaggcuggggaggcacuuuugggauucaagggaccuugacuuugaaggggcuuccagggacacuuucgucaccccacuugacaaugaggauguaguccccuuucuccuugacaguguaggugacauuguacacccgguuccccaugugcuucacguacaccuccucacagggggucuuggggccgugcacgcccaccaucaucauguuggugccuggagagggaggcagagggacaggcucacaccagggaguccccuacugugacccacacccugcucccugacggcuucuugcucacaccccgggagacgcccuccccccgccaccugccugcuuugcugcaguccacggugaaggaguucuucuggcccacgaaggccugggacagcccagggccccgagucaccaccuugcuggcaucugaggagaacuuggggauggagcuguagcuggagccccggcuugaggaggacuuggucacagucuccaccagaaccguggauguuucgugaaggcuguggccuccggacagccucggaccugagggguggguggagggggcacaaaccuagucagaagggcuuccuguucuuccccaggcaggggacccucggccagcacugccacccugugggacucacugccugcauuugaggcucccccucaaauuccuccaagggccacucuaggagcacagccucauucccagccagggcccugagcugccagcuccaacuggugcuccacccuagggcuggggccucagaugcugcgucccucauccuugcaggcuuugucugggaacucaggcuaacucacaggguaagagccacuuuacaaaggaacacccacccaacucauccuacagacagccucaagaggggaagcuugcucaauaccgacugugucuucuuggagcggaggaauaugggaagccaggagggaagaaaguggugcuagagccugaggagccagcgcaggccagagcugaaggagugaggggccacgauggagaggaagaauggcauuuuuacgugaucaugcccgacuccacagaacguguacuguguagagccaggcccaccucuagcccugguaaacugaccaugaugucugggggcagacuauggccuagaugugcguggccaccggagcccuccaggcugggcugggcugcaggcuggguggaccucccccaaacuggcacucaccagugaccuuggccuugaaggggcugcccacgaugugcugggggccaccguacuugauggcaaugagguaguugccaggggccaugggaguauaagugaccacauggcccucaggacacucccgacaguccagcugcaccuuggaggggccaucaauggugacagacaaggcccccgagccggcauucaggguguucacgaugaacucugaugacacaccugggggccagagguagcaaggcugagggcaggaagggcuuguggcccaagagggacugggccccagcucccuggacagccucuguggggacuccuggcuuaggaagcagggccccuaccucuggagcaaagcagcaccagacuaguggccaagcacccccagaagucacccuguuccccagcuccaggcacucaccgguagugccucccucgagcccaggaccguaggcugacaccaagccuggguccccagccuggcucugcuccccaacgcggaucuugaagggacuuccagggaugugggcaccguugaacuugacaucgauggaguggacgccauucucgugggggaugaagcggauggugugcuugucuguggauaaaggguugguggcuuagccuccauccuuccccuccccagaaggccccagcccggaagggaguuggcaggggcagggccagcucaccacuguccagcucagagacguagcacuccuccacagcccccgagggugugugcacccgggcaucaaucacgccccgggcaccguucagcugcacggcaaaggacgcuggcugguucaccuugagccccgucuccugcaaaggccacggaggaugcucagacuccugggaggccggggcuggagcagucuucucugaagccccacacggugcucacuguaagcccagcccaaaggcugcugccaccccaugcccagccuggccccugccugccagcccagccugggagcaggaggagccaggguccgguaugcaacccuaugugugcaccugcuauccuagcugugcuuggugugugggagaugacagacgaugugcccuguccuggcugaggaaggaagggccccacucugugugaagcaggcugagggcggagggcaagugccugaugggcugugugggcugggggugccagagagcucugagguaggaagcugaguuucacuggccuggccugggagagcuuccuggagaagguggaccaacagggaggaccagaagaagcacagaagggcucugggggagggauuggagccugcaucggggagcccaguucaggagugggaggaggagaugcacaaggacucuggaugggccaaugugaccacccugaggggcagccaggaggcgcgugggagaaggagguggggugaagcccauucugugcgccuuaugcagaagcuccuuuacaauguguccccuggacaccuggcccccugguuugcauguuucagugugacuugcugaaagccuuccuugcacauguccgcugugacagaaugaaaggaacacaccacaucucuagaagucagcagcaagagaaagcaagccaggcccccagcggccugaagaggaugcagcccaggcucugcagcccauaggcauucccuuuagaggagccucucacacccucugugcaaacugguuuacucuuaguuuguauagauuuuaugcucucauucuuauaaauguugucaucuagcauucuuacaacagaagguggaacaaacuguaacaagaaauggcagguggcaguaggacaggcagacacacccugagaaaggcagaacgaggcguggcaugccugagugcacgggcaagcccccagggugggagcccaccguccccaagggcccugccucgugccuuaugagaagggacuccuaacuggcccuuccaaggucacugcuaaaucccuggccccauggaccugcuguccucaacuccugcccaucucucagauagcagaaacccuccacccccacccugggcacaaaccuggaggcuggugacagugagacggcgagcgucauccgagagggaggccacaggcaccacaaaggggcugucugggaugugcucaucauugaacuugauggagaccucauagucaccuggggagagagaccagucagcacagguuccgggauggagguuggcagggcgggagccuccccacccuggccuuaucccaggaaaggcucuguggucagcgcucagaucuggaggcagacacauguuucugagggugugggguagagggagacggggcagaggaagagcagggggcuccggggaggggaguucuguggccccaagcaucuccugccuggccagugggcagaaacccagucuggaaggucaggcaggcccagccccacugccaguguggacgcccaccugguuccuggacgacauaggagacgccgcaggagccaucuuugcgauccucaaaugcaaucuccgcuuugcuaggacccuccacagcaauggacaggcccccagcgccagccucccggguccagaugcugaacucggcuggggacaggcaagguaguggacuucagcaucaucgccccucacacuggcugcccugacuucauccccacuccuggccaccugccccuuaccuggcacgccggccacaccucgcuccagcccugugccuccggcccgcaccuugugggcaccaccuucacccagcggccccacagugaacugaaaggggcugccgggcacgugcuggccacgguacuugacagcgaccguauggggccccauuuccuggggcacaaagcgcacgcuguaggcgcuguccucgcccucgacgaucucugcggcuuccaccuugcccgaugggcuggucaccugugcagucauguccugagagcuggccucaccugcaggguuugggggaugucagggcaacacugggauuccuccuagcccuggcccuucccucccccaucaguuaaaccuccuccucugcucagaccugcccuggccuucggggccagucugccagcaucaagccugguccgcagcacccucccaucccgccgugaggacccggccggcccagugugcggugcucacccuccugcugccgggugaugcugccgaaggaucccaggcgcucccggcccaggaaguccccaaacacagcagggaagggguccccgccgaccuggguggacuccuccacccgcaccucgcgcuuugucuccccgccccgcgucuugcugaucuccgugcgcuccgugcggguguagguguggcugcugcgugugaaggugcgugucaggcgcuccugggcagacaccaucuggaaccaguuuccuguguggucaagggagccagggugagggagggaagcgaggggugaggaagcaggguggaggcccgacaggugggcucuggcccgggccagcccucucccaccacccgccccacccaggguccuccaggcuucuaccugggaucuugagguugaggucacaggugcugccgaugguggcgauggaaggugccugucuccgccgggugaugcucuccuucaugcggcccucgccggucaccuucacagugaaggggcuuccugaaguggggacaaagggugggucaggaaccucagagccccagccuccuggccucccugucucucgccaccgaccucugcccagagccuuaccaggcacgugcuugucagcaaacuugauguugaugauguaggugccgggcucgguggggcaguaggugacuuugcaugucccguccuccauguccucacaguugauguccaccuugcuugggccuucaauacucagccccaagcccccauaaccugggggaaagcaaggaacacaucucccucaguccuaggcuggccaagccacaaugcuuuccucuccccagacugcaggcuccacccagaaugggcaccgauguguguagugaccacuaacaaaaauggcucagugggaggagcgggggcaccacgggacaggcggucuggaaaauucccuaagguaagccucuuggauuccagugagcaagggagggacagaaacucaggacagcugagcuuucucuuaaaagggagagaacugaugcggggccauucacuuucccgcaaggggccccagaaugcgaauccugacgcagacuggucaggaaguuucagggaggagagagugcggccaagggggugcugggcaggacgaggacaagugccugugggaggcacccgcuggaaugggggcucucuggggcaggagguaccugcauugcgaguguccacgaugaacucugccaccuggaaugugugucccucggaaagccccuugccccagacccgcaccuugcuggcguccccgaucucagauggccccaccaggaucuugaaggggcuguuggugacaugcuugccacucuugcgcacgcucaccacgugcuccccgaccuccuugggggugaaggagaucccuguggaaaguggguguuaggcagagcauccugugggcccccaccccugagguccccgugaggccccacgcucaccaaugugccgguugggcaggcgcuucagcaggcagggcuccucguugcccgagggggcacggaugcuggcggucagcuggcucagaucacucucggugaucuucagugacacguccguggaggugcccacauucagcugugagguccucauggagucaucaccuggugggggaguuggggcaucaggcugcuaugacuccaggcaggcccugcccucacagggcucaggaacccuccugagcagcccccccuggacucaacagacacggggggccacucccaggugcacggaggcccaaggccuggaaagugcagucugcacucacaugugagcugccagagacuaagaggggccuguaccccaauuccacuguggcugccucaguccuugugggcuaaaucccuaaaggaaaccuccugcauuuuaacccugagucacaugauguugugauaacaaaacacuagacuggaccgcccagaccccuuccucgcuguguggcuguaaucauguugcuuggccucucugggacagggguuccuuaucuaucaaaaggauuauccgugcccuaacuucuuaagagugacuucaugcugggcgugguggcucacaccuguaaucccagcacuuugggaggccgaggcagguggaucacaaggucaggagaucgagaccauccuggcuaacacggugaaacccugucucuacuaaaaauacaaaaaauagccaggcaugguggcgggcgccuggagucccagcuacuugggaggcugaggcagaagaauggcaugaacccgggaggcggagguugcagugagccgagaucgugccacuguacuccagccugggugacagagcaagacucccucucaaaaacaaaaacaaaacaaaugacuucaaagacuaaaugaggcaauguguuuucaggcacaaggaguggcugacugcuucuuagcugccguggagaacagaguguuuuuacauuuaucaaaauaugaccccucacaccuugaagggccucugcccuaaugucacgagugacuugaacgggcugggcuugcacaugagugcacuguaugcggugugugugccucaugggcuguacaugcccauacacccgccucaccugugaucuuggcugugaaggggcuccccgggaugugcuugucaucgaagcgcacgaugaugcuguagucuccaggcgcagucggcagauaggacacggugcaggugccauccuuguuguccuuacaggugaucucugccuuggaugggcccuccacggccagugacagacccccuguagguggagguguggccaagaucagagguccugcccucaccccugccccuggugagucuccaccccagccugcgaccugcagcucccucaccuucuccagcaucuuuggugacaauagugaagguggcuggcuuguugaccaugccauggcucaggccuggcccauaggcacugacauggcggcuguugauggcauccacauagaacuguaaggggcucccuggggauacagagaaaaagggggcugggucagcaucagggauuaucugagcccaccuuggccccagcaccuuccagcagccucccugccaacccccuccgucugugccguagggacccagcugguggaggucugcuucccaccaggguauaagccucccuggggccucgccuggugucugcacacagcgggugcucaauaaauauuuguugaaagagggaaggcaggacugaagcuacggccugcuccucucacccaagccccagcccagcccagccccuaacucaccagggaugugguugccgucauacuugauccccaucuggugcaggccuuucucagugggugcauaccucaccgugauggugccguccuuguugucggugauguugggccgugccgucuuccccgagggcauccgcaccucuccugcagggcagacacaguuacguggagacccugguuucccccacugcaaccucccugcugucccaggccugguccugagugcuucugcugccacccgagaagccaggcaucaagagacagccuguggcaguggccugagcccugaacuggggacagauggcuugcaccugaguucuggcucugcccaacuugcugugugacccuggguagagcucacuuccucucucugggccuuuguuuucaucauuaagacacaggacugggccuggaagaggguuucuccccucagcccucaugccugggagccacagggcaguaccugugagcuccccuuucugcaccgcgaaggggaugaccagguugaagggccucagcauggacuccauuggcuccacaggcaccacuggcuccucuguggccugcagcaggugagagggaacagucagugacuggggaaggcccaggaguuugacccaugcuaugacugaagcuggagagugaggaaagaacaagguaguuaaucaugaaaccagcguggcaggagaggugcgucagcugcaagagaaggagugcugugcccaagugggguuccaucugcccagccuaacucuugccugcuccccaagaggcccccagaccauguccccgcccuggcugcagaggaguagagagaagaaaugaaggaaggggaggaggaggaggacaucgccuggugggaggcgcaguacccaguguguggggcgggcgccgggccggggaggagcguagggcuggcgcagcuguggcacuucagagggcuccuccucgugcggcagggggucacacgccuggggaggcaaggcacgggggcacaggguguggcagccucacaggccuaggggcugacucagagaauggcccaggaaccugaaaugcugggugauaauuuggguguucauccuccugcagggcagccucuggggagauggagcuggggaugguggagagcacagcggguuccuccagagacagcugacagcacugggcagggggcagggccaugcucuccucccacuucgggggugcuguggggaaaguuaaggcuccauccuggagcacucuggccccaggagcccucagagaagugggauuccuuggggacaguuaucugggaucccugcugcugcuaaaagggccaggccccccuccccagccaucuagucuugcuguggcuacagaacuuaccagcacguggaaggggcuguuggggaugugcucacccccgaagcggauggugaugacguacuugcccggcucgggcgcuguguaguagaugucaaagguaccgucaugguucucaaccacauccacaucgagcucugccccauccggcguggacaccgugcaugucaccuuccccucaccggcugccuuggcauccaccgugaucaccgucuccugcccaaucuggauucgagggcccaggcaggcaccugccaugcgggagauccugcucagggagcuggugggcuggagccagcccucucuguucccgcugcccgcccccuaccgccaaccacccuggcccacaccaagaagaggagagaaagggcacucacccaggccauggccuccaauggacacuggaaagagagaagagugugaggccaggcggugcucaacgugggcuggggcauugggcgggggugagggagggaggggccagggcuagggcaugugugcucuccgaccagcagaccccuggggaccaggccaggguucuggaggggcuuugaggggcuggguggugagcagggcacgggcagcgggugggcacccaccugugacgaggcacuugcuggcauccccagugggcagagcauggaugcggaagggcgaguaggggaucucaucaccgccauacuugauggugaugguguaccggccacucauguccggcagguaggacacaguguacgugccauccccauugucccggauguuggccuucuugggcuuacccucgggguccugagggagaagcagaggucaaggcccgccugugccuggagcaugaccugcggggugggaugcacagagacucaccaagaucuggacagugagcaaccccucgcccgcgucccgugcgucgauggugaacuccacaggcaggcuggcagggaugccagaggcguugaggccugggccgcuggcccgcaccuugcuggcaucaugagcugggaggaccuugaucuugaaggggcuugaggagcagaagggauaaacaguuggcuggguggcauggacggggcgguggggggugaucucaucuugagccagaguccuccccauagacaugggcaggagggaggacuguggggcagggaggagggaccaguucccagaagccgaugacauuccaugucugggggugggggcacucugggacucccucgacagagccaggguacgucuccauuccccaggaaggugcugugggaggguccaggaggaggcccuggcccaggccuccugcacucuuccuaaggcgcuagguuugccguaaaagcuccuggggcaggaaagccucacagcagagagccccggggaagagcgggaugggguggcgagacuggacgaggcugagagcugggagaggcucucccaggggacuccagcagugauccugagugccaccccagcaggagcaccccagagcucagccgcagcacaggagcccagggcugguccucaccugcguggcaccuccuggucagcauacuugacggcuaccguguagggcccgucaguggcugggguguaguggacagugugggugccaucuccauugucccgcaccuccacaggcucggccacaccugggcaaggggcacagggucagcagagccuccgggcgucccgccccaccucccuccucccugccccggccauucuauaccuguggggcccagcacagccaccugcaggggcgcccggccagcuugacugcaauccacugugaaggucugaggaacccgggcccugacaccagcccccagcccuggcccugagcacuucaccuucccaggguccaccacauccuucacuggcacgcggaacgggcucccugugaggagaaggacauuagacccugcccaccagcccugaugggucccccugaugcugaggagccucggaggaggaggccuucccugccuuugaaaugcccacagggaagccagaccaacaugggaaaauggcuaggaacuugcuaagaaaacacacacaagaauaaaugaacuugacugcagacugaggcugggcaaaccucacucaugugggucccaggccuggaagagaaggccuuccuaaauuaauaaaaugugaaaauaaaauguuuucaaaaaugaaauguauuucugacacuguggcugaaauaauaaaaagaugggaaauuagauaagggaaaaaauuuccaauuucagcagucccaagucauacaauauuugaagacaugaccugcccgggcagcugggucugcagagggcaggggaguucugcagacgaugcgugcaagaaggcccaaggcuggccugagccgccaagaggaguggacugugucugaguuucuggacacacagugagugguggaccugcaaagccaaggucuugagcuccagacaaggggcuaggaggccagaguguguuccugugauugacuaggggggcugucacaucaacccucauugccugccuccuccacguccucccucuggccgggcuccggccccaacccacucuaggcuguccucucuaugaacauucuuacccaacuuccuuccaguuucccccuuguggggcgagcauccugcacccucccuugucuucccugagaccccgaccacucucucugcacaccugggaugggccgccccccgaaggugauguugacgucauagucuccaggagugaaggggauguacuccacggugcagcuaccauccuuguuguccuugcaggacaucuuggcuuccgagggacccucgauggcuaggccaaggcccccggugcccgcuccccugagagauaacauccccccaucagcuucauaagaccagugagugaggaugagggaguagcugaauggggggacagggaggaaagagggcaggccgcuggggacccagcugaggagaaacgagcuacaggggccaaucugggguccuggagggggucugcuccugccucaccccugagagaggaugggguggggcugaggcccaggcagagggaugagcgaggagggccaggggcugggaaaggguggucacagauuuaggcuagcaaagggggaggauaccuggucuccacagugaaucgguuggccuuguugaccaagccacccuccaggccuggcccgaaggcucggacgcgggugggaucacagcccucggucacgcccacucggaaggggcucuugggcacagcgaccucaucauacaggaccuccaccagaugcacgccuggaagccagccacaggggcaucaaucagggagugugcgcccccaccaccccuccugccccgagggcaauaucaucagaucccggcccugcccacuugcccagcccugcccacuagccuggcccaccggcccucacccuccucguaggcgguguacugcacucgguaggugccguccccauugucugucacauaggugucugucuuggcccccgagggguugagcacacgagccgucacgugguugccgccuguggcuguuagggaucuugcauccacagugaacucaguggucaccucccgcaggacaccuggagcccagggguggcguguucagcaggggugggggcagccuucacacagaugcucccucuccucucccccuccuuucccucuccucucccucuccucuuccccuccucuuccccuccucucacccuccucucccccuccucucccacuccccaacucccaggcugcuccucuaaucggagccugggccccacacccuccccugcaccucugugagcuccagccucugccuucacucccuucuccauguagugacauucucuguucacuugagucacccaccaggcugugggccugggucuugcaucccucugccguggcccaugccuagccagggucuggccccuggcagauggcccauucccacuuacugucuucugacucuugucauccucuaccccaaagcuuuccccgugcccccguccagagcagaguuuuagcuuuuuggaucaggguaccccuuaagcacaugaaagaagagaucucuccagaaaaacgcccagaggcaggugcaguuuugccacaagagcagaggccaaucuccacccccggucuuccccuccacuccuucucugggguuucugggccaguaaggacucuggggcugcuccgagagcccucccuucaccccagguugcucuuccagcucucagcucuucuucccucccucccacggacuacccagcuccugcaccugccacuugaccuuucuuggcuccuccuguccacucaccguguggcucaacaccaggcccugagaccuugacgccacugguaucgaccgcaggcugcacauggacacggguggggaauuugggcacgggaugcccgccauacuugaugguaaugguguaggugccagggaaggcagggcuguaggugaugugguaggugccauccgcguuguuguggaucagcaccucggccuugaccccggcauccgacaggaucucaauggucagcuccgccucgccugccucugagcaguccacagugaagguggcugccucaccgaccuugccgcgcuccaggcccgguccacuggcccgcaccuugcucgggucaaacacaggccgaaugguggcuuugaagggcgagccagggaugugggccucagcaaacaggauguugaugguguacucgccaggcuccgugggcagguagcugacagcacaugagccaucaccauuguccuggcacucgaucuuggccucgcaggggcccucuacggucagccccaggccaccugugccagcccccuuggugucgauggagaauggcgcgggggugccuaccaguccacccuugagacccgggccauaagcacagaccuaggggaagaggcagguuguggguucccugcaccuggccuccucaucccagccuucauggcccccacccaacucaucaccuccaacuguggcugcuacuguggacugagugcuuauaacaaucccaggugaugacauugaggcagcgagaugaagcaauuugccccaguuaguggaccugggauucaagcccaggugugacuccaaggccaggcucuuaauagcuaaguugucuccaaggcagguggugggguggggcuggccucagccccacacccuuggcugugcccacuccaggcacauaagucccucuggccucugcccccuaugacucaucuaucuucccaacaaguccccaacucccagccccaaccagcuccuaucuccucaccuuggagggaucagggggcaggacacccuccacagcaaacgggcugccaggcaccgggugaccaucguaggugauauccaccuuguagggccccuccuccgggggcauguagcgcacagccugggcuuccgcuccaccgccuggcuccagcuugcaggggaugggccggcgagagggcgaagucauccgcacauccaguuggcccugaccgccagccccucguguguucacagagaaugcuuguuccugucccacagccaccucugcguggagggcaagugacaccaugaggagacuccgguccacccuacccgaauaccccucacucccaggguggcucuugccccacuuacugcuauuaaggcccugaacuuugauuuugcugagguccagcgggggugccacauucaccacaaaggggcucuuggggacaggguccccgccauaagucacugucacugccauguugcccuguuggguacaaugguaggucagaacuggauauaaggcaagguccuacaacauccugguggugaauaugggcucugaagcucagauccaccaugagagugagggcaggaggcaggaaaggcguggaggauccagaacuggucccaugggacuggaggagggagacccagggcucuggcgggccggccgggcgguagcaugggaggggcagagcgcaccugcuggacagcgguguacuugacaguguaggaguagucaugguugucuaugaucucaaagucccgcacaaccucgcccuuggcugucccugcaaacugcacauccagcuuggccuugccggcucccuuggucagcaccgugaagugggugggcuucccgacuuccacaccugaggacccacccagagauguggugagggccuggcagccaccuaaccccaaccucgagccagucccagccccugcccagacacucaccugugcgauucagcccagggcccucggccuugacuuugcuggcaucgugggauggguccaccuugauguggaaggggcuggcggggaucuccuggauguggaggaggcucagucagggcucucgaggggaacacaccccugcucucagcuagaugcuggcucaggacacacccaggggacccagcauggacaggggcagccuccaaaagggcccccuuugcuuccucugaggcacccugccucacacagguagggcuccaccaugucugcggaaucaucccucccuguucccagugacagcaucuccagcugccuucuggagcuggcaggugcaugucgcugugaguacccaggagcuuagguaccugguuggcaaacagcaccaugaugguguagcggcccgccccugguggcguguacuugacggugaaggugucguugucauucuugaugaugucgaagucaaugucagccucugcagggcccaccacgccuggggcgcacuugaugccgaugcucacgucgccugcagagaagcgggcacugcugugaguugggcucagcccccgacucgacucacccccgcccccucccagacccaccccuuccggcugggcgcaccuugccccgccucgcugcaguccaccgugaaguaggugggcucauuggccuugaggccugucuucuccacuccggggccguacaccuuuacccgcucgggguggcugcccucgcccacguucaccugcgggaggggucgcagcucagcguggugcccucccucaaggcucauccuccugcccagcgcacccggcccagccucaguggcaccagcccaagccucagucccagccugagcccagggacaacagggacuccagcgaggguuccgcccucccucagggaccccugguggugggcacggggcaggccgggaggacgcacccggaaggggcucuugggcacguuuacgccuccccaggagaugaugauggugugcuuaaugggcuuggugggcacguaggagcagcggaaggugccgucgccguuggggaucaccuugaugucgaugggacagccgucggcguccugugggcaucacccaagcaaaguucauagcuguggccucugcagagcgcccucugcuggccgcaggugaacccagcgccuccuuucccacccccaacacuggcacucccgcccccacaccagccacugaggccaccagagcccagggccacgugcucuggcggccagagcccacccugggagccugacucaaggccaucuguauggcuugcucucccagccuagguuuccucaacucugaaauguguuggacaggaagagugugggcuaaauuuauguuccuaaaacugaaucaugagccuuucaaagaagaaucacccucuuagauccucaagaauauguucauuaaccucuaggggucaauggacaccagucugagaaacugacuugggaaaccagugucuuauucaaugaaacaaucuuucaauuacaaauuagcacaaaaaugacucuuugguaaaauacguuuuuagguuaucaucguuaagaaaacacaaaauuuaaaauuuuccaugguacugaugggcccaugaguaucaguccugccugaucuucugugaugcugucauuuccugcugggaggccucugccucuggccuggcccugccuuccagggucccugccauggguaguaagggcagcagagacuggacaaugaccuaccugggcauagagcuucaggucucccuugccagcugcacgagcaucaauggugaacucagcgggcuuguccacgaugcagccgguaggcuccaggccaggcccaaaggccuucaccugugcggagggaagaaggcugaguuggggaggggaggagaaccagcuugccccacccccggggcaggugugugugagcugggaccacaccuuaucugggaagcagucagguggggcgggcaggaugugggcaaugaagggugagucucggauguccucaucgucacagaugacgugcacagcguacuccccaggcuccgugggccaguaccgcacaucgcaggagccaucccccuugucgucacauucgaucuuggcuugugagggccccucgauggagaagccuggggcaaggugggggagggucggggauccagcaucaggcaagacccuuccgucccccagcuccccucuagcugcccucauguccuaucucccugcucaccccagcgcuccccagcaugcgcacugcacccauuacccacaguguccccugcugcccucccccgcagcacucccuccuccugccccccagccacuuacccaguguccccaccucggugccaauggcuuccaccacaaaaucggcugacuugcccaccuggccagucuccaaaccaggaccccaggcccggaccuuuugcacuccugccucugggcucaccuguaccucaaaggggcugggcagagagggagcugguguccaugccaggaagugccccccaaagucccucgcagcccaaacuccaucuccccucaaacucccucgcagcccagugccccucgucccucccugugauggccuagacaggacagcauggggggcgcaagguacucaccugcgagggauggcguagccgccccacgugauggucaccacauacuucccaggcaccaccggguaguacucgcacucgaacacaccauccccagccucccgcaccuucacuggcuccucugugcccucugaggagaugggggcaggguggggaagaaggcagaucaauauccuugaagucccagcuccucaauccccucaaggagccauugggaccccgacccagcccgagggcagugcuguagugagcagugcugcaacucagggcagggaacacuugucaucccugugcauaacaccccguauagcacuuaggguggagagaaucauuccuggcuuguagaccaagaaacugaggcagagaggagacaaugagccugagauucuggggugccucuggucacuguggagcuguggugcuggcugucacugcccucugggagucagaaccacuggccauacuucccuuaugaucccccagccccacccucacgacccugggcucuggcacucacuuggccccuugaccgugaccuugagcuccccgcugccggcacccuugguaaacaccuugaagucagccaccucuuucacgcgaacacccuugggcugcaggccucgcccagaggcgcggcaggcguugggguuacaggcuaggggaggaagagaaaggagguugggggugcugaggggccuuggaccacuagcccccaccucccugugcacaguccuucuaaccccucccaggcacaggcaguggcccacggcccugcucuggagcccuuuguguccccagcacaaccggggcugccgggcuggagcuggcuacaggccccagaucaggcagguuacaagaaaguuuccgagccagugccacuggggaaaugcauggcagagccugggcugagagugggcucagagagacagggaaggccccuuuacccagcccaaggccauccaucuagagcccucugggccucucagggcaccaaagcaaccuuaggaucuaagucaugccacaaaacauccagcaaugccacagaacaagggcuacuucauagaacucgaagccugccauacaacacaggcaacguguggacaucagccuaccacagaccguggccaguggcaaugagcccaggccuugcuauggaacacaggcaaaggaaugggaaucucagccugccacagaauccagaaaaauggcaugggacccacaggugcuacgaaacaggacacgacacauauuccaggacuaccaugaccauaggcgauggcacugcccaagggguaccacggaacacaggcaauggcucagagcccagauuucaucauagaaaucaccaggcaaguggcaaagacacuagaccugccacagaacacagacaacggcauggaaccuggggccugccacagaaugccaaggaagggggggcgauuccacacggcccgggccaugccacacagcacaggugaggccagucagcugcggccaugccuggccccgccuccacuggagagcauuaauguggcaucacucucggccugguggacgaugggcacugagugcagggagagaacaaguggggcagucaccaccugagggcuuggcaugcaggcaguacucccuagauaugcccccacccauacagccccgucacuuccgcucagcccucccaggguggcacauguucugggacccuucacuguggccucccagcugugcucuuaggaacuccagccaccuugggggugggauggaggacucagggagggggucucugcagacccccgccccagcucuuccuccugccccuugcaagccucuggcuuugguaagggcuaccguggggagcagugaagggcccuuaccuuccgacacauggacagggaagggacugcgggugaugggggcacccgcaaaggccacaugcacgguauguggccccuccauggcaggucuguaugugcagcggaacgugcugucacccuuguccuccagggccaccuccacugugucccgccggcccuguggguccacgaucaccacagcaacaucgccagugccggccccugccgaaaacagaggcugucagcaccacucuggacacacacagcugccccggugcccucacccugaggcugcccacccucuggcuggcaucccugucccagccuccccccacccccacacagccccacauggucaggggcuuuccaccugcacccccuggggcccguccuacccgcaguguagaugucaaaguagguggguuuguuggccacauugcccacagguuccaggccagggccacgggcugacaccuuguuggcaucucccagggccaugcccacguucaccucaaagggacugcguucaauguucuggccagcaaagagcacggucaccuaggggucagaggucaaagguuagcuucuaggggagagcaguccugagagggggcagaggggcacagccaggccaaggagggugagaggcgggcagcuggggcucugggcaggcgcgagguacaggcugagagagggguccaugcagccggaaccaaggaugugaagagcagcgcaggcaggggggccuagagggagauaccuuguguaacccagcgaccuugggcacauaggagacagcauaggugcgauccuugucauuguugggaaccaccuuagccuauuaggaaggaaaaagauuggaagccucuccaaugaccauagccccuccugaccccacagugccuuaugcaccccagccccacucagcccccauggugacaccuuccccagacugcacagcacaguguguggcucuggcagucaccuccgggccauuccuguuguuggccccacgcucucugguuccaaucccaagugaaucccucuguccccagcggccucugcauaccuccucgguguggccuucaggguccucgauguagaccagcaccucgcccacgcccgcguccaccgucugcacggugaagugggcaggcugcagcacgguguugcccuguggcucgaugccuacggggcaggagcagagcccagguuacucagggagagccuacaugugcccagcugcccaggagggccgccaggggcucacacauaccaggcccauaggcgauggcuuucuugggguucagcugcuuggaucgaacaggggcaccagguuugagcuuggccuuggggaacugggacagguaggucauaacagaaugcucauccacguugggguccacaaucuccucaggggcaaugaccugcgauggaaaggagugaugucacauggcgcccucuuuucccagcagccccagucucccccugcacccuggccagguaaacuuacagacccaaccucugccccugcccccuuuccccccugccccaucugcgcauguaccuggggcaccccaagccagucgucggccugcugcauggccucccgggcguucuccacgggcugguuggggucccaggccucccagucggggcagagaccuggagaggugauggagggagacgauggugaggggcagccagccggccaggaugcagggcauuuguucacccaacacccucagaggcuguggcuuuacaccccuucccaccagcucuaggccuugaccagccagguuccugcugaccccaucagcuucgaggccccucaccacguaggagcaggacagcccucuccaccaccaacaaugaagccuuucugcccuggcugacgcagccuggcaccagcccugcuggccggccuccugccugcccaggccccagcucagaccuugaaccccaaacccugggaggguacccccucucgcuaucucuugccucauucagcuuucucaggggugggcagaggaggucagagugccugucccacauaugccccugacccauccccccuagaaggccuccucacagcugccccgaagcucuagaacuccaaacgcuuuccacaccagucuuaggguaugagacucccuauuccuucuaacugcucacuuggggaaacugaggcauuaaagggccugugaggagagaaugacuucuccucugcagcccucaggagcccugccuuccuaacaggaaggacgcugaggcagccccagaucacuccuaugaacggugcaggugaaggggcgcuugguuuaggccagagcuggaggagggggacggcacaccguuucggggagggggccggcucaaggcuggaauccaugacuggcuggaacagcugagcucacugcuggcagccacaccaguuaugggccauggcucagcagcugggaaugcuucccaggaggcugugcccccgccucccacccucugcuccccggcugaccccaggguggaggaggauucucccgaggggcugugacuccuggagaaaaccuaucuuuucaggagaugaggggcagaaagggagcuguccaugggguacgcucuagccagugaugccucagcuuuuuucauggccccugagcuguccccacuugaccaggccaggaccuacacggagaaggggcaaggcuggcucaccugccaccaggcagugccccacuggccucaucccacaucauccugagccucaaccccuucucaaagucaucccagggucucccagagaagagccuucucuggaucuaacuccuggucuugcuacaaguccuggucaccacacugccucucucucagcucggcaggaauagugccucguggcacaguaaaaaauucauggggcagggaguccaggcccugggcucuaggugguucugccacagauaagcugugugaucuuggauaagucaccagcccucucugggccauaguguccuugucuguaaaaugagggguuuuaaaccucuuccugccucugcggaaucuggcacacucaucagguagggccugccaccagccagcggagagccacagcuggaggaggacaaacccugcaggggauccuggcccccaggccccagggugugcauucugacaaccacacgccuuggcagccccagcuuguccccucugucuuugggagcuaagggcuccaugcugugcucacuggcccacucaccgggggcgcaguuguccaccagggcgcccagagcuuugccguccugccagucacgguugaaguuggugaugggcagcuggggcaccuuguucuggauccagccaagcagccgcugcuugggcgucuguuugcgggcauccucaucaucuucauccucccacaugggcauggagauggaguagugcaggaucagcguccagaucaggcccaggaucagcuucagguucccauccacgauggccuugcugucugcagaggggagggcacagacgggcucaggggcgccccacccuccacugccccagagcacccucccucaccugcgcagcuccucgggccagagcucuggggucaggccucuagucucugccuaccugacccucucccuccugcgaggccccacucagaugccaaguucuuuauggggcccuuccggucagaaggcugcuucucuguguuccugugguucuggaagguacccucaccucagcuacagcaagugagucugccuccugucuauguaauuaccugguuucuuucuggccuugugggauuguaaggcucccagggcagagccuuuuuguuuuguuaacaguucuacugagcuaugauugacauacagcaaacugcacaugcuagagaaugaaguuugagaagcuuugacacuauggauauaucacgaagccgucaccacagauggagaauaacgaagguaccauccaucacuccccaaaguuuccuugcacacaccccuuugugagcccucccuccugccguccuugucccuccaucccaagcaacaacugaucugcucucugucacgauagauuacuuuguauuuccuagaguguuauauaaauggaaucacacaguauauacucucuuuuuuuuuggucugguuuuuuucacucuagacacuagguuuuaucuuucuacaaugaaggucuuaaacauaguaaggucucaauaaauauugguugaaugaauauuuuaagaacugaaauuggagugggguaggacaaguuuccacucacacucuaccccgaaugccagaaagggcuuuagaaaccaagggguucugauaguggggcaggggugggugggugggguccaguacauucucaguuaagucuugaaagucauguugucaaaggcugggggccagagggacuccagccucaggagcugacacacuccacccaucaccuccuuugaggaauccuuugagccagaacugguuccucaagauuuggggggggggggcgccuagaucccccuuaacaaucagaaagaaauauccagaagccugggguggccuagcauguagauagaucuuuggaauucagcuuacuuguaaagggcaaugaaguucugaaaucuaucagcuucccaaagcacugcuuucaggaggcuggaaggggguggaagacagucuuguuuacugauguugcccgagagaugggagaggguggaguggagccuuccccuuacacaucuucuccccuccacccuuccccaggucuuggggaaaguguuaggagaccgagagccugggaaauccagggcauccccugccccacucccaccugccccgggaggggugccucagucucccugucccucuggcuggggcucuggccgccugggcucccccacccugucacugauucauccuuccuuccccagcagcuccccagcccacccccuuccccuggcuccacugcagcacaaugguuuggcagcuuucagauuccaugacacacucacucccugccucccggugcuuucucucaaacacacaggcuccaacacuuucacacagucuggaugccccagugcccccagccucucacaaccccgacagccuccaaagcucacacgcccagaaguacuucuugcaaacuggagccagaccccugggcaggaagccuugaggcugcagggguuggggggggcgguguguauauggggaggguggucauucauauuugcuggagagggaaguuucuccccagcaacuggcccugggccagacagcaagugguccaggcuuggggcaggagaagggcaguggggccccaagucccacucuggaagcaaugaccucccucucccuccucccucucggaggccaggcagaggagaggagcucagcgccaccagggcucaccaagccacuucuccaucugccuagggauacccccaaaggagugggaggagccagacagcuaguucccgaggccaccccaggccucaaauggagggggaggagagggcugggccuagggaggugcugggacagcugcugcccccucccgccccucccuugguuguuggcuccaggagaaggaauagcaacuggggaacagcugcgagacagagcugccucauaggccucuuuguucggagggaacgaggggcaacggggggccaggacaagguggugaggauaugaagggcacagcuccuuuaaccugggcucagugccccuucuucaggugggcuuggaucccagcugcuacuccagacccugacuucccuccuggaaagagaaguggggagucuuucugacacccccugaggugcccagaugcucgauuucggugcugagacaauacucagaagguggccccauggauagccccuuuccaccacuaaauggaguaggggagcuagcagaagcaggaugccccugccucgugggcagccccuuugaaccuccucaugguggggcgccccagcuggucgcugccgguguccccuccccuccagccucagccuggggccggcagcugaauugcugacagcuuaucucaucagcgccagugagccacuuggcccaaauggggacugccuccccuuccucccagcgggaaccagggagcuucccucccacccucaaaccagcuuuugcuucuuccccucugcucugagccagccccuccucugcugagccaagggggcuggagccaggcaccgccacgggggaggggagaggugugcucaggaaggacgaggccuggagaggggccgagagcccccgcagacuggaggggaggggaaggcugagcgguuuccuauaugucuugccgaagccuccggcucuucccccagaccccaccugguacagucaguccugccuuucaaaacccagccugcugaggaugccggcccaggacugacuccucucugaccccucagccuccaucacguagcccucagucucacuacacacuccaggcucccucccccacccccugcccucagccuuguccuucuggaaagcucagagacaucugcugugucacggaggcagggcuauuuccaggacagggcaggcggguggggugggggggcaguauuggggcaggaggggguaagggcuagggaggggacuggacggggcaaagggcccugggcugaccucagcugcuauaucaggaggccuagagauggccccaagggagaguggggcugacagacaucaagucaucuggagaaaucucagggaacauccuguguggggcccaccuggccccacaugaaacuccccuccuggggccguggggugcaccguccaaggaccucguccugcaaaucccagcaggguucuuaagagcucuccacaggggugggcggggggaucuuccccaggcccccagccucagggaugacugcaggacucugagggcaggacagccuccugccacuccaagcccacccuuggcgucucugcucccaagacuagagugccuccccgcccccacccugcacuacacaccuuccaaaucugguuacacucaaagacuuccucccuuccacaggccuuucccucccuccccgcagcccagaccguuagcugcagccaaucccgcgguagggggugggcuggggcagggccuggacuugcggaagcccccuccaccgcaggcugaagcaggaggaggacagacagggguuaagucuccccgcgcucgcucagugccuuuuuagguuucugaggcugggcccugccuguccuggcccccgggccugaacccagcugcugagcacaugcacgaagagggccucccgcgccagcuccccucggccccagagcccgcagacgcgggcagugguuggggaccugucuucagcccucucccagcccgcggaggggcugugaagcugggaagccacuuguuuuguugggggcggggagaugcccccaggaaucagugacaggcacugguucuguccucccgagugugggcuaggguugcccgauggaaggaaagggaacggugagccgaggcgggaggugggaaugugcauggggaggcggcagcuggagggcucgcaaacccuaaggccuggacuccccggggcacccagggagugcucgcuguccccagaggggugugcaggcagugcccauggcccuugucgaugggugggagggccggggccagggucuucucucuauaccggggggugcccuccgcccugucucucagcuccccgcgcgcccaccccgcaccugugccccugccccaugggacgacccuauccccgcagcgcccgugcccucgcccccggcacugaccuauggacacgagcuugaugugcucgcgcucgaggaacucgagggccacggacacguucuccagcuucauuuggcggaaguuggggcgcggauggaacuugcgguacaugcgcuucuggcugagcaccucgagcagcgcgaugagccggagcccgucgcugaggucgcgcugcaggucggucaggcgcuugcccacgcacuugaggugcucauugcaccagcgcgugaauguguucugcuggaucuucuuccacggcgcguccuccgccagguccuucuccguggacggcaucucgucugucucaucgcccaggccgaggccggcgucugaguagccgcuguuguucaucaugcuggcgcgggcugggggugcggccggggcuagggccgcgguuugggcuaucgggggcugucgggcgcuguuggggcgcgaccacgggacucgcugcgcugcgcugcucuccucuccaacuucucucgcgccggggcuggcggggcucggcgaggcucggcgggccuccuaggcgcucggccgcucucuggcucucucucccuccagggccggagcggugcucgggaagggcgggcugggccggggcgggggguuuaagaagcccccggaccgccgcccccccgccgcgcccgcggcccccggguccacgucagagcgccggccucccaggaaug

SEQ ID NO: 14562 - RNA, 1510 nt, Homo sapiens
ggaauagugcugccgcuuccuuguuccucuucuggcuggcuggcccuggcuuuccucugugaccucagcuccaggcacugaggccaggucuuagcguggcauugcagccucccugcccccuguggcaaaggcucagguccacuaugggcccagacucuggggcagagaagcugccgucuccuuacugaagcuuuaagcuugguggagagugggcuggggagaccucagucccugccuggucuagggggagggguggcuuccgacuucuggucuuuaugacagggagggagagcuuuggaaggguucacagcuccgcccucaauguuccuuuuugccugugagcuucgccugugagacccaacccucugcuucccagcuucaaggaggaguuucccagccugugggcccacagggacggcuguccucacuuccucccuuuggcccccucugccugcugagcccagggcccagcccugcccccuacccaggcucaccccacagccaggccugagcucaggagugggaaauggggcugagaccagccagugaagggcggccuuggcauuuggggccaagccugggacugcugggguggguagggguguugaguggaguucaggaaagaaacuuauaggggagagaggaaaacacuggucguguccaugauuucagagaucaggaguucuuauuauuauuauuuguuauuuacugagcauuuaccaucucucuaccgacucuaaauucuuuacuuauauaaucucacuuaaugcucacugcaagucuauaaaguagauguggugauccccaguuuacagauagggaaauugaggcacagagaaguuaguggucuaaggccacauggaauuggcugagcagggaucuaaacccagcucagucugcuucuucuguaaacuugugagagagaggaaaaaucgaucuggaaacccuagggcgauggaguaaccuaaaagggcagggagacucucuaggaucccgagagggguggacuuggguuuauuuucuuuucagggucuccuccuggaucuuaagcggagacaaggccuacacccccguugggcuuccugcgagcuggagcugcucucuggggucaggaccggccgggcccggggcggguggaggugugcaugggaaaggcgcgcgcggugggggguuugagcccucccugaacaaagccugggugggagcggccuguguguccccaccccgccuuccccagcgccugcugagccgcgacgacagacggcgagccgagcgaggcggagcuagcauggccggggucggggccgcugcgcugucccuucuccugcaccucgggggcccuggcgcuggccgcgggcgcggaaggugaguccaggugcgggaggcuugggguccggccaggugcgcccccucccuccuaucagcccggccugagggggccgagaggggcugggggcucugcucuuagcccugccugagguucgcgcgccucccuggccagcuccguccu

SEQ ID NO: 14563 - RNA, 17523 nt, Homo sapiens
cggggcggggcacugcccgcgcccggagcucagcagcagcugcccaggggcgggggcggcaagacgcggaagugcccggcagguuggcggaccggcgggaggcgcagccugggcagagcucagcuuggucccgccgcccggccggugcucccuggcgcagccacgcaggcgcaccgcagacaggugggucccggccgccgcgcucuccucucugcguccgcgcccggcgcgccccgaggguggcgggagcggugccggcuacugcccccaagucuaggccuagacugggccccgcgccccccaggcaccugcgggcggcgggaugaagacuggaguagggcgggguccgcguccagcugcgccuggaaagcgagcucgggggggugccuacagcagggugcgcccggccggccugggacuuccaaagcgccucccacgccccgaucgguuuggggugcuggcgcccggggagcccagugacccaggcggcggagugggcagcgcugcggggggcgccggcucugcugcucucccucccccucgccaucgcccagaauggggguucccgggagccccgcuggaggcuggcuuggaccacagaggagcgaggcccgauccuuacuuucgaugcacucgcccuugcucuuaccgggccacccucacccuuucggaaaagagguugagguuaaagcguucaucccccgggaucuucaggccaauggcaggaacugugcaagaguuugggggaagauggugucagguagaggcugcgucccugggcucgcggccgggaauggcagacucucgucccccgagcagcggaaaaggauggggcgcaauaguuccugggcugguuuccucagguccugucccagaacuuaagaaggcaacaaugaagaggcuaaacguggaggaaaagugaggcuagcauggccgggaugcguggggagaugguugucuccggaccccgggaggggcgggagcggguaccugggagcagaggcuggagugggggacuuucccagccucgcggccacgcugaacacagcagggcgaggaccggggugcugcuccuccagcagcaggaggagagguccagaggccgacucuggagguggggguggcuccgcgggcuggcccagggggugugccccagcggagcacgcgggaggggugggggcggaggggaggggggagcaggggcggaggacugggcugggccugggcuccucgagggcccagaauggggauaagugaccagaaccagagagggcucggcuguaucgauguaggaaacuguagccccucaggaggcccucuggcaagaccuccccuuccugcccccacccccaguaguuauggggccuggggugcuggggcugagggguuccaagagucaagggaagcacugggaaaucaccccuuuuuaucuaaaggcccuacuuugggguuuuuccccuguacccuggucuuccccuacccugacccugggaggaagcugaaagaagcuucuuucugggcaccuuuugccccagagccucagccugucuggaccaggugggcagcagggcccagggugugggcagcugacccggaggggugggauuugggggucagggccuguacagggaaccccuuguccucucccugagcuggguguggguuugcaaggagacaugugacccagaccaacccugggagcagcagggcgccugcugucuggccacucuuacuaggacugcuguggcacuuccuccccuagugggucccuggugcccaugaauugcagcuccugggugguggugggggcacugucuccugggacuccagcauggcccuggggugagcugugggcuuaccccaccucagcagguccucuagggcugcccacuggaugcuucgcugccucacacaauuguagggacuuccucaggcuguuggauuuccccaccuuccggggcucagguccauugacuuaggucuagggcuccauacauuucacccagagacuccggagccuggcaggcagaccuguucugacaccgaacuuccaaagucaugggccuugauugggguggucugaauuagaccuagcccuuuucugggcagaagggagcuucuaggaggauggaugcuguucggguuagagcucguguggaccuagcugcaggcaaaagccuugaggcugagucccuucuguggcaugguggacagacucucgcucaucacagccgggcuugucacgggagcuccuccuccacaccccucccuaagcugccuguauggacgcggcccucugacacugaggucggaguuaucauuucaaaaccuugcucuguauuaaacagccguguugggcagggccagacugcuggacugacaguagggggcaggcagccggacccucugagcuccccaacggcaccagcgccugcacggccucagcccagggggucauuagggaagcucuccccgauucugugcagacagagcuuccucuguccacccuugcucggccagaauugugugccgcuggugacuggcaccccucuauucuagggccaaggccucucaggggucuacagauacaacuaugggugggugcacacccauguuauaaaccacacuaaaugcacaaaaacugucugcaaguuuggggugcggggaacagcucugggugggagguuggaaauuuggucugggggacccacucggcucccucccucagcccacagugagucugguuucugaguugucccggucuagccacuuucguuuccccuggggccggguggaggcuggggcagaaagcggaacugagcccgcguguucugaggccagggcagggcuggagcguucugaacaccuccccgucccagccccugggccaggcaagggccggccuuaccucuccuggguugguggcagcagagcugggcucugagggaggccugcaaugugagacaguagcagcucagaggcggcacuaggcaggugcaaccccaaaagguacugggcagggaauuucaggggaaacugaggcuccaugcugcaaggccaaagcaggcccagacacagggaguucagcucgaacguuugcuccuuacuugcugaccgacacauucacuucugaugggcugugcuguguaaugacccaguccuuucugucuuccacccaggggucucaagugaagggccaagggcauggguaaggggaggagagggacagaaggggacucaggacuguggagaguuuccgguucugggcuggagagggaguugggcaggugaaggggaggaggcagggucccucuggccugacuccagggaggcagugaagcuguggccugggaggcggggcucgugccccuggguagguagcaguuagagcuguggcuucuguuuccuguagccuuccuaacaggcuccggcaggcguuagggccuuccuaagugcuacccgaaugcguguccagugggaggagaagggggaggaccaagaaccuagaugaauggcccuagagagguaacaucuguuuggugccugcugucauuggagguggguugaguugguugaugggauuucucuaaagauauugagaaacugcuuuccucugagggcagguguccuugggagcuccagaugagauucuuguugagggcaucuccggagggaacucucaggggauggagggugagaaaacuugggcagggaagaaucgaacuagggguguagacugagcaggaggcugucuucgggcugaucccacagagcgcucgcugucccagguagccagcuugagacaagacagccgggcuuuuggugucaggcagucacuggcugugggcugccccccaagagcaaggggugggccuaaccuguggugugaguaguggaaggcgguucucuggccaacgggcugcuugcugcuguuagcaguuggagaauggaugccucugcccgguaaagggcaccuggggccgcgcccgcagcauucacuaacucguaacucuccuucccuuccuccaaacacaaaauuccaugacacuagacaagaaagcugaugcuuggaaaagagaauuggccuuaaauaccuagauggacuggagagaccauccuuugugguccauagcuugaccucugaguacccuguccccauccaccugcagaccugcugaggcuccccucuggcuuucuccugcagaccccucugccaugaaccaguccaucccaguggcucccaccccaccccgccgcgugcggcugaagcccuggcugguggcccaggugaacagcugccaguacccagggcuucaaugggucaacggggaaaagaaauuauucugcauccccuggaggcaugccacaaggcauggucccagccaggacggagauaacaccaucuucaagguaagccccggggaggagguuggcuggaccuccagggcacccuguccccagaagaggagcgcacauaacgcacacaggcagcuccucgaggcuggccacccgcccagcuaccaugcugcugcugaugccgggcccggacuaaggggaugcagacguagacacaggguacaccuuuuuccuuuuuuuuuuuuuuuaagacagagucucgcucuguagcccaggcuggagugcaguggcacgaucucagcucacugcaaccucugccuccuggguucaagcaauucuccugccucagccuccugaguagcugggauuacaggcaugagccaccacgccuggccuagggcacaucuuuucuaaccugcacccuagagcaucguggggacugaggguccccagaaggccuucccauaacucguccuacucacccuuugcucgucucacuccuauuacucaugaggacuuguucagugcacgcauaugcuaaaggaagccaacgaucaucaucuuucuaaaaauuuuauuuuuaaauuaguauauauuuaugggguacacaguggugauuugauaagcacagugaucagaucagguacuuagcauauccauaaucucaaacauuugucauuucuuuguguugggaacaaacuauuuuuaauauaagauucagauacaucaucaaucuuucaauuguuuaaauuuucuaauuuuuuuuagagacagggccucacacuguugaccagauuccaauuuuuuuuuuuuuuuuuuuuuuuuuuuugagacagggucucacucugucacccaggcuggagugcaguggcuugaucucagcucacugcagccucgaccucccaggcucaggugagucucccaucucaaccuccuugaguagcugggauuacaggugccugccaccacaacuggcuaauuuuuuguacuuuuaguagagacuuugccauguugcccaggcuggucuugaacuccuggacucaagcaauccacccaccucagccucccagagugcugggauuacaggugugagccaccaugcccggcccaaucuuuuuuuuuaauugauguacuacaacuguacauauauacucuuuuuuuuuuuuuuugagaugaguuguugcucuguugccuaguguugcaccauuggugagcaguggugcagucauagcacaaccuccaacucagcucaagugauccuccagucucagcuuccugaguagccgugacuacaggugcaugccaccaugcccagcuaauuuuuuuuuuuuuuuuugagauggagucuugcuuuuucacccuagcuggagugcaauggcacaaucucagcucacugcaaccucugccaccuggguucaagcaauucuccugccucagccucccgaguagcuaggauuacaggcaccugccaccaugcccggcuaauuuuuuuuuuuuuuuuuuuuuuuuuuuuuuuuuuuguauuuuugguaaagacaggguuucacccuguuggccaggcuggucuugaacuccugaccucaugauccaccugccuuggccucccaaagugcugggauuacaggcgugagccaccgugcccagccuaauuuuuugauuuugauauuuguaaagaugaggucucacuuuguugcccaggcuggucucaagcucaugggcucaagugauccucccaccucagccuccugaguagcugguaucacaggcgcaagccacugugcucucuccaauaaucuuaaugcuaggauguaccucgcauaauaguuuuugcuuacauuuuaguuuuuuugcacauguguguauauggaaugcaaaauuggaaucaagugaauaucuugauuuauagccuggauuuuuuucacccaauaucaggaucagcuuuccuuuccaacauacguccacaucacuuuucgugacuguagaauuuccacuggaaugguuuagcacaauuuggucacugagucuugguuuuuagauacuugagauugcuuuuaaaaccugaacuuaaaaaccacauugucauguaggcugucuuaaugcuucccuuuuuuucauccucaauuauuuuggggguugauuuccuagaguugaaaauugcugggucaaaggcaaugcuuauuuuuuaaaacuuuggguacauauuuucuuaguuuuugggcuugauccuuaccuuuccaaaauucuuuugcuaauccauuuauuuuguauagguaauacagucacaaaauucaacauuaaaaggcauagaaugguuuagagcaaaaagucucccuccuucccugguucaucaccacccacuccccucccuagccuuucccuagaggcagccguguugucauuuucuuguuuagccuuccugagagauuuuuaugcacauguaagcaaauauggaacuauccuuuccucuacuuuucauaagaaaugcuagauaucugcauauuugucuagacuuaauacuucuugacgauugcuacaugucagcuuauaaacaguuuccugcuuuuucuuuuuuugugcugcccaguauuuuucauucaauggguuggccguaauuucaccagccccucauugauggauguugcauuggguauuuugggucaucuuuuacacacagcacugcugcgaauaacuuugugugugcaauauuuugugugaaugcuucuaugauauuuaggaugaauuccuagaaaucaaauagcuggguuaaaagguagaaagaaauguugguaacccucaccucaccuaauugccauucaaaauaauaccaacagcuccagugucucgagccuguccuaugugcagguuuagcucugagugcuuuacggacaucaacuccccucaucuuuuuugagauaggguaucacucugucguccaggcuggagugcagagcauaaucauggcucacugcagccuugaacuccccagcucaagcaauccucucaccucagccuccugaguagcugggaccacaggcacccaccacuaugcccagcuaauuuuuuguaaagacaggagucucguuauguugccuaggcuggacuccaacuccugggcucaagcaguccucccaccuuggccucccaaaauguugggauuacaggugcgagccacugugcccagccaacaucaaccccuugagucuucgcugccacuccaugaggugggcaacugugaggagaucaagacaaagggaggcagugacauggccuggcacacagcuggcggggggcacuuccagauucaaacccagccuggcuccagggugcucacccuuaucccgcacgcuguccuccuuagagaucacacuguuucacccucccaggagcagggacuauggaugcaucucauagccccuagauuucauguagcuugcuggcagccugagggcuggggcaggacuguggcagacucccacgcugcaaaccaggucuggggcucagcgaggcucagccuguagccgaaguucuccccacacaguagagucuccuaugggacaggaggcagacuggggcuguggcagggaugagguucucuguggucggcuauuucuuccugccccaggccugggccaaggagacagggaaauacaccgaaggcguggaugaagccgauccggccaaguggaaggccaaccugcgcugugcccuuaacaagagccgggacuuccgccucaucuacgacgggccccgggacaugccaccucagcccuacaagaucuacgaggucugcuccaauggcccugcucccacagguaucaggccuagcccucugugggccaccugggaggcugugcaauguccuggcccccagccaugagcucuugggugcaggcaggccaagggccccucuagcaggcagugguccaggaaacgaugcgggggcucccgcuaggucaugacacccagggcuuccaggaguggcugggaugggucacuggcauaucaggaauggcuuggcgugcagucagggaccugggugcuucuuccuuaccauugcccucguuuuggcuucuggcuccagccuaggucucauggcccauggagucggggaggucuuucccaauccugguggcugugcccuccaccucgcccuguguugggggcagcuuuggggaaggcagaagcugcauaggagcuacaggcagccucucaggggaucuugcuucuccuccgacauugacuccuuuacugcccugcuuuucucucccugcugugcagacucccagcccccugaggauuacucuuuuggugcaggagaggaggaggaagaagaggaagaggugaguguggguugaggaggcagguggagcccuggacgagcucucugcuguccccaucggccuuagguuuccgcagccccacucccauggagccccguggcccucucaauaguucuccuuguuucuucuccugggauucugaacgauaggagcacaguccccaccugcuccuucccagggcauugucauuacccugugugugugacccacgcagcaguuggggcuugguaggucugacucccugcagaaggcaaaugaggaaagugaggcaaagggcuuuucugaccugccugggauggacgagcugggaccggaggcagggucuugccugagcuaaacugaggcuaggggaguugccucauaguucucgccuguuauuuccccagccccaggucaguggaauaaccuguccuccuuucucucccaucucuucccucccuugcugguggugucccuucagcugcagaggauguugccaagccugagccucacagguggggccgggagguggugguugggggucuaguauacagagaagcuauagguaccauagguaccuggaagggggcugaugggaggcuaggguggcccagggcugggaggaggugugccugggaggcaguucguggagguggcacugacagccguccacacgcacucucuguagaugcagugcagucuggcccccacaugacacccuauucuuuacucaaagaggaugucaaguggccgcccacucugcagccgcccacucugcggccgccuacucugcagccgcccacucugcagccgcccguggugcugggucccccugcuccagaccccagcccccuggcuccucccccuggcaacccugcuggcuucagggagcuucucucugagguccuggagccugggccccugccugccagccugcccccugcaggcgaacagcuccugccagaccugcugaucagcccccacaugcugccucguaaggacccauggcugggcacggggaagcagugcugggggauugggguaggauuggcaaggaggguggagggugcuggacucccuugggugggaaaagugggagggcggauggggcugggccuggccacugggcugcagaauggggaggcguggggcucaaggacgggaugggccugccuucugccccacagugaccgaccuggagaucaaguuucaguaccgggggcggccaccccgggcccucaccaucagcaacccccauggcugccggcucuucuacagccagcuggaggccacccaggagcagguggaacucuucggccccauaagccuggagcaagugcgcuuccccagcccugaggacauccccagugacaagcagcgcuucuacacgaaccagcugcuggauguccuggaccgcgggcucauccuccagcuacagggccaggaccuuuaugccauccgccugugucagugcaagguguucuggagcgggccuugugccucagcccaugacucaugccccaaccccauccagcgggaggucaagaccaagcuuuucagccuggagcauuuucucaauggugagggcccaaagcugugauccuccuggcugccucuugcccagggcaugguuccagccucugacuagggaccuugauuuugaugcagagcucauccuguuccaaaagggccagaccaacaccccaccacccuucgagaucuucuucugcuuuggggaagaauggccugaccgcaaaccccgagagaagaagcucauuacuguacagguacaucuccccuaucccaaagucggccuuggcuugaaaacuggggaauccuggggcuaggcccuugccccaggcuggaggcucagggcucccugagcagugugaacuuggcggccagagaccaucaaggcucagagccggagaaugcggucuauuacucaccccugauggcuguccucaugcacagcuggaucuggcagcccugccacaggucucccugucucaucuccucuuugccucccagguggugccuguagcagcucgacugcugcuggagauguucucaggggagcuaucuuggucagcugauaguauccggcuacagaucucaaacccagaccucaaagaccgcaugguggagcaauucaaggagcuccaucacaucuggcagucccagcagcgguugcagccuguggcccaggccccuccuggagcaggccuugguguuggccaggggcccuggccuaugcacccagcuggcaugcaauaacaaggcugcagacggugacuggcccuggcuuccuggguggcggugcggacugauguggagaugugacagccccgaugagcaccuggcuggcugcaggguccuaccucuggguuuccuggaaguggauuugggccaagaaggagagggagaaaggcccgagccccugccuucccgggccuuucucuccugggcugucucuggucuggucagccuggcucucgggaaauucagccaugagcagggaaagaacucucccaacccuggggccuagcuguauaggaggaauugccuaaggguggcccacucuugugauugccccauuuccucuggcaacaaaagccagaguguugugggccaaguccccccacagggccucugcagggcauggcccugauuucccugguuugagacucacuuccucaucucccuguccucugagauaauaugagugagcacuuagguaucauaucagaugcucaaggcuggcagcuacccccuucuugagaguccaagaaccuggagcagaaauaauuuuuauguauuuuuggauuaaugaauguuaaaaacagacucagcuguuucuuuccuuuuacuacuaccaguugcucccaugcugcuccaccaggcccuguuucggaugccaacuggcccacuccccaagcacuugcccccagcuugcgaccauuggcacugggagggccuggcuucugggcugaugggucaguugggccuucauaaacacucaccuggcuggcuuugccuuccaggaggaagcuggcugaagcaaggguguggaauuuuaaaugugugcacagucuggaaaacugucagaaucaguuuucccauaaaagggugggcuagcauugcagcugcauuugggaccauucaaaucugucacucucuuguguauauuccugugcuauuaaauauaucagggcagugcauguaaaucauccugauauauuuaauauauuuauuauauugucccccgagguggggacagugagugaguucucuuaguccccccagagcugguuguuaaagagccuggcaccuacccgcucucacuucaucugugucaucucugcacacuccagcccacuuucugccuucagccauugaguggaagcugccccaggcccuuaccaggugcagaugcccaaucuugaugcccagccaucagaacugugagccaaauaaaccuuuuucuguauaaauuacccagccucgggucuucguuuacagcaacgcaaaauagauuaaacccccauaaauguucaaggauaccuugccccacagccucguccacagaauauauugucacuguuuggauuuuugccaaccugacaggugagauaguaucucagugccacuucucauuaucagcaaggcugaguagcuuuucacaugguuaaguggccuguacagauuuuuuuaaauaauuuuagaaugguuuuagauuuauggaaaaguuccuaauagaguuccuauggacccacacuuucuccaauuguuaacaucuuacauuacuauggcacacuugugacaauaaugaaaccauguggacaauuacuaugaacucaacuucuuuauuuggauuucaugaguuuuucggauauccuuuuucuguuccaggauacuauccaagauaucacauuacauucacuugucacaucuccuuagacuccucuggucuaugacaguuucuuagacuuuucuuguuguuggucuugaugguuuugaggaauacuggccauuuuuuaaagcaugucccccaguuugggcuuaucugauguauuucucauuuguuuuuagagauagggucuuuguguugcccaggcuggagugccauggugcaaccuugaacuccugggcucagaugauccucccacguagcugggacuacgggugcacaccaccacaccuggcuuuuuuuuuuugagaccuggucucaauauauugcccaggcuggucucaaacuccuggccucaagugaucuucccaccguggccucccaaacagcugagauuacaggugugaaccacugugccccgccuguuucucaugguuuuuguauggaagaccacagaggugaagcaucauucccacuacaucauaucaagggugcauacuauuaaccugauuuaucacuguuucugacugagguagugauagguuccucuaucauaguuacucuucauccucccugaucuauauguacacagguaccgugguuuuaguauuauucaccugcauccucuuaaacuucaccaacuagaguacagugauuacguagugcuccuuuugucuuaguuuucaaucauuuacaaaggugugcaccuuuuucuucacaggccugugcaguucuacucccucuugcaauugucaauguuuugagauuaggagaagggagaugucacauaucugguuuccagcuucuuccaaaaaacuggcaaauaugaaaacacugucauacauuccucaaaggcaaaaaucagcuggaacucuggauggggaauguucucccaguucaauacgguccucuccuggccugcuuccuuucacugcucuccgugucccuaagggcauuugaguuugcaacccuugaugaaugguggagcagggagacugaguguagaugaauuggggaagcuuggaagggccaggugccccucgcgaccacgagugggcugacuuccccaguacugcuagcaguugaguaacugccaaaaaucuucccugaauuuguauuaauugguuuccuaaaacuaaaaugaaaacagcaaugaaaaccuggcugucacuuacagaucucuguguuguaguagccagcuguggaugaacaguauccagaagugacagauguaacaaacuccagagguaaaggcaggccagugugagguacaauucacugcucccaagccaggcuagggcuccccuugguaauagcuuuuggcugcucugguggccugugcuggagcuuaaguuggaacccacaggaccuugaugcccacauccuggggaugaaugcaucccuuuagccccagcaguuucucucccuucuuucaagcuccuuguccccaccaaguucauccuuauaaccaacuaaauauacccuuuuuaagacucucagcucuuugacauaaagaaccuacccuggccgggugcaguggcucacgccuguagucccagcacuuugggaggccgaggugggcagaucacgaggucaggaguucgagaccagccuggccaacauggugaaaccccaucucuacuaaaaauacaaauauuagcuggucaugguggugggugccuguaauccuagcugcucaggaggcugaggcaggagaaucgcuggaccccaucagacagagguugcagugagcugaaaucccaccauugcacuccagccugggcaacagagcaaggcucccucucaaaaaaaaaaaaacaaaaaaacaaaacaaaacaaaacaaaacaaaaggaaaaaaagaaaaaacguacccuuuucagucucuguagaguagaagauaucaauggcuuuucccauuuuugcugaaagagcauucuuggaaggcaauguucucauuugcugguaaucuaucccaaagaaucaggcacaucuuguugcaaaaucuugaaccuuuaaggucucuugguuuuggcuuucaucuuaugauucacuuaaaucagggccacacaagguagacauuuaaauaaacucaugaauguugaugccauucaaaagcacaguuuccuuuaugucuuaggugugcauucucaguuacuguucuuuauaacaauucccuucagauacauaaggauuacaaguuacuguguuuuaguacagucuugcuggaaauagccccaaugcugaugaucuguguuccacauaaucauggccaacauuucauggcuaauccuaucacggaacagacaauucuguggggagaugacuuaggcaaguucaggugcaguuagcugaccugcccacauggacgggagauacucauccuauuucuacuagacaaugccaugcagaaacacagcaucuccauuaggugagcugauccugaacaguuccuuuuuaaauuaaaaucuagaugggcauccuugcucugccgaaaguuucagagcagcccuuucaaauaaucuguaaggcuuaaguaagcagugagguucugacaccauuaacaacacagggcuguuugcaaagcuauagcuuuagauaugcauuccacaugcuguuuuucaguggcuaaggagggcugcauuaagucuuccacacauuuuuuucaguuccccacacaauugccugugaaaacagccaaauuccuuaaacagagcaaaaucaacugguuauuucaaggaccuaugguuggacaaaacuuaaagguuuuauuauuuagccagaacaugagagggauggcugggguaaugugcugaucccuggaaucugauaucacucuauaaacacucaaguuuuuuucucuccuucuaauauugccucuuuagagauuaaaacccuguguaccacugauguuaugcuggaagauuuguuucaccaauuccuauuguucuguagcuugaggauuuaugcccaggagugaaaaaguuaaagugacaggcaaagaaaaggcagagaagugucaguauaucaacaacacugccagaucuaucacauuagaauacagcucugcagguauuagcucaaagcccaauugccauaacagacuguuaugauuccauuuauuaaaaacucaggaaaaugcaaacuaaucuacagugauagaaaacaaaccagugguuauguggaaauggggauggaugggaagagggaggaaacagguauuaccuagggguucaaggaaacuuuuggaaauaaagaguauguucacuacccugauugugauaacgguuucauggauguaucuuaugucaaagcuuaucaaaguguauaccuuaaacacaugcaaauuauguuaaugauacuucaauaaaguuuuuuuuuuuaaagaccaauaaaucugcaggucaggaaacugucuacuuggguggccauaguagaaaaaccauaccacacuguuuaacugaaagaguaacccaacucccuuucccacugaggcuacacaaaaggguaaaauguaagcgugaugagcuuuggugugaauuaggagaauaaaaagugcagaaugaaccacuucccugaagucugaagggucuguggcaucagggcaggggccugcccuuucaacuccauccccagaugucuaucagguaccaaaggcugcuuccauagcuagucuagcugaaccauuuccgagcuacaaggcagugaaugaaaguaaaaacaaagaaacacugguuaaauuuuaaaaauuuauucuuucucuuuuguugcuguugauuuguucuugagauggcuacaacaccagacagaacagugcccucauaucugauggcugugaagggcugcacuccuuugaaacauuaagaucugcuuugggcuucccucuucggccucacccuccccuuaaaaucaagucauuuccacacuuuuuaguaacauacuaaaugacacaucaucccuuguuagcccuguaaacauuuuuucuccacacacccucccucuuuuuuucucucaugucugugggugaauaauucacuaagaaaaaaaccuuaaaaaacaaaaacuuacacauuuauauccugcacuccccacccacccgcccaccccaguuuuggcucuucucuccaaggcagacaacaaacugauguggauuggaaguggacugagagaaugaacggggucaggguucagauauccauaaauucugacccuggcaggucccgagcaucaccaaugugaccacgauagaaagcagaacaaguuccuugcuuacuccuccuugucuaaacaacucuaaaggugggaagaaacagcuggggaagguagaagaaauuucuacucauuugcauuuaaaaggaggggagagagaaagagaaggaaggguaggagaggaaagagaggacaaaacaauagaaaaccugaacaaaugacccugacccucuucuuccaauugcagcuauuuaauucaugugaauccccacauuaucccuaaguaaauauuuuguuucacagaaagcuuguccuuuuguuuuucuguguacacgugcgcacuggcgcuugugcguguaugugugugugcgugcaugugucauuugcuaccaggugaauguuucaguucugguuucuguuuagucuuccuuuuuuuucuuuuuucuuuacuuaaaauuauuuuuccuuuuagaaaguucaccaggaaaccagcuccccucccaccacgccgggcaggccacagccaucuuuuuaaaauccgcgcugauuuucccucacacccccaaacaggaacuccucaggauggccucagaaggcuggagucucucccugucuggcgggacacccugguggcggugaaggccccucugccacaacggagguuucugauugugggacacagucugguuuuuguuuucuuccugucuucuaauuaaaaaagacauuccuga

SEQ ID NO: 14564 - RNA, 3280 nt, Homo sapiens
ucaacuuggcuucugccccaauccuaucugcaagugcuuuggugucaaacacuucagccaaauguuuaacugaaguguccuugguggggagcccauagaaauggaucaaaaagcuccuugaggccgggcgcgguggcucacaccuguaaucgcagcacuuugggaggccaaggcggguagaucaccugaggucaggaguuugagaccagccuggccaacauggugaaauccaucuccacuaaaaagacaaaaauuagccgugugugguggugggcaccugugaucccagcuacucgggaggcugaggcuggaggaucgcuugaacccaggggguggagguugcagugagcugagaucacaccaccgcacuucagccugggcgacagagcaagacuccgucucaaaaaaacgaaaaagcuccaugaauguuagaacuauaguuaugugcuacaaugauguuuuggucaaugauggacugcauguaugacagugauccuaugaguauaauagagaugaacaacugcauguugcguuacucacaugcuuguggugaugcugguauaaacaaaccuacugcacugccagucauauaaaaggacaacacaaacaauuaucuacaguauacaauaauugaucauaagcaacuauauuacuggguuauguauuuacuauacuacacuuuuuaucauuaauuuagaguauauuccuucuacuuacaaaaaaaaaaaauuuacuguaaaacagccucaggcagguccuucgggagggauuccagaagaagacauuguuauccuaggagauggcaacuccauguguguuacugcccuugaagaccuucuaagugggacaagauguaaaaagguggaagacagugauauugaugaucuugacccuguguaggucuaggcuaauauguguuugugucuuagcuuuuaacaaaaaaguuuaaaagcuaaaaaaaaaaaauaaaguaauuuuaagaauagaaaaaagcuuauaaagauauaaagaaaaaauuuuuuaaugagcuguacaauuuguguuuuaagcuagguguuauuacaaaggaguccaagaguuaaaaaaaauuuaguuuauaaaguaaaaaaguuacaguaagcaagaguuaauuuauuauuauuauuauuauuauuauuuugagacagagucucacucugucgcccaggcuggagugcgguggcacaaucucggcccacugcaaccucugucucccagguucaagcgauucuccagccucagccuccugaguagcugggauuacaagugcccaccaccacgccuggcuaauuuuuuaaauuuuuaguagagaugggguuucaccauguuggccaggcuggucucaaacuccugaccucaagugaucugccugccucggccucccaaagugcugggauuacaggcaugagccaccgcgccuggccaaggguuaauuuauuauugaugaaaaaaauuuuuuuauaaauuuaguguagccuaaguauacaguaucuauaaaaagucuacaguaguauacgguaauguccuaggccgccuauucacucaccacucacucacugacucaccuagaacaacuuccaguucugcaaguuccauucaugguaagugcccucauacagguauaccuuuuuuuuucucuuuuauacuguauuuuuacuguaccuuuucuauguuuagauauguuuggauauacaaauucuuaccauuguguuacaauugccuacaguauucaguacaguaaccugcuauacagguuuguagccuaggagcaauaggcuacacuauauagaccagguguccgguaggcuauaccaucuagguuuguagaaguauacuccaugacguuugcacaacaacuaaaccaccuaaugacacauuucuuggaacauauccccaucauuaaguaacacaugacuguauuuucugucucgguccuucugacguuugauauuucuuagcuuucuauuuauuuacuuuuuuaacugccaguauuuuuuagauucuguuuucuggcuucuaguccccaaauuccuauccuuccaccauauuucugaaagcuuuuauggucacuauuucucgagccccauaagauuacuagaggagugcugagaaaugagauccuuuugauccgaugaccugguagguaacagaaaauaaugaaacucugaugacuugacuagggauucaaccccuuacuggccucuaauuccaguaucaaugcuucccauguucaacaccuuuuggcuuugaagagccccaggcaagugacaaguagucauagaauaaacaccaagauggagaaauggaaaugauggcaggguuucuucuagucccaauuggucuuaguuaaugauagguucaucuggcauuuggaaagcaagaauguuauuuuagacugaaacgucccagcuuucuucaaguugaccaacuaaaaaagcuagggaauuggccaggcgcgguggcucacaccuguaaucccagcacuuugggaggccgaggcggauggaucaugaggucaggagaucgagaccauccuggcuaacaaggugaaaccccgucucuacuaaaaauacaaaaaauuagccgggcgcgguggcgggugccuguagucccagcuacucgggaggcugaggcaggagaauggcgugaacccgggaaguggagcuugcagugagccgagauugcgccacugcaguccgcaguccggccugggcgacagagcgagacuccgucucaaaaaaaaaaaaaaaaaaaagcuagggaauuaauuaccaguaccaugugaaaagcaggcuuggacuugcugaaaugaaacuaaaccaguucacccucucugccagaauggcaaacaaaguagcauguugaggcagguguuacggaccuuaaaaucaaaagggagacugagucaugcaugggacagaaaguucaagggcuuucugucuugucuacuacaggcauucuagaggaagagaauuacuaagaggggaugagcaaucucaaguccuuucucuagcaccucuacauuagcucuuacuucuguucauuucccaccacuauguuacauauguuacagccugcuauaggaagagcugcaaaacuuguuuagcaauggaagaucaaguaggucagguugguggugcaccuuauuuucccauaucacaggacaaagauaacagguuuuuuuuuucccccacagcacugcuuuacuuaggucucuuuuccuugccccaagauuuauccuaaauuaggaaaggauaucuau

SEQ ID NO: 14565 - RNA, 29602 nt, Homo sapiens
gcgagcuagagcaacaaaggagccgggucgccggcggggagaguucggggggcugcggcgcgcuggggcgaagguggcugcugggccgcgggcuggcgcgggggcggagccggagcugcacucgcacccccggcccgcgucuggccucccucgcggggcggggagguggcuuuaauggugggagagggaauggggcuggggauugggggcccaggggucuccuagggcugaagacaacuuggauugcgaggcuagggcuuggggagucgugcaucccguuccgggccuccgcagcccaacaugggccccggguuccaaaguuugcgaaguugggcgccgaggggccggggcgcgcggagcguccgggggggcccgggcccggauucucugggcgcacaggucgccugagccgccuccgcggccgccgaggucgugcguguggccggggggcuccgaggagcaggcgggggcgccggggcuuuugcugaguuggcgggguuggccauggccgcugcccgcccagcgcgggggccggagcucccgcuccuggggcugcugcugcugcugcugcugggggacccgggccggggggcggccucgagcgggaacgcgaccgggccugggccucggagcgcgggcgggagcgcgaggaggagcgcggcggugacuggcccuccgccgccgcugagccacugcggccgggcugcccccugcgagccgcugcgcuacaacgugugccugggcucggugcugcccuacggggccaccuccacacugcuggccggagacucggacucccaggaggaagcgcacggcaagcucgugcucuggucggguaagugcggcggagccgggucuggggggcgggaggugccgcgguaagaugggggcacccuuggaaagaacaggcucaggccugaguuuuggagagggcggggacagcacccgggagaguuggagggacagaucccgaaacuuugggggcagguuacgugcaggaugggacccucggucaugggaaaaggagggcaaggaaguugacgaagcgggucacaaagggccugagcuggugggugagcaaaggauggcggggaugaggggcccgugaggagguggcucuaagccacgggaaaagacauuuuguaagaagaggagaugcuccaccuauucuggaagcagggugccgggggauucaaggagguguugaagacccuggggaaauuggaguuggagaggaaaaggggagggaugacggaggaagagguuuagacauuuggagggaaggguagggggacaugaucgagugaaguuuugaaggaaaagaaaccucccuagugaugaauuauuaaaagguaaccagaaaguucuggaaaucuugauuugggagacaggaaugaagccuagagaacugugaucuugucuggcuuucacgggagauuucauucaguuugugcaucugaaaaaccggcccucugacgcaugcaggagguuaugaaggaauaagaccuuucuaacaguuauuuguguuuucuuuggaaauuugguuaccgaggcuggucagggcuguggaaggacgcuuaagucuggaguguugagagccuguggacacuuccauggugguuugaagucccaaagcccccucacuggaguggcagagucugaaaaacugcacacugaacccaaauguccuuccuuagcaguguggaguauacucucccccaccugucacuuuucuagaugaggcuuggagggugcugaggaagggagcuggccuuaucagcccucgcuucuagccaguaugauucuaaaacuguccugggaaaaagaaaagaaaaccaggagccaggagcagaacugggagccucccucuuuugacagggcugggguaccccaucucuuagcucugcccagggggcuggugaggacccuaauguagggaguguauguaggccgccugucauugacaaguucucggccuuugucagauguuggacaaggccauaagguuccuggcuuggugcagaugcuggaggaggaacuuggaggaugguauccaugguacccaugaggaagagcugcauccuuuuuggggaucagguucuaaagucagcacagcacauuagacagaaaucauguguaaacaacaguggcuuugaaaacucugcagauuaccauaguguaagguggaugugguuuugcauauacacuucuuuuacgauguuugcauacauguguuacauguauacucauauauaagaauggguauacauagaagauaaaauaauuguaauuuuaaaguuacauucaugcaaaagacugaaauaauaauaauaauaauaaaaagaacaccaaagugagauuaagcaagauugcuuugagcaccacccaaaaugagacuugaguuuaggagccagcuguguggaaaguccaaaucucucagcacuagaaucucacccaguucugaguugcucaugcugucagaggauaaucuuucugucccucucuuuauugauugugcaaggacccaugguuuaauuuucccaaguuaaaugcauguuugauguugccucuguguaguuaccaucagaucaaggaggaaggguaugaaccucuuuccagcccauacucuugagagcagcugcugagcagacagaaguaguuuaagcuggaacauguaucaauuaguaccaucugcagguugugcagguugaaaucucacuaucugugccuuuuggcagggcaggguccuacagagaugccagcacugagcccagcaccguuaguuccauuaguucacuaugaguucuucucugccaccaaccaccaucccucagcucauuccuguuuccauauguguucugguugcacucuuucugcuugggacuugcaaguagggcagaagcagguguuggcuugagcuggguaaugaguagguagagugaacccaagccucgugugagaaucacagccaggucagcugguagccucuggcaagugauuuaucaugucccgaguuaaugaucuugauuuugcauuagacagggucaguguuaccuggcucuuagggguguuuuugugggugaaggaugaaggugaucuagguugucuucaucgguaaacucuugaauguaggaacugggucuucacuuuuuuucaaagccugugaguacugaguacacagccaugcuucuauucaugcauucaguuauguauugaauguuugcuguaugucacaugcugcgcauguaaggaugaagaauacagauaugauccucugucaucaagaagacaggcuggacauggugcucacaccugugaucucagcacuuugggaggccgaggcgggaagauugcucaauaccaggaguuuaagaccagccugagaccuugccucuaaaaaaaaaaaaggaagacagauaauucaacaggcuuuggaaauaccugugaaagguacuguggcauuuuaggguacugaaaaagcauaaaggacccaaggaacaucccagaagaacuggcauuuaacccauaacuugacacauaagcaggaauugccuggccgagggagaguugagguuugaagggauaggaagaggaaauagcauguacaaagguguagagguaggagggcuuggugcuuugaaagaaaguauaagaguugcaguagaacuggaucaaagcgugugagggguggaauugugagagauaagaccuaaagaauuagaaaauaaagggauuuauaccucauauuaaguuuggauguuauccaggggaugauaaggagccauugaaagauuuuaagcaagggagagauguaauugucuuugcauuuuagcuggaucucuuuggguauggugugaagaagccauaggagcagggaaagccuggagccuggcuucuugaccaggggauguugaaguagcccaaguaagagacgauggcgguugggacuggguagcaggacagagggagugggcagaucccacuaacuuucagagguagugcucauagggcacugaugaguuagauguggagccucagugagcaggaggccucggguuucaggcuuggauggaagguggugccauucccuuucacuaagauagagaaugcuagaggaagaagaaguuuaggcaggagguguggcuuugauuuuggccgugugaauuagagaugcucauuggacaucuauguggagauucucagcagaucuggaaauaggaauugcuggagagagguggccacugugugcuuccuuggcccugacuacugaggcuuuggaaggaugccauugacugaggaaguuuauagcucagguugguccaauuucuaggucuguauagaccucaggucuuuccucugucuuucaucucucuggccucaggcuucuucagucacuuagcaucucuccccuuuacagcuggaaaugccuccucccgggcauuccaagcugaccagacaaacauaauguccaggccgugguccaccuuaggccaaaccugguuuaguaaguggggcaaaaaagcagagaggccugcagcuggcaguggcgauaggucccugagagccagcacguagccuccuuaaccacugcugugcucugugugguacauaaguguguggcccugucaccuugcccacuugcagguaaguaggagagagacaaaggcugggaggaauuucuuguuugccucucacacauugaauugagggcugagaggaggaauguuuuuggugaugguggguuauuuucagggacggaucaggaagaauuuccuuagagcuauuuccaaacuuggcugguaaucagagucaguuaaaaagauauauauggccgggcgcgguggcucacgccugcaaucccagcacuuugggaggccgaggugggcggaucacgaggucaggagaucgagaccaucccggcaaacagggugaaaccccgucucuacuaaaaauacaaaaaaauuaguugggcaugguggcgggugccuguagucccagcugcuugggaggcugaggcaggagaauggcgggaacccgggaggcagagcuugcaguaagccgagaucacgccacugcacuccagccugggcgacagaccgagacuccaucucaaaaaaaaaaaaaaaaaaaaaaaaaaaauauauauauauauauauauauauauauauauguauaggcugggugcaguggcucacaccuguaaucuuagcacuuugggagguugaggcaggaggauuucuugaagccaggaguucgagaccagccugggcaacaaagugagaccccaucucuaaaaaaaaaaauuagccgggcauguuggcacacaccuguggucccagcuacacuggaggcugaggcaaaaggaucgcuugaacccaagagguugaggcugcagugagccauccucacaccacugcccuccagacugggcaacagagcaagacccugucucaaaaauacauacauacauauagauauguguguauguauacacacacacacauauauguauagugaaaauguaaaauacagaaaaacauacauggaccuaagucuuuuuuaaaaaaaaauuaucuuuaauuaauuauuugagaaauggggucuugcuguguugcccaggcuggagugcaguggcuauucagaggcucacucauugugcgcauggugcuuauggugccuggaauagcuggcacuacaggcauguguucugugccagcucaagucuucaauuuugcuucagaucuuuaacuuuuuaauugugaaauauaacuguaugcagaaaacugcauaaaacacaaagguacugaauaacaaauaauuauaaagugacaucugggucaauaacuagaccacagucagaccccugaagcucccucugugucuugucuagucacaucccccuccccuugcucaagagguuuucaguaaucacauccuuuuuuucucuaugguuuuaccuccuaguuuuggaauccauaagcaguauauuucagcuuugcauguuuuugaacucuguucaaauggaauuuguacaaaauaauaugcugugcauauuauuucuugcuucuuuuacuuuauaucauuauguaagauucauccauguuauugcagcuuauuucuuuuuugcuuguuuauuuguuuguuuuuguuuuuuugagacagucucacucugucaccuaggcuagagugcaguggcgcgaucucggcucacuacaccuccaccuccuggguucaaacgauucuccugccuccgccucccagguagcugggaccauaggugcacgccaccaggccuggcuaauuuuuguauuuuuuaguagagacaggguuuugccauguuggucaggcuggccucaaacuccugacuucaggugagccacccgccucauacugcagcuuauuucuucauugcugaauaauauuccauuauaugaguauacccccaguuguuuacccauuuuauugucaucucaaguuuuugcccauugcaaauaacauugcugugaguagucuuuuauguauauccuaguacaacuggcacaaguuccuucagguauaugcugaagaaguagaauugcuagauaauaaggcacgcauacuuuaggcuuuugccaaaccauuuuucaaagugguuguacuaacuuauacucccacuagcuaguagaaagucaacacugguucacaugauucccaacauuugguauuaucagccuuuuacauuuuugccaaucuaguggcuauauuguggcauauauuugugguuuuaauuugcacuucccugauuacuaguaaaguuaaaugccuuuuuaaaugcuuacuggccuuuaggguuucugcuuuugggaagugucuguucaaaucuuugacauauuuuuccauaggggcuaucugucauuuuuguaagauuuguaggaguucuuuauauaugcuagauaugaguuuauaggauuacaaaggaaaucaauuauauugacauaauaguuaucaaauauaaaaaugcaaguaugugggcuuauuuauuuauacaauaaauaagaucuggugcagguguaauaacaacuauaauaucaaagugauuauaagcauugacauuauuucaagauaucugcaacaaaaauaucugguuuccacuugugacaacgccacagguacuauuaacauuauguacugugggccaggcgugguggcucacaccuguaaucccagcacuuugggaggucaaggugggcagaucacgaggucaggaagucgagaccauccuggcuaacacggugaaaccccaucucuacuaaaaauacaaaaaauuagccgggcgcgguggugggcgccuguagucccagcuacucgggaggcugaggcaggaaaauggugugaacccaggaggcggagcuugcagugagccgagaucgugccacugcacuccagccugggugacagagugagacucccucucaaaaaaaaaaaaaagaaaagaaaaaaaaaacaaaaaaaaauuauguacugcgauguguugcuuacauucauaauuggaggaagggccaaauuuuaguuagguguaauuuuuuucccauugaaauucauggaccucugaauuuuuccaagaauccuuugugaaccauaggguaagaauguuacuuacagaauaucacuaucuaguagagagucugagcuauucuugauuguguguguguguguguguguguguguguuuuaauagagacaggguuugacccuauugucccggcuggucuugaacuccugggcucaagugauccuccugccuuggccucccaaaaugcuccuuuguguuuuaauauaaaaauacuuggugauuuuuuauugggauugcauugacuauauagauuaacuuggaaaaaaaaagagacaucuuuacaauacugagucuuccaaacauugaacauuuauauauuucuauuuagaucuuucauuuucucaauauucugcacagauuuaaauacuuauuauuuguuagacauuccuagguacuugauauuuuugaugcuguuguaaaugaugccuuuaacauuuauuucacuuuguuuguugcugacauauagaaauaaaacuggcugggcacgguggcucacaccuguaaucccagcacuucgggaggccaaggcagggggaucacgaggucaggagauugagaccguccuggcuaacauggugaaacuccaucucuacuaaaaauacaaaaaguuagucgggcaugguggcgggcgccuguagucccagcuacucaggaggcugaggcaggagaauggcgugaaccugggaggcggagcuugcaaugagcccagauugugccacugcacuccagccugggcaauacagugagacaccgucucaaaaaaaaaaaaaaaaaagaaauaaaauugaugccuuuaacauuuauuucacuuuguugcugauauauagaaauaaaauugauugugaauucaguaaacuugcuaaauuuauucuauacacauagucauauaauuugugaguaaugaguuuuguuucuuucuuuccaagucuuauaccuuuuauuuauccuuauugcuuuacugaaggcuuccaguacauuguuaaauagacaaaacaucuuaauucuugacuuuucuggauucuaaaaagaaagcuuuuucuacccuucaccauuaaauuugauguuugguauagguuuuuuauaguuaauuacauuuuaucagauuaagaacguugucucuuauuucaaauuugccaauuauucuuuugaucauagauggauguugaauuuuaucaacuuuuuuuuuuggagacgaagugucacugucaccgaggcuggagugcagugaugcgaucucagcucacugcaaccucugccuccuggguucaagcgauucuccugccucagccucccaaguaucugggacuacaggcgcaugccaccacgcccggcuaauuuuuuguauuuuuaguagagacgggguuucaccguguuagccaggucaauuuccugaccgugugauccgcccgccucagccucccaaagugcuaggauuacaggugugagccacugcgcccggcugaauuuuaucaacuuuuuuuugcauccauugagaugaucauaugauuuuuuucuccuuuaaccuguuaauguaguaaauugcauugauugaauuuucuaauauuaaaccagccuuagaacagugauacucaacuugacuagucaucagaaucacacaaauaaaaagucuuuuuaaaagucuagaucagccaggcgcgguaacacccguauuccuguuucucuuuuuguuucauauuuuauuaaaauaaaagaaguaaaauaauacugauaaagcugauauccccucucuuucucguuucaguuucauauccuucuuuucucuuuggaaagcuuccccauccuaguaauuuguguauuucuuuauuuuguuuuuaagcucaaguuuuguuuuuguuuuuguuuuuguuuuuuuguagagaugggguuuggccauauugcccagguuggucucgaacuccugaacuuaagugauccacccaccuugggccucccaaaaugcuaggauuauaggcgugagccaccauguccagccuuaagcuuaauuacuuuuaaaaaauagguuauacauguacauggcacagaauucaaaaggaacaaguuaaguccuacuucugcaucuagcuacccauuuuuccucugcagaaguaaccaccaacacugguuuuuguguccuuuuggaaauauccaacaucuguccagauguagaugugcucucagucucuccucuaccgcccaaccaguaccaugcucuauagacugcucuccacucaacugaguccauguaacaugacaacauuggacaucauuccauuucaaugcacauccugucaugcaccccagaaggagauuuugguuaacaauggaccacaugugaugguguucccuuaagauuauaauaccacauuuuuacuguagccuuucaauguuuagauauguuuagauacacugauacucaccguuguguuacaguugccugcaguauucaguauagcaacaugcuguacagguuugcagccuagaagccauagguuauacuguaucagcuaggugugcaguaggcuauaccauccagguuuguguaaguacacucugauguucacacaaagaugacauugccugaugacacauuucacagaagauauccucauuguuaagcaacaugugacuauaucucaacccugaauaguguucuauuauaaugguguacauuauuuuacuugguuggucuccuauugauggauauggauucaagcuguuucuacuuuuuugcuauugcaaaacagugcugcaaugaauaaucuauauuaucuuugugaacaugugaaguagaaguacuaguauaaaauuuugguagauaaugccaaagugaucuccacaaguguuuacuaauuuuuauuccuaccaacaaauauaaaagugccaguuuaucccuacacucuuuauaguacgguauuuucuuuucuuuuuuuuuuuuuuuuugagauagaguuuuguucugucacccagacuggagugcaauggcgaucucggcucacugcaacauccgccuccuggauucaagcaauucuccugccucagccucccaagaagcugggauuacaggcgcccaccaccacaccuagcuaauguuuguaguuuuuuaguagagacggguuuucaccauguuggccaggcuuguguagaacuccugaccucaggugguccaccugccucggccucccaaacuguugggauuacaggcgugagccaccaccaugcucagccuucuuuauguuuuuaaaggccauuaaauggccuugaguccaggaguucaagaccagccugagcaacauggugaaaccuugucucuacagaaaaauacaaaaauucaccaggugugguggugugagccuguagucuuugcuacucaggagguugaggugggaggauuaacugaaccuggggagcugaaggcugcagugagccgugauuaugccacuguacuccagccugggcaacagugugagacccuaucucaaaaaauaaaaaaauaaaaaaaacauaaagagauguucgaccucacucuuaauaauacaaauguggaauaaacuacaacgaaauauucuuuuuuuaaacuuuuauacuuuuuaucacagugauaaagaucaaaacauuugaaaaugugaucuguuauuugucuuucgccugugugucuauagaauuaugcaauuuuuacugauuuggaggagcuuugugcauauaaggaaauuagcucuugugauaaguauugaaaauacauuuuuucaguaucuuacuuuucuuaugauuuuuguaucgauuuuucugaagucuuuuguuuaaaucuuuuauuucaugauguguaggcuuugugucauuucagaaggccuucuccacuccaagguuuaaaaaaucauuuccuggccaggcgugguggcucacgccguaaucccacuuugggagaccgaggcggguggaucacgaggucaggagaucgagaccauccuggcuaacacggugaacccccgucucuacuaaaaauacaaaaaaaaaauuagccgggugugguggcgggcgccuguaaucccagcuacucgggaggcugaggcaggagaauggcgugaacccaggaggcggagcucgcagugagccgagaucacauuacugcacuccagccugggcgacagagcaagacuccaucucaaaaaaaaaaaucauuucccaucuuuucuucuaaaacuuuaauuuuuagaaaaacaauguaguuauuuuuuuauccaucuggacuuuuauguaagaaaugggguaaagcuccaccuuauuuuuuccccagauaauuucuuaguuguccuugaagauguauuuaauaaucucucuuuuuccuggggaguuuuauuuuuaagguaugaaacaauauucacaaugagggaaaaaaaggaaaacaaauuagacauuuuuaaaaccugauuguuaccacagauauaaaaagauugagaaaaauuacaguuuuuuuuuuguuguuguuuguuuguuuguuuuaaugagucuugcuguaucacccaggcuggaguacacugucgugaucuugacucacugcaaccuccaccuccuguguucaagcaauucuucugccucagccucccaaguagcugggacuacaggcguggaccaccacgccugguuaauuuuuauauuuuuuaguagagacaggguuucaccauguuggccaggcuggucucaaacucccgaccucaagugaucugccugccucagccucucaaagugcugggauuacaggcaugagcuaccgcaccuggcugacacaaccuuuauuuuuuuuauuuuucgagacggggccuugcucugucgccuaggcuggagugcaguggugccaucuccgcuuacugcaaccucugccuccuggguucaagugauucuccugccucagccuccugaguagcugggauuacaggcaugugccaccacauccagcuaauuuuuguauuuuuaguagagacaggguuucaccauguuggccaggcuggucucggacuccugaccuugugauccacccgccucggccucccaaguucugggauuacagguuugagccaccaugcccagccgacacaaccuuuuuauuaacugccugauguuucucuaaagcauuuuacuccagagagguccccccauuuuaaauauauugugcaauaaaaguaaacauccaguaaaauugacuuuuucuuguacaguucuaaguuuagacaaacacauagacuuauguaaccagccaccacauugaauucaagauagagaaucguccuuuaacccccauauauucucucaugcuacuauuuuguaggcaaauccugcccucaccccaaucccuggcacccacugcucuguuuucugcaaguaccuauguacucagaauuucuggugacuguuuuuggguuuuuuguuuuuuauuuuuuuguuuuugaggcagagucucauucuuuugcccaggcuggagugcaguggcgccaucucagcccaccgcaaccuccaccuccuagguucaagcaauucuguugccucagccucccgaguagcugggauuacaggcauguaccaccacgaccggcuaauuuuuguauuuuuaguagagacgggguuucaccuuguuggccaggcuggucuugaacuccuagccucaggugaucugcccgccuuugccucccaaagugcugggauuacaggugugagccacugcgccuggccaacuggugacugaauugagucaagugggaacuguugccugaggacauugcuucuuaacuggcaggaacuugcucugcacccuggaauauacucugaaggcugggagcagucagaggccucagacaaauaaucauaagaguuaacauuuccugagcgcuuacuacaugacagguacugugccaagggcauuuaaagcauuauaucacuuuucacagcaguuccaugagguaaaucuaucauccccauuuuacagaugaggcaacugaggcuaaagauaaaguacuuugcccaagaucauacagccaggaaagaguggagccaagauuuggacccaggcugggcaguugccaugcacaugccccuuaccucucuacuauguugccuucccccgaaaagagugguuaccugucucuaccacccccagccuggaaaugugaccggcacccauguuggcucucacauccucauauucucuccuaaugcaacuucuugcuugggaaauagauauugcugaagcaggguugauucaggaagggcuucugugaugggcagggcggaggacuaggcuggggacgggugcugggagauugccgccuguuucugucuugcugacaacauuuuuccccucuccgcacuggacagagccucuucuguuccucuccaucugacuuccugcuuccuccucuggcuuuggagugccuggcuccucugacuaccucuucuuaagcccccaucucuucucucucacuccgcuugguaagaggaacaaggguucuggggucugggcaaagggaaacaucuccuggcucuagcaaaugggccccgugagaguugggugcaccccugaaaagguaaauccaccccggggagcucuaccagaggcauuaccacucccuagcagggcaucuggaaguggcaguuauuuucuuaaaacuuaaaugauaguaagcauacagaauagcgcacagaucaugagcuugguuuccacaaggugaauacacucauguaaccaguaucagaucaggagauagaauauucccaacaucccauguaaccaguaccagaucaagaaguaaaacauucccagcagcccagagguuccucuccaggcucccuucuagucaccgucccuagaguagagggcuggggcauuuuuguuugucacaaucacuucuggguucuacuggcauugaguuggcagagucuagugucugcaaugcaugggacaguccuaugguauaaagaacuguccugcccagaugcacuguugagaaacacuguaccugccaggucugaccagugaugggcugcaguguggcaaaggccuggaggacaggggugaagcugcgucugugggucagagugaggaggggccuucacugcaaugcuguugccacccccaggccuccggaaugccccccgcugcugggcagugauccagccccugcugugugccguauacaugcccaagugugagaaugaccggguggagcugcccagccguacccucugccaggccacccgaggccccugugccaucguggagagggagcggggcuggccugacuuccugcgcugcacuccugaccgcuucccugaaggcugcacggugagugcucugugagacaagguccaggcucucuggguugggcaggaccggguauagggcaggguccaguggggagcaggggagcccagagcuuugucuccuggagacccugagccuacagccauggggucaacaggacacaaacucaaacugcagcucacuggcuggauccgucuauuagggauucucuauuuauuuaucaaugaucacauguucagcaaaauguuuugagcacuggcuguuggguguugugguguuacgggcaucacggaugacaggagccuaucaggaaguuucucauguauguugggaguuaaggcgcgagcgugugaaacagcuagagccaccaagacaggggacgugagcuaguucuggguggugcaggagaggucuucaaugaaaauaauaacaguaauaaugaugguaauaauacuaauuaguccuguuuacuauaugccaaaugccauuauaauaagcucaugccuguaaucccagcacuuugggaggucgaggugggcagaucaccugaagucaggaguuccagaccagccuggccaacguggcaaaacccugucucuacuaaaaauacaaacauaagccugaugucauggugugcgccuguagucccagcuacucgggaggcugagacacgagaaucgcuugaacccgggagguggaaguugcagugagcugagaucgugccacugaacuccagccugggcuacagagugagacucugucucaaaauaaauaaauaaauaaauaggcuggccagacacaguggcucaugccuguuauccccaccacuuuggaaggcugaggcggguggaucacuugaugaggucagaaguucaagaccagccugaccaacauggugaaacuccgucucuacuaaaaauacaaaaaauuagccagacaugguggugggcaccuguauucucagcuacuugggaggcugaggcaguagaaucgcuugaacccgggagguggagguugcagugagccaagauugugccauugcacugcagccugggcgacagagccagacucugucucucucuuucuauauauauaauauauguuuauucauuuaacccuuaaaccauaccauaagguaaguacuaccaucuuagaaauggggaaacuggccgggcgcaguggcucacgccuguaaucccagcacuuugggaggccgagguggguggaucaugaggucaggaguucaagaccagccuggccaaccuggugaaaccccgucuaaaauacaaaauuuagccgggugugguggugggcgccuguagucccagcuacucgggagucugaggcaggagaauugcccgggaggcagagguugcagugagcugagaucacgccacugcacuccagccugggcgacagagcgagacugucuaaaaaaagaaagaaaaaaagaaagaaagaaguggggaaacugagguacagagaggccaaauaauuugccaagccagcccugggauucagguccuggaaguguaucuccagccacccugccaugcuaccuagauaccuuucccuaaacaagaggcucgucccugagcugccuugacaccgucuuuucccaucccuggugccagaaugaggugcagaacaucaaguucaacaguucaggccagugcgaagugcccuugguucggacagacaaccccaagagcugguacgaggacguggagggcugcggcauccagugccagaacccgcucuucacagaggcugagcaccaggacaugcacagcuacaucgcggccuucggggccgucacgggccucugcacgcucuucacccuggucagccgcgggagggcaggcccggggggcccucagccuggaacgugggaagagagccagagggaaggggggcaaagaggucuugguggggguccccagggaagggucaugaucagaagggucuggggcucaguuaagggugucugugucagcagaauaacccuaaccucacagaauggcccacuucucucuucuaggccacauucguggcugacuggcggaacucgaaucgcuacccugcuguuauucucuucuacgucaaugcgugcuucuuugugggcagcauuggcuggcuggcccaguucauggauggugcccgccgagagaucgucugccgugcagauggcaccaugaggcuuggggagcccacguaggugucuuggggacccagaggugaagguacagggaggaaggcugaagugugcguuuaccccaaagggagcaggugcguguaaaaccgagauccagggcaggaucuggcucugcccuacugcauacugcaugcaagaucuccaguguuaggaucuuaguuucagaaucaggaccuucaugguuuguaucugcucaaaggggcggcuccuagagccuccucagaucugaccuggguccugucuccaagcccugacuucugggaaccuccagaccucagcagcugagggucugggcacaggguggggagaccagguagagggaguacagagugaccgccucaagugacaccucaccucucugcacagcuccaaugagacucuguccugcgucaucaucuuugucaucguguacuacgcccugauggcuggugugguuugguuugugguccucaccuaugccuggcacacuuccuucaaagcccugggcaccaccuaccagccucucucgggcaagaccuccuacuuccaccugcucaccuggucacuccccuuuguccucacuguggcaauccuugcuguggcgcagguauagugacugguaggaacgggagaccuggauggggugaguuugagggagggggccaguaacccaccuucugucccaccccuuccugcugcagguggauggggacucugugagugggauuuguuuugugggcuacaagaacuaccgauaccgugcgggcuucgugcuggccccaaucggccuggugcucaucgugggaggcuacuuccucauccgaggugagugaagaccaggccaggaccaguugggcaacaaaauauacugggcacuugcugccaguacugggagcugccagcacggcugcccccaugcugaaaccccagcuagcuccuauagggccuucacacaguagaaggugacccucuaggcagacgaaacaccgugagcacuugcugcgggacagcaccuuuguacuggccagaaaaauccaucccucucuccagggccuuggcccagggcucacagcuuguuuuuuuuguuuguuuuuguuuuugagacagagucuagcucuguugcccaggcuggagugcaguggcacaaucuuggcucacugcaaccuucgccuccuggguucaagugauucuccugccucacccucccccauagcuaaaauuacaggcaugcaccaccacgucuggcuaauuuuuguauuuuuaguagagacgggguuucaccauguuagccaggcuggucuugaacuccugaccuaaagugauccaccaccucagccucccaaagugcggagauuacaggcaugagccacagugcccagccucacagcuuguuagguggaguugggucaggauccagccccagucagcuccuggccggugcacuugugugaugaacacccugaguaaccuacucugcccacuuggaccaaccuaggucguuugguuaucugugugcacauuaauucgauauguacugucaaucuucuggagcuugguuuucaucuucuuucuguccccggcacacacagcucucacagcaugcguggaauuaguggucccuaacuuuccugucucaugcugccaucccauaguaagccucagcaucuauuuagcucauuguuguuggguuuucuuuguaaaccucaguuuccucacccugaacugccagccuucuguucagucaccucuuuccccucuuuuuggcauagugucuggcccucugauuugugcuucguuaucaugcuguccuaguaugguaaucacuagccacauguguugaacuaguccagccugggugcggcggcucacuccuguaaucccaguacuuugggaggcugagacggacggaucacuugagcucagaguucgagaccagccugaacaacauagugaaaccccaucucuacaaaaaauacaaaaguugccugggcaggguggcacaugccugugguccuagcuaugugagaggcugaggugggaggcuugcuugagcccaggagguugaggcugcagugagccaugaucuugccacugcacuccagccugagugacagagugagacccugucuccaaagaaaacaagacaacaacaaaaagaaacaaguccaaauugagauguguuguaaaaugugaaauacacacuguauuaaaaaaaaaacuuagugggaaaaaaauguaaaauaucucauuaauaauuuguuacauggauuacauguugaaaugauuuuauuuugaauauauuagguuuguaaaauauauugauauuaguuuugcuuguuucuuuuaacuuuuuuuaaguggccacuagaaauuugccauauguauguggcucacauauuucuaugggaaggccggcaugguggcucacaccuguaaucccagcacuuugggaggccgaggugggcagaucaccugaguucaggaguucaagaccauccuggccaacauggugaaaccccaucuuuacaaaaauacaaaaauuagccggcgugaugguaggugccugugaucccagcugcuugggaggcugaggcaggagaauugcuugaaccugggaggcggaguuuacaaugagccgagaucacgccauugcacuccagccugggcgacaggguuccaucucaaaaaaaaaauuauauggauagcgcuguucuugagucuguuuuaugucuuucccaucagaacagcuuugaucugcccccuucuucaggggcagcugggccacgaccgaggcucccucuucucaagugucugucuaggcucugcccuggucuucucaccauuucuccagugucucuagcuccccagguuuucauuuagcacagggguaaucagacuugggacuccagagccuuaggacccuccucccacucacccauccuucccagcagggcagccucaccccugcuaaugucugaggucccccuucuguucaggagucaugacucuguucuccaucaagagcaaccaccccgggcugcugagugagaaggcugccagcaagaucaacgagaccaugcugcgccugggugaguggccccgggggacuucggucugagguccuggccagcccaacacugcacccuccuggggcuaugcgaccggcaggaugcaguaagucagugggacaaguuagccauagggacaaggacaagggguguguguaggugguagugguaguggcagcucaaaagaagggggucuacucggggggaagaauucagucaaguucaugccgggacugguuccuccugcccacuacgucccacguggucccucccacaguugcuucaagugcccuucuuauuuuauuuuagagaaagcaguucuuggacugagcccagcaugaguucaccccagccccagcugggugaacuuugaggcccaguggggcagacucucuccuccccacugcugcugcgggacugggcuugguaacguccuguccugccccuguccuccacaggcauuuuuggcuuccuggccuuuggcuuugugcucauuaccuucagcugccacuucuacgacuucuucaaccaggcugagugggagcgcagcuuccgggacuaugugcugugagugaggggcauggaggcggcagugcugggagcuggagccaaggccauaaagacacccaccuccacccaccgggcagcagggauuugccaggucccugcugcagacagcagauucaauggauggugucugggugcauaaggcaucagucuccguaguuucucaaacguggcaaacaaccuucgcaucccuucucaccucugcccuucccucuccacccccuugguugcccagcuggugcaugugugacuguuaagcagccaguucagcuucgucuucucugacugacacuaaguugcccucuaauucugugugcucuccugcagagccugcuuuagauccuggcacaggacuaguuaccucucugugauagguuaaugaccugcuaauguuggcuaguuuuugccugugcuuuuuugugucauaaugaggauggauuggagagaguaagacauugcuacugcugagagaagcgcaguacccacuguuacaaggacagucgcuaaaauggaugcuaguccaagcccugacugcuucaggcucuuccguaaagguuccggcuuccagucugggaugcuuuaaaccacagugaugccugagucucugccccagagauucaauuuaauugucuagggugggucccaggcaucaguagcuauuaaaagcuccccaguugauucuaaugagcacccaggguugagaucagugcuguggagcuuagcccuuucuaaaguuuuuggauugauugucugagucuacccaguagacucagaaaaccccaccuguagucccagcuacuugggaggcugaagcaggagauugccugagcccaggaguuggaagcugcaguggguugugaucacgccaccgcacucuagccugggugacagagcaagauccuaucucaaaaaaagagagaggaaaagaaaggaaagccucaccugucuacguucccucacuguagaugucaggccaaugugaccaucgggcugcccaccaagcagcccaucccugacugugagaucaagaaucgcccgagccuucugguggagaagaucaaccuguuugccauguuuggaacuggcaucgccaugagcaccugggucuggaccaaggccacgcugcucaucuggaggcguaccuggugcaggugggcauggcagccagccccuccugcccugcccgccucacccucagccuugggaccccaucuuuagguuuugucggguccugccucuagcacagccuuggucagugguucaccgcugcccccugguggcaccuucuguccuuggguggccugaugccugggccugggccugggccaagggcagagccagcugccaucaccuuuuaagagcggagugauuggagggcugggcacacaggagcucugcauucuggccccacuucuuugcagagaaggccucuacuccugaguccuugaaggacuugaggcccuugggagccuccuucucuggaaagaauggcaucgcuggcccuucccaagauuugaugggaaguggcagcuucuucacgcuccuucccuaucccuucugcucucagguugacugggcagagugacgaugagccaaagcggaucaagaagagcaagaugauugccaaggccuucucuaagcggcacgagcuccugcagaacccaggccaggagcuguccuucagcaugcacacugugucccacgacgggcccgugggugagccucaccccuccucuaccggagccgccuggccccgcgcugcccaugugcuagucucucccagccugcugggggcacacagauuauuuggaagaccgacugugaggagcaaggcgcucccuccaucgcucacacacccauucuucccccggccccuccuacccucuggggggcucuccccucucuguuucugccccugggucugcuugccggugcuuggguuccaagaagacuccccucccucucccuucucauaaauucuccaguugcucucccugggcaagaguaagucaggguuccaagaacuggauuucuggccuccaguuaggcccuuuggggacgugaggcccuucucuucagauucugaagggguagagaucaccgugguuacagggugagcuuucucuggugagcaggagggacuggcugugggaagaugaauggcacugacuaugggaggcacugccagggaccgggaagucacuauuccuucuccuuuccuuccuuccauucccacagcgggcuuggccuuugaccucaaugagcccucagcugaugucuccucugccugggcccagcaugucaccaagaugguggcucggagaggagccauacugccccaggauauuucugucaccccuguggcaacuccagguaugagaguucaagcuucuggaggaagguggggggagcacagaggcugggggcuucugggacuggaguacaggggcugucggaggaggaggaagaggaaggaaaggccccagaggaucugaagaguggggcugaggcucuaagagucuagagaccugggccccagaacuaacagguuaagugcucccaggggagcggggguggcauggacagagccagggccccaggcucguguugucucuccuccugucagugcccccagaggaacaagccaaccuguggcugguugaggcagagaucuccccagagcugcagaagcgccugggccggaagaagaagaggaggaagaggaagaaggaggugugcccgcuggcgccgcccccugagcuucaccccccugccccugcccccaguaccauuccucgacugccucagcugccccggcagaaaugccugguggcugcaggugccuggggagcuggggacucuugccgacagggagcguggacccuggucuccaacccauucugcccagagcccagucccccucaggauccauuucugcccagugcaccggcccccguggcaugggcucauggccgccgacagggccuggggccuauucacucccgcaccaaccugauggacacagaacucauggaugcagacucggacuucugagccugcagagcaggaccugggacaggaaagagaggaaccaauaccuucaaggcucuucuuccucaccgagcaugcuucccuaggaucccgucuuccagagaaccugugggcugacugcccuccgaagagaguucuggaugucuggcucaaagcagcaggacugugggaaagagccuaacaucuccauggggaggccucaccccagggacagggcccuggagcucaggguccuuguuucugcccugccagcugcagccugguuggcagcaucugcuccaucggggcaggggguaugcagagcuugugguggggcaggaacgguggaggcagaggugacaguucccagagugggcuuugguggccagggaggcagccuagccuaugucuggcagaugagggcuggcugccguuuucugggcugaugggugcccuuuccuggcagucucaguccaaaaguguugacugugucauuaguccuuugucuaaguagggccagggcaccguauuccucucccagguguuuguggggcuggaaggaccugcucccacaggggccauguccucucuuaauagguggcacuaccccaaacccaucuuuuguucuccuauauccuccuucuucuguuccauuucaguucaguuucagcggugccaaccucuuugcguuuccuuuuuguugaugaggacccagagcugcugcacacacucaccucuaacccccuccccucgcugcugggccccaucuccacaggagagacugguucagcucuagggccucagucuggagugggauaggagcagugagugacaaagccucugaaagaugcaucaucucuuccucacacccauuuagugggggauggguccucuagacuugaggggcuacccugggaagcugccguagcuucagccaggcaagaaagcuuccuucaaccugcauagccggugggugaggagauucccaccuuccauagccuccaaacauguucccaaggccccacuuucaagaaucagacagcaggaagccauagaugcuggcuggguuccagguuauggggagaagaaauacagucaauaaaagguuuuuguauaaacucuugguguguuuuuccuuuuuuuuuucuuuuucuuucucucucuuuuuuuuuuuuuuaauugagauaaaagucucacucuaucccccaggcuggagugcagugacaugauauuggcucacugcaaccuccgucuccuggguucaagcaauucugccucagccuccugaguagcugggauuacaggugccugccaccacacccagcuaauuuuuguauuuuuaguaaagaggggguuucaccauguuggccaggcuggucucgaacuccugaccucaagugauccacccgccucgggcuccaaagggcugggauuacaggcgugagccaccgcgcccagcuagugcguucuuucuucuaugggcuccgauccuggccuccuuaccuugucuuggucccaaucuuuuuggucuuccccaucuucccgagggugcucugaaaggccaagagcuuugugcuaauguggccacggcugacagucagaugucaggcugauggcgcccucaugugcuggcuguccaccugagccagucggcucuauaugaacaaaagcucuucugugaccacggcugccucgcggagcagugaucacaagauaauugagcacaggcaugcagcuuccccuggggugauggugucugccugaugggaguggagaugggcaggacuccucgaggcauuccuggaccucaucucugggggccucuuucuucuaccagggacguccauugggcuagacgcauucugauccacagcuuccuccccuggccagucagggaagccuguuagccccacuuccuccaaugagauaaucaguagaagacugggaacuggggugcaagggcucaggauuaugagagaaggaggucuguguagcaaaggggcuggugcccacagaccuggcggguauuguggaguacagaccaggcuuguuuggggaguacucuuuuuuguuguugaaauagaguuucacucuauugcccaggcuggagugcaguggcacaaucucagcucacugcaaccuccgccuccuggguucaagaauuucuccugccucagccucccgaguagcugggauuacagacgugugccaccaugcccagcuaauuuuuguuuguuuauuuauuuauuuauuuauuuauuuauuuauuuauuuugagaaugagccuugcuccaucgcccaggcuggagugcaguggugccaucucaguucacuguaaccucugccucccugguucaagcgauucuucugccucagccccccaaguagcugggauuucaggcgcgcacuaccacaccccacuaguuucuguauuuuuaguagagacaagguuucuccauguuggccaggcuggucccaaacuccugaccucaggugauccgcccgccuuggccuccugaagugcugggauuacagaugugggccacugcgcccggccuaauuuuuuuuuuuuuuuugagacagagucucccugucgcccaggcuggagugcaguggcacaaucucggcucacugcaagcucugccucccugguucaugccauucuccugcaucagccucccaaguagcugggacuacaggugcccgccaccacgcccggcuaauuuuuuguauuuuuaguagagacgggguuucaccauguuagccaggauggucucaaucuccugaccucgugaucugcccgccacggccucccaaagugcugggauuacaggcgugagccacugcgcccagccaggaguagucuuugaaugcugcucaugugaugaggacaccgcauuuugaccauggccagauuccaggagaaggggaaagggaauacuaacccacggauuguauuccuaggcacuuuacauguguauuaauaauagcuaacucuuggcugggcacaguggcucaugccugaaauuccagcaccuugggaggccgaggcaggagggcugcuugagcccagaguuugagaccagccugggcaacaaaaugagacccccaucucuacaaaagauuaaaaaauuagcggggcgugguugugugccuguggucccaggucuugggagucugagguggauugcuugagcccaggagcuggaggcugcagugagcugugacugcaucacuguacucuagccugggcaacacagcaagacucugucucagaaaaaaaaaaaagccucccccucccccucccccugccccucucccucucucuuucuucggucgcccucuguugccgaggcuggacuguacugccgugaucucagcucgcugcaaccucccuaccucaggcucccaugauucuccugccucagccugccaagugccugggauugcaggcgcgugccgccacgccugacugguuuuuguauuuuugguggagacgggguuucgccguguugacugggcuggucuccagcucuugaccuagagugaucugcccaccucggccucccgaggugcugagauugcagagucucgcucacucaaugcucaauguugcccaggcuggagugcaguggcaugaucucagcuugcuacaaccuccaccucccagccgccugccuuggccuccgaaagugcuaagauuacagccucugcccggccaccaccccaucuaggaagugaggagcgucucugccuggccgcccaucgucugggaugugaggagccccucugcccggccgccccgucugggauaugaggagugccuaugcccggccgccccgucugggaagugaggagcaccucugccuggccgccacccugucugggaaguggggaccaccucugcccggccgucaccccguuuaggaagugaggagcgucucugccuggccgcccaucgucugggaugugaggggcaccucugcccggccgcccaucaucugggaugugaggagugccucugcccggccaccaccccaucugggaacugaggagcgccucugcccagcugccccgucugagaagugaggagccccucugcccagccgcccaucaucugggaugugaggagcgccucugcccagccacccaccgucugggaugugaggagcgccucugcccagccgccaccccgucugggaagugaggagcgccuuugccuggccccccuucgucugggaggugaggagcgccucugcccggcugccccgucugggaggugaagagcgccucugcccggcugcccugucugggagguguacccaacagcuccaaagagacagcgaccauugagaacgggccaugaugacgauagugguuuugucgaaaagaaaagggggaaauguggggaaaagaaagagagaucagauuguuacugugucuguguagaaagaaguaaacauaggagacuccauuuuguucuguacuaagaaaaauucuucugccuugggaugcuguuaaucuauaaccuuacccccaaccccgugcucucugaaacaugcgcugugucaacucaggguuaaauggauuaagggcagugcaagaugugcuuuguuaaacagaugcuugaagacagcaugcucguuaagagucaucaccacucccuaaucucaaguacccagggacacaaacacugcagaaggccgcagggaccucugccuaggaaaaccagagaccuuuguucacguguuuaucugcugaccuucucuccacuauuauccuaugacccugccacaucccccgcuccgagaaacacccaagaaugaucaauaaauccaaaaaaaaaaaaaaaaaaugccaacucuuaguguaugcuugccggguacuucucuaagcacuuuguguacauuaauucaucaaauuucacagauucagaccugugaggcucuguuaacaccccucaagauacugaggcacagagaguuucaguagcuugcccaagaccacacaguaaguggaaaugcuggcauuuuguuggcuccagugggcacuuagccauggugcuccacugucucuuguuuaauucagagaauaauaaaccaaucagaggagcucauuuuauguguuagguugaugcaaaagucauugcaguuuuugccauuuuauuuuauuuuauuuuaaguauuuugagacagaguuucacucuugcugcccaggcuggagugcaauggugugaucucagcucaccacaaccuccaccuccaggguucaagugauucuccugccuuagccucccaaguagcugggauuacaggcauguaccaccacaccuggcuaauuuuguauuuuuaguagagauaggguuucuccauguuggucaggcuggucucaaacucccgaccucaggugauccaccugccuuggcuucccaaagugcugggauuacaggcgugagccacugagcccagccaguuguugccauuuuaauuggaaaauauaagcucagugaagcaaaaugacuugcuugcuaccccgcagcuagugagugacagacacuagguccaggcucuuccugacuaguguccaggcucuuuccacgcuuaaucccgccuuugauuuuucucucuauccagguuuccugguuuauguucccucuggccaucccacauccucuuacaccugcucuucuuguucuucccggccguuacugcuucccuuagcauuguuacagcuauuuuuuagccuuuaucaacaacaguauuuaaaauaaugaaaguuaucagugcuguuuaaggaucuuuucugaaacaaaggggaguguu

SEQ ID NO: 14566 - RNA, 208525 nt, Homo sapiens
cagguuccguggcgccucgcgcgaggccagaccgggacggggcggggcggggcuggaggggccgggacuggcgggcggagaaagggggugggagaggaggcgauggaggggaggaguggggacaugggggagggaagaggaagggaggugggaggcggggccgaccaagagcaggagcuggagucugagccggugguugcagcggaggcggugaugucggugcagguugugucagccgcggcugccgccaaggugccugagguggagcugaaggaccugagccccuccgaggcggagucgcaacuaggacugagcacggccgccgugggcgccauggcccccccggcgggcgguggagacccugaggcuccagcucccgccgcggagcggcccccgguccccggcccgggcucggggcccgccgccgcucucagccccgccgccgggaaggugccucaggcgucggccaugaagcggagcgacccacaucaccagcaccagcggcaccgcgacggcggcgaggcccuggucagccccgacggcaccgucaccgaggcgccgcgcacagucaagaagguacuggggccgggcugccucucuaggagaggaagggaggggaggggaacugcagauccucucggcacggcggcaccacccuccacgcccuccuuucugaucgcaggaccggagauaccccuuguccccuuaaacccacucucucagagaugccccccagccggccccucgugcugggagcggagacuccaggaggcacggccguacuucgcucugaauaacauggagguagcgcucuccccuacuacuuggaauaggcagcgggaggagagacaccuaauaguacgucccgcggccccaacacgcucccgggugugauuuuccagccuaucggggaagagaccucgauaguauagaaaaaccuuaccgcucacgggaguucacacagcaauaaggaugaaaagaucuuuaauacuuggagaacgaguaagguguagucaccuugcauagaaaucgucagaguugucugguuuccauacaguugaugacuuucugccuuucuguggccaaccguggccauacagcaacacgaugcugugcccuucauuuccagcgacugcgauauucucucuucccugaauauguaaaaggguaauggagagauucuccucacucuuucguguuaagagcuuuguccucccugcuggguauaguuggucaccaggauuauuaggcuguguaugaagagaaugaaugucuuauugauugcuuuauuauaaucugaaagugauaggaagaaaugcugcuacuuuugggaaagacgaucuuugugggguuuucggucuuaggcgucagcuucuuucagacaguuuugaggaggucucagaauaccaagaaguaacugccuagguggaugauagcccuguauuacccguacauugucuauccauaguugucugucucucucaaagcuugucuuucuuucucucuuaaagcugaaucagcacagaaaaacagggcaaguauuggaaaagacagaaguguggaucauauaaaaagggcuuacagcuucaauuucguagacacaguaugggcacagggauuaauguuuuuuuuaaauuguugugaaugguuuuuaauugcuuuaucagaacagcaacaaagagacgggaagugugcauugguuuuacugugugggaccagcugaauuggaaccuuggauccaccauaacuuuuuguugucauagcgucaugauuaagguauagcggauaauccuuucauccuaacgauacaaauuuaggugauaagucagaggcaagacugaaggaauuucuguaaugcuuuagacaaugucuuugucguuuguaguaugaaacuccucugggaagaauuagaguagaaagaggcagcauccugcagaaauggguuuaaagaaaaaaaguaaaguaaaaaagagaggcagcagcagcaccagugcugggaguaccuagaucugagucuggaaauccaaagcauacuucugacuuguugagauacuuuguaucguuaagucauuuucuugugauaaagacuguuuuugucuaaacuuuguaauuugguuagauuucuuuaggcuaaaaguguuuaacaaauugcuuuuagagcaugaaguuuacagucaggcagaccuggauuugaagccuaguacccccauuacuaccuuuuggguaauuuccaaauuacacaaaucaguuuccucuucuauaaaaugaaaguacuaauuaugauugaggauuagaaauauuuguaaaagguuuagcauugagcuuggcacauaaagucuuaaaugauauucuuacuaaugcuuuuauuauuaugaauaauugauuuuauuuuauuccucccaucauggcuuaagugcaagcccccaugaccaccucugaaaguuacacacaguucaauauauucuauauaaagaaauuaaaaaaucauggcucacgucuguaaucccagcacuuugggaaaccacggcugguggauugcucgaguccaggaguuugagaacaguccgggcaacauggugaaaaccucucucuccaaaaaaaaaaaaaaaaaaaagagccgggcaugguggugugugccuauagucccagcuacucaggaggccggggugggaggaucaccugagcccaggaaguugaggcugcaaugagcacucuagccugggugcuggagugagaccuugucucaaaaaaaaaaaaaaaaaaaaaaaaguuaaaaaaucaaagaccagcauacuggagucuguuuuucuuaauucuagaugugcuucuugaccacuuuccuugucguugaaccaucuuccuguuuuuucagcaccaaauguauguuccaugauuguagauauacucagcagccucaaggcuauuguaaagcagggcugagcuugccuuacaauguuaauugcaccaaaaaaacaacuucucugcugaaaguuaagcaggugaagcucugggcaaggauacagcuggaugacgaaauucagggcauugcugagcugcuuuucaggugcccaaucuuuaaccuucuugauauugaauuggcuaaaucaaaauaagugcccaagacugcccuuucccuaaguugaaagucaucucaccaaggaacugcagugugacauuuugauuuguugagccuuuguugauucuuagauugucuauguaaauaaccacuuugaccuugacuccuuacuguuuuucuuauagcauaugaaggaacugagaauacuaguauugaaauagcugccuuuggcuguggaacuggugacuguugcauuuguuuuuuaacuuucauguauaaacauuuauuuuaagucacauuuccauagaugguuuuccuuacuucauucacauaucaucaguuuucuuaguuuuguuacucugcucagccacacaaggggaauaaacuuuuuacaagagccagaauucccaagugcaguaguuaauaagaaggaacauauggugugcagguuacucaaucacaucuuaucuuuggcaccugccuccguccuguaacuugcgaugcucugggggccagaucauguuauguggcuaugauauauuuaauuauaguguccuuuuucauaaguugacaucaagugaacccagcaagccaaaaaucucuauaagaaguaauuugggaaaugggaagguaaguuccacagggaaugagguaguacuagcugaaagggauuucuuccuuguguucuugaaaaugagugauaggaguguuggcgcacagcagggaaaacaaggcaggagaggauuuauuucagaaauauuaaaacuuucugacaauaaggcugcaagcccaagaaccucaacuagauugugcuuacaucaguaucaguaaugaccguguucaaacagacccuuuauugcuuuuggcaaacauauccaccuuccacuggcuuuguugcugucaggagagaaugaguugagccauguuagcacuucuuguccugaauuguuuaagcucuugauuugguuaauuauagaguacuaaaauggaauguuuuggauaaagacaugggaaugugguagcaguaugacuccuuuugccuguuacaagaguacugcucugaaaaguguucaguaaggcaauuggcaguuggucuguaauaauaguuaccaauaauuagccuuuuuuuuuuuuuuuuuuuuuuugagacagaguuuuacucuuggugcccaggcuggagugcaauggugcaaucucagcucaccgcaaccuccgccucccggguucaagcgauuccccugccucagcuuccugaguagcugggauuacaggcaugcaccaccaugcccggcuaauuuucuauuuucaguagagaugaaguuucuccauguuggucaggcugcuuucaaacucccgaccucaggugaccugccugccucggccucccaaagugcugggauuacagaugugagccauuagccuuuuaugugccaggaguugucauagggguucuguaauccucacaaccauacuaugagauguagguggcauuauuuccauuuuauagaugcagaaaugagauccugggagguuaagugccuugcccaagguuauacaucuagaaagugucagagguagaacuuaaauccagggcuguccgucuccaaagcccauguccuuuucauuaugccacagugauucuaacuucuuagaugcugaguucuugcuuucucccagaggucuuuuagaauacuaagugaacucuaaggcgugucugucuggcuaaggcuuaggucaucccaagaccaaaguaaggcaggucugaguuagagcuuuaggaagaggaugggagaaaauuguacaaauguagaacuugaaagaauuguaaauuuagaagaggagaauaaaagcaucuuauacagaaaagcauuucaagaucaaugaugcagcuucacacugguaauuuacugauaaucugagaaauuuauccauauuuuaaaaguuauaaauaaauuuggaguaccugaggaauauacccuuucuuccuguucagcuaacacuuuuucccuauucuuuaagccucaccaucucuaugagucaaucuuugauaagagcuuuugaaaauugcaaagggaagaauauuccuacuguauaccaggcauuguacuuagagcuuuacauauacuguuuuauuuaauucuuuuuuuuuuuuuuuuuuuuuuugagaccaagucucgcucugucacccaagcuggagugcaguggcgaucucggcucacugaaaccuccgccuccuggguucaagcgauucuccugucuugcccuccugaguagcugggacuacaggugugugccaccacacccggcugauuuuuuuaauuuuuaguagagacuggguuucaccaaguuagccaggguggucucgaucuucugaccucgugauccacccgccucagccucccaaagugcugggauuacaggcaugagccaccgcgcccggcuauuuaauucuuuuaagaggccucgaagauagcuaguguucuccuuguuuuauugaagaaacugagugucgaagagauuaaggaauuugucucaagguuacacgguaaugugauggaacuaacagagcccuaaacuguugcuuuucaauucaaauaguacucuguucgaaacucaggaugaaccuucuaaaucuuuuuuuuuuuuuuuuugagauggagucuugcuuuguugcccaggcuggagugcaguggugcggucuuggcucacugcaacuucugccucccggguucaagugauucuucugccucagccucccgaguagcugggacuacaggugcacgccaccacgccuggcuaauuuuuguauuuuuaguagagacgagguuucaccauauugucuaggcuggucgugaacuucugaccucgugauccaccugccucagccucccaaagugcugggauuacaggcgucagccaccacgccuggcccuaaaucuuaaucuguguuuuuuggguaguuuuuuuguuauugcacugacaguuucuuuuuauuuauugcgugguugaaggucuuaccguguguuuuugugagcauuuauuuucugagaaagcagccugaggugggcagaucaugaggucaagagaucaagaccauccuggccaauguggugaaacccugucuccacuaaaaauacaaaaaauuagcugggcaugguggugcacuccuacaguuccagcuacucaggaggcugaggcaggagaaucacuugaaugcuugaaugcgggaaguggagguugcagugagccgagaucaugccaccgcgcuucagccuggcgacagaaugagacucugucucaaaaaaaagaaaaaaaaaagcugcuuuaggagcugaaguugcaguuguguguuugaugucuugaggaagacaauuacuacuacuacuacuacuaguacuaccuacauucucaguauccaguuaauugaagaaaucgauaguucauuaaaaagggagagugaguuuauuauaucauuuccuuggaagugauucccucccccacgagagaaaaaaaguuuguuguaaucuuuauucagacccuuugucaaguuuauaaagaauaugcaguuuguuucauggugguuuuuguuuaaauaauuuagagagguacaacugaggcagaugggaagagaacaaucuuggcaguugcccugauccacugcccugcugucauguuuaggugguagacacaauuagaggagcugaaauuccauucacccaacaagagguuuaguaaacuugaucagauuucuauggaauuuguaggagcuuuuuauagucugaaugaccuauggccugcgauuuggugagagcagagcagaaagcggcaguggauugacguuucuucuguaacaguucccaacucuaaaauuacuuugauuaaauuagaugauuauuuguauggguuucagucucccuuuuccccagcuguaucgugcaacaguucaguuagcuauuucccucuuggacgcuugcacuaaaagcuggugauuuuauuuucuuuuuuuuuuucaagggucuaucaguagaaaucuauugguuuggggcaccuaguucuuagcuuagaaccuauauaaaggaaggguauuugaacugcugauugaguuucucugaguauaggacuuuagccuuucugaauguugcaaaccugaggcuaaaacuagcuucaucuucucugcacacacuuacauucuacagugcuccaaggugaaacuucaucuauugacuaccuuuucuuggaaacucuucucuuggcuucagugucacuuauaauugcuaccauuuacugaauacuuacuccgugucaggaaucucugucuuaguauuuaauccucaugacaacuuuaucagauguguaguacuaucuuuauauuauggauaagaaaauauaggcucaaagagaguaauuaacuuguccaaggcuuugucaaugaaaugcuggccauagcaauauugggcagcuuugccucugugccaacacccgugcugcucugaccagacucccacugaagucugcuuaagcugcugcuaagaccacuuuggaucucacaaucuagccucuuucaaggggaggccuaaacaccaugccucacaucccuguuuguuucagucacuacccgccauccgccauccauuaucuucccaauacuaauuccuuuaccacucucuucauccuucagcugauucagucccucaaacuguuccaccauguucuuuacaauaucccccuccuugaucagcagauucacauguaguaucagucucuagcagcaagaucaaguuauaagggcaacaguggcaaguguuagcacuuaguauccagaacugugauggugcaaaccaagcugcagcaucuccugcuuggcauuagcaaucacaucuuugccaacccaguucuguaauuuugaguguuguuuuagcuguguagcacuuaaguucuucacugaaaaagugaccucauauccuuucuguaaauucuuuuucuguuuaauucagccaguguugacuucugcugcuuguagaacuuggagugauguacggguugaaccuaaccaucuaccuucuuaguugcuggcacucauggagcugagaguugcuagagaaaaucagcaaauuagacagaucagugucauuaaaaauuuauaaucaucuauuucauaugcauaaucagcauuaccuagcaauguuauacauuucucuaguucacuuuccagcucacugcgaauuauuucuucauauugucucuuucucuuuucuuuuuuacugagacaaggucucccucucucacccaggcuggagugcagugguacagucacagcucacuguagccucaaacucccugguucaagcaauccuccugucucagccuccugaguagccagaacuacaagugugcuaccacgccuggcuauuuuuuuauuuuuuuguagagacgguaucuugccauguugcaggucuccaauucucgggcucaagugauccuccugucucacccuuccaaagugcugggauuauaggcauuagccacugugccuggccuacugucucuauuucuuuuucucuuuuuuugagauggaaucuugcucuguccccaggcuggagugcaguggcgcgaucuccgcucacugcaaccuccgccucccggguucaagcgauucuccugccucagccucaugaguagcugggacuacaggcacgcacuaccacgcccagcuaauuuuuguauuguuaguagagauggcguuucaccguguucgccagaauggcucaaucuccugaccucgugauccgcccuccucagccucccaaagugcugagauuaugggcaugagccaccgugcccagcucuuauuucuaaucucucauauuuucuucuuuuuuaaccagucauaggcuuuaugccucauuauaaaaauggaagcugcugaaugggaauuccuucauucuuuuaccucccaagucuacaaaccuaugugcaucugggacucaucuuuuucuccuucauucugucaagaccaaucccuucacaggugcuguaaucauucuuuucucccccuccccccuuccuccuccuuucuuuuucuaucuuucuucucucucuuucucuuuguuuucauucauuuuucuucaagagaugaagucucacucuguagcccaggcaggagugcagugguguggucauagcucauugcacccucaaccuccugagcucaauagaaccucccuucucagccucccgaguagcugggacuauaggugcaugccaccauaccuggcuaauuuuuuuaugacuuucuuguagagauggggucucuuuuuucccccuagauggagccuuacucugucacccaggcuggacugcaguggcacuaucucggcucacugcaaccuccgccucgugaguucaagcaauucugcugccucggccucucaaguagcugggauuacaggcauccgccacugugccuggcuaauuuuuguauuuuuaguagagacgggguuucaccagguuggccaggcuggucuggaacuccugaccuugugaucugcccacuuuggccucucaaagugcugggauuacaggcgcgagcccacaccuggccaagauggggucucuugcuauguugccuaggcuggucuugaacucccagcuucaagugauccuuccuccuuggccuuugaaaguacugggauuauaagcaugagccgcugcacccagccacauuuuaaaaacuuuuuguagagauggugucucacuuuguugcccaggcuggccucgaauuccucgcuucaagcaguccuucugccucacccucccaaagugcugggauuacaggugugagccacugugcuuggccucuccugucuuaaagaauuucuuccuuugguuuauuucaucuuucuacuaggucuuuuccuucagaauucacacuugcccuauugucucccauuuugaaaacccuguccuuugaccugcauauuuucuguugcugucauguuuuucuauucucuuucacaggcaugcuucuuaaaggaguuuucaguacaugcuauaugugcuuuuuuccucucaugaauuccuuaacucacuccugcuauaauauucuguuuaaccaaaacaaaacccucuugcuaaaguuguugauguccauuagauugggaaacaugggggucuuuuuuuucaguccucaucuucuuggaccucuuagcagcauuugacauugacuccuugugaaacacucuuuucccuuggcuucugugacaccgaucuuuacuagcuuccaucuuauuucucuagcugcuccuucucauucuucuucuuuuuuuuuuuuugaggcagaucucacuguguugcucaggcuggagugcaauaguaugaucacuguaaacuugaacuccugggcucaagagaggcuuccaccucugaaccuaaaggacuaggauuacagacaugugccaccucauccagccuccuucucauucuucuucuucuucuuucucuugagacagggucucacugugucacccaggcuggagugcagugguaccaucauggcucacugcagccucaacuucccaggcucaagcaauccucccaccucacccuguggaggagcugggacuacaggcacaugccaccaugcccaacugauuuuuguauuuuuuguagagaugggguuucgccauauugcccaggcuggucaugaacuccugggcucaagugagcugcucaccucagcuuuccaaagugaguuuuauaauaacuuguacauaaauaaaagcauacucucuauacauuguuuugcagguuccuuuuuuauucaguagcacaucuuagagcucuuucuguaucaguaccuauagaucugucucauauuuuuuaacugcucaauuaauuuccuaagucuauauuguuguuucuuaaaccauucuuccauugaugcacauuuaccuuaacuuguuuuuucuuucuuuauacauggugcugcaguaacuaucuguaugcauuuuuguguguguacauguagaaguguuucucuaggaucaauaucuaaaauuuuaauuuugggaucaaagauagccuuuuuuuuuuuuuuuuuugagaguuuuuugagacucugucaccugggcuggagugcaauggcacggucucagcucacugcaaccuccacuuccugggcucaagcaauccucccaucucagccuccugaguuagcugggacuacagguacacgcugccacgcccagcuaauuuuuaauuuuaauuuuaauuuuuuuuuuuugagacagucuugcucuguuguccaggcuggaguacaguggugugaucucagcucacugcaaccuccgucuuucagguucaagcgauucucuugccucagccucccgaguagcugggauuacaggugugugccaccaccccuagcuaauuuuuguauuuuucauagaaacgagguuucacgguguugcccaggauggucuugaacuccugaccucaggugauccgccugccucggccucccaaagugcugggauuauaggugugagccaauguaccuggcccagcuaauuucuguguuuuuuguagagaugggguuuuaccauguugcccaugugggucucaaacuccugggcucaagcgaucugcccgccucagccucccaaagaggcauaaaacacagugcuuggccguguuuuaaacuaaaugcaaaaugccauguugucuuuaaaaauguaguaccauuuuacauaucagcuaacgauacacgaaacaacucuuucaccauacauuuaccaauacugaguauuuuuccaucuuugggggaaagucuuuuacuggucuuuuuauaauaucugcauucuucugacagaaugaggcugagaguauuuucaugcauauauuggcaauuuauauucuuuuucuuguaauucccuguucauauucauuaacaaauuauuuauugauugacuacuguaugccaagugcuggggauacagcaguaaacaaaacggauaaaaucucugccuucguauuggauuuuuuuuuucauguugguuuuaggaauucuuuauauauucuggauauuaauuauuuguguauauguugcaaauauuuuuuccuacuccauuucuuguuucuuguaacauuguuuauuauuuucaaaguuuuuauaaacuuggauuuaccaguuuuuuuccuuuuuggcuucaacauuuugugucuuagaauugccuuuccaaccccaaauuuauaaacaacaucuguguuuucuucaccuguuuauaugguuguauuuauuauauuuuggucuucaauccaucuggaauuaauuuuuguuuguaauguaaaauagggacuauuuguaauaugagauagcucuauuuguucccaaauaaaauauauuuuaccuuuuucugguuuguucucugauuguuucuuuaacuugucuuucuuaacuauuuuucuuucuuaacucuuaguuuacauguagaagaaacuugugauugaagacugugccuauuuauuaacgcaaauaugacacuaaaaauuagcauccugauacuacugauuuaguguuuacggugaauuauucauagaaauacuugcuauuuuagcgauuuuuuuuuuuuguuuauguagauuaguuuauguuuugacggaaauuggagccccaaugauaucucggauacauguccuaugcagugguagccuacagagaaacucaucuucugcauuauacuaaguuagaaaaaugugauacugugugguccuuuuccaaaaugacacuuuauuaauauuauuauucugagacagagucuugcugugucgcccaggcuagagugcaguggcaccauugggucacugcaaccuccaucucccggguucaagcaaccccagccucccgaguggcugggauuacaggugcccaccacugcacccagcuaauuuuuuuuguaguuuuuaauagagacaggguuucaccaucuuggccaggcuggucuugaacuccugaccuugugauccaccugcuucggccucccaaagugcugggauuacagaugugagccaccacaccuggccaauuauuaugauuuuaaggccuugucaggaauugaguaugugugaugaggcucuaggacgaaaaauuuuucccggguuagguagguguggucaccuaucuuucaaaguugacauuaacugcguuagcuuaaagaagaaauucuuuuccuggaaggcaaauaaagauucuucuucaacaaagcuuuauuggauauacagcucaacugagucuagucuugggucacugagcucagggagguagaaauggaauaggaauuguacuaccuuaauucaugucuuucauuucuguaagggagaaaagaugauuggccuaaugcuauuuuuuuuaugaccgaugcuagacuguauuagagaaguaacuuaacugcuucuggauauuugccuaauaaucucccuaauacauugugagcuucuuuuuugcaaaaaccguuuauuuguugggugucaaauacugcuaagugcuagaguuauaaguuagcaagauaccauucuugcccuccaggagaggauagggaauguagacacagaaauaacuaaauacaguguaguuugauauaagcaauacuggaaacaggaauuguaguuugaagaggucagcacugaaauugaggugaaacccaagagguuucaccaugugucagaaccucuguggccgggcgcgguggcucacgcuugcaaucccagcacuuugggaggccgaagcagcagaucacuugagcucaggaguuugaaacuagcuugaccaacacagugaaacccugucucuacuaaaaauacagaaguuagucaggcgugguggggcgggugccuguaaucccagcugcuuaggaggcugaggcaggaaaaucgcuugaauccagggguggagguggcagugagcugagauggcaccacugcacuccagccugagcaacagagcaaaacuccgucucaaaaaaaaagaaccuuugugagguuuccuuguuccagcuuuacaagucuagaaauucacauuuuugugcaaucagggaucauuuaccuguuaggacuggcucagacuaaccaaaaucaugggagacucauauuuaaaacaaaaugguaacucuuaauuuacagucauguauaacacucaagcuaaucugauaaacguguaaaucagaggauauucuggaaaaucuauaugggaggucuaauuauaguuagagacaguuuauuaaguuuggaaucauuuagauccuugcuauucaaacugauccuugcuuuucaaaccagaagcauugguuaucaccugggagcuugugagauaugaacaauaucagguaacucuggcucuguacuagcauauaucugucagaaccucaauuuuguauucguuguugaguagauguuggcuuagcaauuagucucauuucauguuucucauuuuuauuaauuuuuuuuuuuuuuuuagagaugggggucuugcuuugauacccaggcuggagugcaguggugcuggagugcaauggugugaucauaguucacugcagccucaaacugcugggcucaagcaguccuccugccuuagccuccugaguagcuugggauuacaggcccaagccacugugcccagcuucaugcuucucuuuuaugaaaccucagaguagaaaagcaagaaaauaauuuuaggguuuuauggaaagguggaaacuuacaguaaaaccuguuauaagacuuauaacaaaauacucaauagacacaaagacauagaaaaauaaacaggcacagauauauagagacagacacaccgagacccagagggagaguuacacacagacucccuacacacagagacacuucccccauauauacauaacagaaccccugccccaccaugcccaagccucuacccagucccuucccacacacagagaccccauacccacagagagaaccccacggcuggccggacgcgguggcucacgccuguaauccuagcacuuuaggaggcugaggcggguggaucaccugagguugagaguucgagaccagcuugaccaacauggagaaacccugucucuacuaaaaauacaaaauuggucgggcacaugccuguaaucccagcuacucgggaggcugaggcaggagaaucgcuugaacccgggagguggagguugcggugagccgagaucgcgccauugcacuccagccugggcaacaugagcaaaaaaaauccgccucaaaaaaaaaaaagaaucccauggccaucuccacagagagucuucuccaugguuacagagacaccccacacaaaccacacacacccugagacccacccacacacaaaaacacgggcucccacagagagaaauacauacacagacacacacacugacauccaacagguaaugcuuaaaacuaagguuuucauggagcgugaauaguguucuccacaguuauuuugaggagaaggagcaaguguucucucaaagguacuuuuaacugagccagaaaaugaagcaaaaacagacgggcugccauugggucugcagaacagugaaugcuacaaagccaguuugauuuggauuccuguuucuggaacugcuuguuccugggcauuguuuucaguuugaugcacucagcaugcuuagguggaaagucauucucuuauuuucucucaggagcuugcauccuagauugcugguuaagcagaguuuuaugcucagucuccuuuggcacuaauuaacacacucccuuggugcucccugagucauauaagucugcccaggauuggaagauccagaaacacugugcccauguggaggaacucauacugaguccucugugggugcgugggaccgaggaauguagggggaagauuauguauuagauauagaaagagauguaauuuucauuuuuuuuuaaccugugggucauucaugguauagguuugcguagagagcuugauggaacuuaagaaugacuuaggaauuauuuaguuguaaauuaaaugauuuuuaagcuacauuaaugugggcaggggauggcgcuuuggauuauuuugguugagagagaacacugaaacuacauagccagauuucuugugacucgggcagcaucuucugagaauuaucuuguuaggaaaaagaguugacacaugcagcauguuuguguguguaaauacuugaaaguuucuaucacaccaagggagccagacaccagagacaucagaauaguuuuauaaacguuaaguuccaaaaagaacuauuuucucuuguugccuggcacacguauauguauuccuuugacuaaaccuguuuaauuucaaacaggcuaggcaugguggcucaugccugucaucccagcacuuugggaggcugaggcagguggaucaccugaggucaggaguucgagaccagccuggccaacauggugaaaccuugucucuacuaaaaauauaaaaauuagccaggugugguggugugcaccuguaguuccagcuacucgggaggcugaggcaggagaaucacuuuaacucgggaggcagagguugcagugagcugagacuggccacuguacuuccagucugggugacagagugagacuccaucucaaaaaaaauaaaauaaaauaaaauuucauuucaaauagauggaagagucaugagaaaaguguacucauuauccaguuuaacaaauguuuucauuuugcaaaauuucuuuauuuuuuaaagauguaaaacauuggauaaaauugaagacgcagcuggccacaguggcucacgucuguaaucccuuugagaggccaaggugggaggaucaguugaggccagaaguucaagaccagccugggcaacauagugagacccuaucucuauuuuuuuuaaaaaagggagacagaaaaaaaaaaaaaagaacucuguguauuccuucucuauucauucuccuuuaucccuucucuccuucccauaaggcccacaaagguaacuuuguguuuauaacuccccuucauguuuaguacuuuugcuauauauucuuuaucaguaucaauuguaugucagcagauaauauauagcauuguuuuguuuauaaacuuuacauaaaugguauuuauguauucugcagcccucuuuuuuacuuaacuuuagaguuuuagccaguuugauacauguagauuuucuaauugauuuaacuacuaugugguauuucacauguaugaauauacuacaguuuacacauucaucucacuguguugcccagucuggucucaaacuccuccuggacucaagcgaucccuccugcuuuggcuuccuaacguguugggauuccaggcaggagccaccaagccuggccuuuuuuuuuuuuuuuaacugaaaugaacaaccuuacucauguuuccuuaugcacaugugugagaguuucuccaggauguaucucuagaagcaaaauugcuuaugguggccgggugcaguggcucacgccuauaaucccagcacuuugggaggccaaggggggcggaucacgaggucagaaguuugagaccagucuggccaauauagugaaaccccgucucuacuaaaaauacaaaaaauuagcggggugugguggugugcgccuguaauccuagcuacuccggaggcugaugcaggagaaucaugugaacccaggaggcggagguugcagugagcugagaucgugccauugcacuccaccugggugacagugugagacucugucucagaaaaaaaaaaaaaaaaauugccugugguauguuaauuuauaucagcuugacaagauauuuccaaauugcuuucugaaguggcuugauuccuguuuucaaauccuuacuaauauguggugucgucagacauuaaacuucugucagguaguaucucuguuguuuuaauuugcauuuccuuggauagugagauugaguuucuucuaauaugucuguaguucauuuggauuuccuuuuuucauauccuuucccauuuuucuguugggaucccaguggcguuuucuuaucgacuauauuguuucucuuuuuuuuuuuuuuuuuuuugagauggagucucacucugucgcccaggcuggagugcaguggcaugaucuuggcucacugcaaccucugaagcccgaguucaagcaauucuccugccucagccuccugaguagcugggauuacaggcgccugccacugugcccagcuaauuuuuuuuuguauuuuuaguagagaugggguuucaccaucuuggccaggcugguuuugagcuccugaccuugugauccaccugccucggccucccaaagugcugggauuacaggcgugagccaccaugcccagccgacuauauuguuucuaauuccuuaucagauauguguguguguugaaaauaucuuuuggucuguggcuuguggcuuuacuuaugacuuuuauuaaaaaguuaaaaauuuuaauauaaaauugauuuuuuaaaaucauuuguccuuuuugagucuuguuuuagaaacuuguaccuauccuggggucauauuuucaauauagucuucuaaaauguuuaguuuuguguuuucaguuaugucuuuuguuuguuuuuguuuuuguuuuguuuuguuuuguuuugagacggagucuugcucugucgcccaggcuggagugcaguggcaccaucuagacucacugcaagcuccaccuccuggguucacgccauucuccugccucagccucccgaguagcugggacuacaggcgcccaccaccacgcccagcuaauuuuuguauuuuuaguagagaugggguuucaccguguaagccagcauggucagccaggauggucucgaucuccuggccucgugauccaccugccucggccucccaaagugcugggauuacaggcaugagccaccaugccuggccuucacagucaugucuuuaauccaacugaaauuaauauuuuauaugguaugagauagugaucuuauuuuauuuuauuuuauuuuauuuauuauuuuuuucuuuuuuugugcuuuuuuuugguggggggacaguaucuugcuguguugcccaggguagagugcaguggugcaaucaugguucacugcagccuugaacuccuggacucaagugauucuucagccucagccuucccuguagcugggacuacagguguaugggccaucaugccuaauucauuuuuuuuuuuuuuucuguagauacagagucuugcuauguugcccaggaugguguugaauuccugggcucaagcaauccuucaaccuuggccuuucaaaaugcuggaauuacaggcaugagccacugugccuggccuuauuuuauuuuccauauggauaaccaguugucccauauguuuccauauggacaaccaauuguugacugaguaugucuuuucucugugauacgugucauaguccacucagguugcuguaacaaaaauaccauagauagggaggcuuauaaacaauggaacuugcuuucucaugguucuggaggcugggagucugagaucagacuggugaucagauucaaugucugguguggccuagcuaacugguucauagaugacagucuuuuugcuguguccucacuugggggaagagggaagggaauucucugggacccucuuuuaugagggcacuaaucucauuuaugaggacuccacccucaugaccuaaucaccucccaaaggccucaccaccaaauaccaucacacuggggguuagauuucaacauacgaaucuuuugggggaacacaaacauucagucuagggcaauaucuaaugccgccuucugauauccagauccuuucuguuucuggauucucccuuuuguuucacuggugucuuuguugaugucuuuaccaauugcaugcuuuuuaaauuguuagaacuuuauaacaacucuugauauuuugguugggcaaguucuuccuaauguauuccuuauuuuaaacagcaagagguaaaauuugcguaguguaaaauccacccauuacaaauuacaauucaaugauauauauuuguagaauauucuuuuuuuuuuuuuuuuuuugacagagucucacucuguugcccaggcuggagugcaguggcacagucucggcucacugcagucuccgccuccugggcucaagugauucucuuacuucagccucccgaguaccugggauuauaggcguguaccaccaugccuagcuaauuuuuguauuuuuaguagagaugggguuucaccauguuggucaggcuggucucaaacuccugaccucaggugaucgaccugccucagccucccaaagugcugggauuacaggcaugagccacugcacccggccagaauauucuguuuaugguaaaauauauauaacaugcaauuuaccauuuuauacauuuuuaagugcauaguucaguggcauuaaguacauucacacuguugugcaaccaucacuacuacucaucuucugaaguuuuuucaucuucccaaaccaaaacuccauacccauuaaacaguaacucuccauuccuuccucccccagccccuggaaaucaccauucuauuuugucuuuuaugaauuugacuucucuagguaccuuauauaaguagacucauacaguauuuuuccuuaugucuggcuuauuucacuuagcauaauaucuucaagguucauccauguuguaucacaugccagaauuucauucauuuuucagggugaauaauauuccauuuuacauauacguaccacauuuuguuuauucauuuguuaaugaacaguuggguuguuucuaccuuuuggcuguugugaauaaugcuucuaugaacauugccauacaaauaucuguugaagucaauacuuugaguucuguugguuguauacccagaaauggaauugcuggguuauauggucauuuuauuucugacguuuugcaaaacugucauaccguuuuccauagcaacugcacuguuuuacauuucuaucaucaguguacaaggauucuaauuuuuauacaucgacaacacuuauuucguuuuuugauaauagucauccuaauaggugugaaguauguuggauuuguuuuuuuuuuuuuugagacggaguuucacucuuguugcccaggaugagugcaaugaugcgaucuuggcucacugcaaccucugccucccggguucaagugauucucuugccucagccucccgaguagcugggauuacaggcaugugccaccacgcccaucuaauuuuguguuuuuaguagagacaggguuucuccauguuggucaggcuggucuugaacucccgaccuaaggugauccacccgccucggccucccaaagugcugggauuacaggcgugagccaccacacccugccaaguauguagaauuuuaaaaucaccuccacaauccaguuucagaacauuuucauuucccccagaagucacuuuugcccauuuguggucagucccugaucccacccucugccccagguaacuacugaucagcuuucuuucuguuuauuuuuauuuuuuugagacaggaucucgcucugucacucuggcuggagugccaugcugugaacucggcucacuguggucuugaucuccuacgcucaaucgaucuucucaucucaccuuccaaguagcuggggcuauaguugcgugccaccguggcuggcuaauuuuuguauuuuuuguagagaugggauaucaucuuguugcccaggcaagucucaaacuccugggcucaagugauccaccugccucagcuucccaaagugcugggacuauaguugugagccaccaugccuuuucuggaaauuucauauaaauuaaauuauacaauauggggucuuuuguguguggcuuuuccacuugauguaauguuuuugagguucauucauguaguagguucauucaguaguuccuuuuuauugcugaguaguauuucauuauauggcuauaccacauuuuaucaguuuaguaguugauggacauuuagauuauaucaucuuuuagcuauuuugaauaaugcaguuaugaucaauuaugguaaaucuuuuggcagacauauauuuucauuucucuuggguggauaucuaggaguggaauggcuggguuguguguuacauuuauguguaauuauuucauauaaauguaacuggcaaacuguuuuccaaagcgauuguaugauguuagauucccaccagcaaugcaugaauguuucauuuucuuuacauccuugccaauacuuggcauugucagucuuuuugaugauaaccaucgaagcaguuguauagugcuaugucauuaugguuuuaauuuguguuuccucaugacuaaugauguugagcaugugcuuauuagcuauuuguauaucuuuuuugcuaaaaugacuguuuacaucauuuucccauuuuuaauuggguuguuuuauuauugaguuguaggaauucuuuauacagcauguucugaauacaaaagauuuuucagauaugugauuugcaaauacuuucuccuagucuguggcuugucuuuucauuuuccugaugauguauuuuaaagagcuaaucuuuuuaauuuugaaaaaguccaauuuacuacuuuuuaaauagauuguacuuuuuuuuuccccccaagacaaggccucauucugucacccaguuuggagugcaguagcaugaucauggcuuacugcagccuugacuucccugggcucagaugauucucccaccucagccuccugaguagcugggaguacaggugugugccaccaugcccagcuaauuuuucuauuuuucguagagaagggguuuugccauguugcccaggcuggucuugaacuccuggguucaaucaaucugcccacuucugccucccaaagugcugggacugcaagcaugagccacugcacuuagccuuagauucuacuuuuggugguauaacaaagaaaucuuuguguaacucaaggucacaaauuuuaucuccuuuguuuucgucuaaugguuuuauaguuuagguuuugcauuuagauuuuugggcuuggggugaaaaaaguccccauuuuuucccuucauauggauauccacuuaucccagcaccauuaguugaaagaacuauccuuuccucauugaauugcugugauaccuuuguugcaaaucagcugucugcagauguggagguauguuucuagacuuucuucuguuccauugaucagcuugucugucuugaugccaguacagcacuccccugauuuuuguagcuuuauuguaaguacaguuaucccuugguuuccuuggggaauugguuccaggacccucauggauauaaaaauccugggaugcucgagucccuuauauaaaauggcauaguauugcauauaaccugugcauauccuccuguauacuuaaaucauuucuacauuacuuacaccuaauauaauguaaaugcuauguaaauaguuguuacacuguauuuuuuauuuguauuacuuuuuauuguuguguuguuacuauuuuuucuuuuuuucuuuuuuuuuuuuaaauauuuuugaucugagguugguugaaucuguggaugcagaacccauggauaugagggcugacuguuggaauuggguaguauaaauccuggauacuauuuuuuuuuuuuuuucaaaauuauuuuggguauccaaguccuuugaauuuccacauagauuuuaggauaagcuugucaauguuuacagaaaaagcuugcuaggauuuugauagggauuucauugaaucuguaggucaauucgggagaauucccaucuuaaugauacugagacuucugauacaugaacauggaacuucucuccauuuauuuagauuuucucuagcugcucuuuagcaguauuuuguacuuuacacuguauaggcuauuguaaaugaaauuguuuucuugauuuuacuuucagauuguuuauugcuagcauaaacaauuguaaaaauacaauuuuuuaaaauugugguaaaguuuacuaacaauaaacuuuuuuuuuuuuuuuuuuggagacauagucucacuuccucacccaggcuggagugcaguggcgcgaucuuggcucacugcagccucaaccuccugggcucaggugauccuccuacugcagcccccggaguagcugggacuacaggcaggcaccacugugccuggcuaauauucauauuuuuuguagagacaagaucuugccauguuguccaggcuagugucgaacuccuagacucaagcaacccuccuguccuggccucccaaagugcugggauuacagacaugagcugcugcacccagcccauuuuaaccauuuuaaaguguacaauucauuggcauuaaguacauucacaauauuaccauuaccacuaucuauacccaaaacuuuuucauugccucuaacaaaaacuauguauuaaacauuaucuucuuuuuuuuuuugagacggagucuugcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgugccuggccuaaacauugucuucuuuuccccggucccccagcccuuggaaaccucuauucuauuuucugucucuaugaauuugccuauucuggguaccuuuucuuuuuccuuuggugucuggcuuauuuuacuugguauaauguuuucaaggucccuucauauuguagccuguauuagaauuucauucuuuuuaaggccgaguaauauucuguuguuuauccauucaucuguugauggauauuauggauauuuggguugucucuauauucuuuuggcuauugugaauaaugcuguuauugggguacaaggcuggacgcaguggcccacaccacucccaacuucugggaggccagugugggaguauugcuugaggccagagguugagacuagccugggcaacuuagcaagaauccaucucuuccaaaaaaaaaaguuagcugggcaugguggugugcaauuguaguccuaguuaccugggaggcugaguucgaggccacagucagcuauuauugcaccacugcacuccagcugggaugacagagugagacccugucucaaaaacaaacaaaccaaaaaguugguaugcaaauaucuguuuugagcuccugcuuucaauucuuuuggauauauaccuaagaguggaauugcuugauuacaguugauuauuguguugaucuuguauucugcaauuuuaauaaacuuguguauuuaguuuuuugaagauucuuuaggauuuucuuuguacaggaucauguuaucuacaaaugaccauuuuacuucuucuuguccaauguaugugccuuuaauuucuuuucuuuucauauuacacugucuagaaccuccaguacaauguugaauagaaguggcaacaguggacauguuugccuuguuuccgauuuuagaggaaaaguauucagucuuucaucauuaaguguaauguucacugauaguugguagggcagauuucuccuaauauauccuuuauaaugucuuaguuuuggcugacuaagggacugaauaaauuggcauguguuagugaauaucaccucuugacauuuauaugucucuuagcuaagcuauaagauuaaaaaucccuuucuuccuuguagaauggagcaacccuuaugauacccuguaaguuucuacuuugaguccuucaguuuuugaauuagucaaauuacucaucuaaauuugcaguucauggucugcuuguccauauuaaagucuagggugucuagauugugaccaaaaccggugaagccuuuguguuuucugaugcuguuuuaaagcuuauuauaauuuucccuucuauggggaaagauucugugcuguuuucucuuaaagugaaauguauguuguuguguguuuuuaaauagauguaguuuauuuuacaguccaaaccuguuguuucaucuauucccauaagauccacaggcagcauccuucuccauuuggauggggacagugagguuuauauaccuugauugguaagccugugucugauguuuuaagugccuuaucccuuaaauuguaaacucuacaggacuuagaccaugugugucuuguucacuguauuguuaacagcuggcagauaguaaagauuuuuuuuuuuuuuuuuuuuuuuuuaaauaagagugauuaaaucaguuuguuuugugaugcuugugugaagagaagugauuaguguaaacuggcuuugcuuuaggguuuucauucucuaaauucuugaagcauucuagaguaggaauuguugucuauuuaguuuaaacaggauuuuuuuccaguuucuucuuaguaauuaagcuauuacuagguuuauuauucucuuacaugugugcauuuaaaaaauuugaaacacaucucgccuccuuuacaguuugguaaaggcugccuuggcgucccaaaguggugagauuacaggugugcgccacugugccuggccagcugaaguuuuugauucccagccuuauucucugucuuugcaccucagugaugcuccaguaagcaucaucuguuuuucucaaacugcuugauauaaugguaacucauauaguuugauaaugaggauaucuaaaaaugauuauuuccaguucaaauacguccauuaaucugcaugcuuaauccuaauuuuuuucuugucacacugccuucugaguuauuauaguggcuuauacauuuuaugguuucuagaaucuuuuugagugagaaucauugagaauauuuguguuuuuaaucucuucuguuuaucucuucuguugaugugcuuuuuguuaauuauuuggcuggcuuuuaguggaucuugcacaauuuaaugcuggcacaugauaaguucauaauaaauguuucugauuaucgagcugagccccagucaugaaccauugauuucuaacauacucucucccuuuagcaaccugguuaccucugcccuuaaaugaacauaaccccugaugccaugacauacauggagacuucaguauuaauuuuucaguucuuguauguaacacucuuagguagagucucugucagauggcacugauaauuaauccuuuggaaagaucccaagggcuuucaggcucucuggcuagauguuaacaacaggaacagugaguaguauauagcaacaugauacuugacaguuuuaaagcaacacugguuuuauuuaagaucaucggguuaaaccagcuaauacuccuuuggcuuaaaaccuacuuguaguuuuuacuguuugguauucucuucucagaauuguucuuuauauauguagcagaggcugcacgugauggcucaccucuguaaucccagcacuuugggagggugaugcaggaggauugcuugagcacaggaguuugagaccagccuaagcaacauagugagacccuaccuuuccaaaaaauuaaaauauugucugggggugguggcacaugccuguaaucccagccacuugggaaguugaggugggaggaucacuugagcaaaggaguuugaggcugcagugagcuaugaucgugccacugcacuccagccugggugacaaagcaagaccuugucucugauugauugauagcuagguagguagguagguagauagaugauugauugauugauugauugauagauaaauagauagcagagaucaugacaagucugugucccacuugaagauuagaagacucagcaggugggcucuuggcuuaaaaagaaggcaaagguagccgggcacgguggcucaugccuguaaucccagcgcuuugggaggcugaggugggcggaucaugaggucaggaguucaagaccagccuggccaagauggugaaacccugucucuacuaaaaauacaaaaaauuagccaggugugguggcgggcgccuguaauccaagcuacuggggaggcugaggcagagaauugcgugaacccaggagguggagguugcagugagccgagauuguaccacugcacuccagccuggccgacagagcaagacucuguuucaaaaaaaaaaagaaggcaaaggugauagguguuuugggacucacagucagacucaugaaggcuuugucccaaucuugagaagaagaagggacccuuaggaagauugggaccuugccaagacguagcauguagcagaguaucgaagaauacucuuuuuagagcacuuacaaauaugaauuaauucuuacgguagcacugugauaagcaauuguaguuuacuaauggcaagaccaaauaaagugaaauucaauuaauguuuguuaaaugacguugagcacuauacuuagugcuuguccaaggcuucagagcuguaaaugcaaauggcaaacacuguauuuugcuaagacagcaccucaguuucucugucuguaaauauaaucccagaguuauaagguuguaauuaagaaauuauuuuuuauuuuugagacaggaucucacucuguugcccugguuggggugcagugguucagacacagcucacuacagcuucgaccuucugggcccaagugauucuucugccucagccuuccaaagugcugggauuacaggcauaagcugcucuaccuggucaaaaaauauucuucuugaauauuuagagauuagaaugcaaauguuucaaaauauacuuguuuagguuuucauguuucaugcauuuucaaaggaguaaaaauaauuacagaaaagagaaacaaauguaguuuauaauuauaucuuuucugcuuaacuauuaugauuuaguuaaucaaacacaagguaaaaagcugaacuugaauucuuguucuguaguacuuuaaccaaguguuuauuucacaaaaucaaaauaugagcacuugguuuaaguauuacagaauaagaauucaaguucaguuuuuuaccugucuuugagauguuaguauaacaucuaaaugaagaugucuugcagauaguuagaacuggauucauaguggaaguggggaagaaaggaucaagaaauagcuuuggaagguaucagaaaggucccaaucauaaugguagcuauacuuugauugauauggaggacaaagauggcuaauuagaguaccuuagguacaaagcaccauuaauggacagaaagaagaaaagguauuagcaaaauuacauuauuauccuacaacaacauaauuuuaccuuuguguaacugcuuauaccuuucaaaccaguaauauccauuaucuuacuugauacugaaauaguuugaaauaaagcaggugacuucuuaguacaacauguuaauuuuagagaaacuagcuaguacuguuuuuucuagaaacucugauuauauuauaaagacaaaaccuagauacuuuacauugaauuauuuuguacuugauugguacauuguuaauauuuuucaaagaaauagcaauuuuguugaacuagagccaggucucaauuuucucucuggcuuucuuuguggcaccauacuccuguaaaaccaucaaugcucauuaagcuguggaucacuuuggcuuuucuuaaccuggcuaaagcaguguuauccacaaguuucauuucagagaagauagaacuuuguaaauaaccugaaggcaccuuuauagcuaccuuucuauugucucugaggguaggucacaggcugugauggggaagaagaaaagcguucugagguuugagaaaaaguggugagaauuugaauaguuuuuuguggagugugagcaacugaauuaaucagaaaugugguaggauuucugaauuaauuagaaaguaaagaauuaaauuuucuaauaguagcuacauuaaaaguaaaaagggccgggcgugguggcucccagcacuuugggaggccaaggcgggaggaucaugaagucaggaguucgagacuagccuuaccaacauggugaacccccgucucuacuaaaaauacaaaaauuagccgggcaugguggcacgugccuauaauaccagcuacucgggaggcugaggcaggagaaucgcuugaaccugggagguggagguugcagugagccgagaucgcgccauugcacuccagccuggguggcagagcgagagucugucucaaaaaaagaaaaaaaaguaaaaagaaacaagugaaauugauuuuaauaucuuauacuuaacccaguaaauuaaaaaguuauuauuuuaacauaucaauauaaaaauuaagauaucuuuuuaauuuuguacuugagucuuugaaaucugguguauauuguguguugacaguauaucugaauuugacuagccacauuucaagaguucaacagucauaugugguuaguaacuaucuauuggacagugugggucgaaaguaauuaaaaauaaauuuugaacugcauagacacgucaucuauuuacaugaauguguguguguguguaugugcgugugugcgugcgcacgcgcauguuuagcaauucuuaggguuaagacaauucauuugauaggccuggguugaugaacucaacggaaguugaugugaauaaaaaugaaaaugagggcuuggcgcggugguccacgccuguaaucccagcacuuugggaggccgagguugggaguucaagaccagccugccaacauggugaaacccugucucuacuaaaaaaaauacaaaaauuagcugggccucgugggaggcaccuguaaucccagcuacuugggaggcugaagcagaauugcuugggccuggaaagcggagguugcaaugagcugagauugcaccauuacacuccagcuugggugacagagcaagacugugucucaaaaaacaaaaaaaaaaagaaagugagauugaguucaaagggaagucauugcaaggaggcagugccaguacuaaacuuaauaccuccguccuguguagacacauccacuuuguugaauggaaagcuggccucuuacuacccuucaacuacuuuauuuuuucugaugacuuguaauaaauaccgucuaccuggaagucaguguguuacaauuagaaugugaggauuagaagaaacuaauauagguaggacuaggaaaaaauaauagguuagagugauaaaguaaaaauuuuaagaauacaugcaauaguauaaaaaucaaaagauauaaaaagauuauguaucaaauauaaagcucuuauccucuagccaucugauucccuuccuugagaguaacuagaauaguuucuuaugucuuauuuaucuuuuaggaguagccuaugcauuuacaaguguauacauacuuuuuugucuuuccuugaauaaaccaauaaaauacuuauauccuuuugaaaauauacaaaagguagcagcauacaauacacaccauuuaccauuuuacaucuugcuucccgccccccaccccccaccccccccccgccuuaaucuaucuuguagcugcuuuguuguuuuuaaagucuauauaauauuucauuguauggauguaccauaauuuauguaaccaguuuuuuauuguugguuauuuaaauuguuuucaauauuuugcccuuacaaucaauacuguaaugaauaucuuuggguauaucuguugaacaccuaugugaauuauguggaauaaauucucauaaguagaauuucuuguucaaaagguuuuuuuuuuaauuguauaaauauugccaaaugcaauagagguuuuuaccaguuaacacuuccaacuaauaaugugugaauaaacuuuuucuuaaauaaaacugauucuacaaaccgagucuuaggagaaaauaaaauuuauaaauaauaaaauuuuuauugugcuguugaauugaagaggcauagauaacccccuuuugucuugacaugauccuuuugagcaaccucagaggagccccuagaguugcagaggcauagacugaaaacaccgauaaccagcucccuuuauuuuaucuaugaagaagagagcucugaagggaugaagcuguuccuccaagaccacccaaaaaacagaaaaacaugaacuauagaacccucagauaggaauaggaauggcuuggaaauguaugcagaaguguuuuguguaacagguaaaccccaauuaauuacuuuuugagaaucaaaccuuuuuaaaauaacauuugcuguuugauuuuguuuuaguaagcuucaugguuaguggagccuuggcagccuaagggauccuuggaguggaaaagggaacuugguggucagagacaagggaggaaguccuaccuucauauuucugacauggugacaacugauaugaagagcaaaaggggcaaagacuagcagaagagaaugagggguggaggggcaaaagggucucaaguaccuacccagugccuggugcaugguggcugcucaguaaugguaguuccuuacugguggaaguauggacuggucugaccauuuugaaggaugguacuuaaucagauuaugcauuauguauaccuuguaacccagcaacuuuuuuccuguauauauacgugaaagaaguucucacacagguucauaaggggucauucauuucaguguauuuguucuuguggaaaguaauuuguuguccauacccuuuccccagugauggguaaaaugugaucauagauuuauaccucaguuugaaguaauggucuagaugugcacauggcagccuaaggaucuuagagacauagugcugaguaacaacagaaagaaaaggaaugagauauguaacacaauagcauuuauauacauuuuaaaauguauguaaguaaaacauuacauacuuuacaagaaaacauguuaacacauuaaacacauuauagugauugccuguguuguggaugauaggaguggaauaaaagaauaagcaaauaagaguaaaaauacacaaauguaaaacuucauuucuguauggaggugaucuuuaaagcaucuguuggauaauuaggaggacaccuacagaucaguaccccugugucucccauucucccauugugguuaccuuugggaguaaaauuucugguaacgaauuaccauuggaauauuuuuuguuguuaauuuaacugaaaguaaaucagauucacaguucucaauuuuuuuuuuuuuuugccuuuaaaaggaaaaaaaaaaagaaucccccauccuucacuuuuucuguuacuguguauucuguuggauuguugcuuaaauacaaaauacuaaccuuaugccuaauuuagguacuacguguauaccaggacuacaugauauccuucuuagaagauaauacuuagugacauuaauaauucauugggagacuucuccauguucuuuuagauaauugccuuuucugauuaaagcuuggaaugccaauaguuggaauaaagcagucacuucuuugaucuguuacccauuauaaaauuuauguuauuuaucuugcuuuuuuuuuuuuuuuuuuuacaagaaucucugcuuauagcagauaaaaauacugacugacuuccagagaguucccugagauaccagguaagaucuuggauagaauggaguguaggaaacaaacaguuccuaucguaagcaauuuuuguugcuagaacaaaauccuuuuguaggucaugaacuuuugaguagccugaguuuugaguuagccucaauuaagguuuuugguuguuuuaccacccaggcuccagauuagcaacuggagacaggagcugugauggaauuaaaguaaccguggcaaccauuauaauguaaaugagccuucuugggcaggaaguugagagcgugagcacuuguuagggcauuccuuuauuacaucuacaacuagagcugaguagcauuuugcuauuuuaaaauccugcuccuuggacaccaucaaguccuguguuauuccaaccuucuuuuaguuuucugagaaacuaacaccaaacuaauauguauauaaaauaggaaaugaaucucuggugugccuccuucauucacauuaagaccucuucuuccuuuaauaacauuaccuuuuucccacugcuucuggcaauaacacucagcaccaagucucugauaaacaaagaaggccacuuagguuuugagagaugugguguguaccuaguauacucugauggccaagauuuggcuuaugguggaacaaguggugccagggccccuucuuaagcagcacaggagcgacaaaucuuuggucucaaaucuuaauuuuuuauauuagucuuuaaaauuuuaaauuauuuuaaaauuuuuuucaauaagucuuuuguacuccuaaccuuugaauuucaagucauaagauuguaaguuuuagaguauuaauguaggcuuacucuuuguggauuuagagauuagaugacuggaggagaauaauaaaagugaaacugaaguaauuaccaaaugagguugaguucuaaguuaaguacuguacuuguuuacuaccccacaaugaguccagugauuuuaacaacaaggcuuguaagcgagaagcuuaagguuccuauucaagguuaacuauuguuaugauguuggugcuaggaaaauaacuucccucaaccucaguuuuucucuuuguaaaggaagagugaaaacgacgacucacucuguuguggggaaauacuuacaaaaggaaauaaaauuuaacuaguaguauggucaagaaugucagcugagguuggccaggcgagguagcucacaucuguaauuccagugcuuugggagguugaagcaggcagaucaucugaggucaggaguucgagaccagccuggccaacauggugaaacccugucuuugcuaaaaauacaaaacuagcugggcaugguggcaugugccuguaaucccagcuacuugggagacugaggcaggagaaucgcuugaacccaggaggcgaagguugcagugagccgagaucaugccuuugcccuccagccugggcaacgugagugaaacuccaucucaaaaaaaaaaaaaaaaagcugauauaagacaaauucugauuuuuaagguaaugugccuuaguuaugccugcuuagcuugugccaguuaaggcuuuuuacuuugauuuuaaguuuccuuccuccuacuucauccuuuuguugaguugucauucagaucacaacagauacucuuguauaacugucuuuguuggcuuagucuucaacagguggauugaucuuggacuucaaauauuugagcauuuacuauaugcaaagcuuggaacugggugcauagggaauaaauauaaaauguauacaagugugauuccugcccuucaauauacaaucauucaaauacuuguagacaguucugcucuuacuuuuccuaccccagauagucucuucuccauggaaaucauuccugcuucucuuaaucauucuucauaugauguagucggccaggccauuacuaccauccuggcuaucagcaucacuuguaagaggucauguuucaaauuauaauucucaggguguugcuugaccuguuucauauuucaaauuauaauucucaggguguugcuugaccuguuucaauuuucuuccuuguucaggucacuguacuguuauuuuauuaccuaugaauuuguauuaacuuuuaagcugucaauucaguacaaaggcccaccuugagcuuacagucaacugaacucucaucaacacauguuaaaauugguuucaauuuuuuuuuuuugagacggagucuugcccugucacccaggcuggagugcaguggcacgaucucugcucacugcaaccuccgccuccuggguucaagugauucuccugccucagccucccgaguagcugggauuacaggcguacgccaccacccucggcuaauuuuuuguaucuuuaguagagacaguguuucaccauguugggcaggcuggucucgaacuccugaccuuaagugaucugcccaucucggccucccaaagugcugggauuacaggcgugagccaccguaccuggccugaaauggauuucuuauucgcuguauacuucuaaaaaauaaaugcauguauauuuacccuugauaaauuuuauuuuguauuuucagcacguuguuucuauauguucagauauuugaucuuuuauaaucuuuaaugauaucucuuauaucuuuaaugguauuauuuaaucuuuauagauagguuuagaucaccagaaaauuuauaagcuaccauuuaaaucuucacaauauugauaaacaucuacuaagauaaggccaaauagagaguucuguggcaacuguuaguuacuucuuuccagauuuacauuaaacaauugauuaauaaucuuagaaucguuguucaaccaauuguaaaucuaucacuuaacuagcauaagaaaguuaaucuugauuucagcaauauguauuggaccuacuuuauguuauuucucugaucucuuagucuaauacuuuugucaaaaguaaaaugagguuagcaugauuguuuuucuuggugaaccccauucugacucacuguguucucuguaccccuucccuaccccaccguaggcuaacauaggaaaucuuuguuaaacccuuaaucuaugauuucaauaaucuagucucuuuuuuuccuuugaaauugagaaaauuaaaauugcacuuuauuguuucuagucuucuagcuucucuuccauuuuucaugagagaucauggagaucuuaggcuguaauuuaucugguucuagauauuugcauuuacuaaaagcuacugggugcucuuuuauuaucuuuucuccuauuucaggcuucaguuuccucuuaaccauuugcauucucuuuucaguauggaaaguuacucuggauaaagaaaaugcaagcaaaauaagaguugaauagguuugauuuucuguauuauuuuuuaacaugguagaagggccugucucauauuuuugcauauaacaucacugaaaaaagacuauauguuugcacuuuucauaagcuuauauugauauucuauuaugugccaggcacugcauuagauucuugggcuccaaauauaaauaagauauggucucuguucucaaggaggucacaauauaauuggagagauacguauuuauauaaauauuuacuguauagcaagagccgcuggccaggaucagaaaacauacuuugaggguuagaaaaauaagacagggauuuaugcugaauaagguggcgaaauguacauuuucaauaagcuauaggaggagucaugaauauuuaugaaaggagaaacauguacaugcacaguugagcuucuuaccccuuuauggguugcauguacagagaaaaggcaguauuagcaugauccaaggguggaguuuuugagccucuggccucaaaaggugaagcagaggacaugaaaagccucacugcgcauccucuguagacuggccagaaccacuccgugguugguggucuccuauuaggaaggaaugcugguuggugguugugaggaaaccacaagagggaggggcaaugucaggagguugguuuauauuagcaguggagcaaguaaaaaggcugguuucuguuuaacccuuaggaaagaagccuaaugcugggcagcaagggauggguauaaugaggugugucugaccuuucacuuggucauggcugggaacucagauuucagggcuucucuggggucuccuuggccaagagauggucacuucagucaguuggggggcuuagaauuuuauuucucaggaggaacaacauuccuuuuuaugaagaauagcauauaauaagcugacaugaaaauggaggguaaaggcuaccugauguguuuagaaaucuuaaaauaauccaggaugguuggaauacggaauaggagucccaagaaaugaggcuggaggugggaccauaaaagaaagggccuuauauucuuugcuagaauuuggacuccaggaggcacaggaguaucaccgaaggguuuuaagcuggggaugugaucaaaaccaagccugucuagucaguccuuccuuaugacauacuauauaauuaaguuuagucuguuauguugugguuacaaacaguccccauauuuuaguggcuuacaauaacaaggauuuauuuuuugcucauacugcauguccauuguguagcuuuguuccaagacuuaggcuagaugcucauaucugagacauuuucucuuguauuagagauaaauaaggcaugguagaaccacaccauuucucugaaaguuucuguucagaagugggaugugucauuuccucuuacuucccagcgucauuggcuaaagcaagucauguggccaaacuugauaucaacuggaccaguugucuaauucuccaccaggaaggagcagugauuuuugaauaauaauggcaucuauuuacauguaucaaauuuuauuucuuugcuuuccgggauuaccugggagcaucuggugacuguguucccagugacuugaaguagcuugagggaauaaagcuaguuguaggcagagaaacgagagacaagaaaauguccuggcagcuuuaauuuguuucucuucucccugaggcuguccugguuccugaaauuuuccuuugugucuguaagcuaauaggagagugucaugaucagaugugcauuuuagcaagauuacuucagaugcaauauggagaauggggagaaugcauucgaguaaaagcaggaagaacaguuagugccuuguguagaaagaauuuuuaguaaucuguuucagauauagaaggacaaacuaagggccuggcaauagaaaugugggauucuuuuagaguuaccucugaguccuggcuauuguggggagaaauaaaagagaaggaagagaguuauguccagguaaggcauuugaguagaugguggugccauucaccaacauaagggguaaaacaggucagaggagaagauauuuuauuuuauuuuauuuuuuauuuuuuugagacggagucaugcucugucgccuaggcuggagugcaguggcgccaucucggcucacugcaagcuccaccuccuggcuucacaccauucuccugcuucagccuccuaaguagcugggacuacaggcacccgccaccaugcccggcuaauuuuuuguauuuuuaguagagacgggguuucaccuuguuagccaggauggucucaaucuccugaccucgugauccacccgccucagccucccaaagugcgggauuacaggcgugagccacugcgcccggccaguagaagauauuuuagacauugaguuugaggugucuguggaacaucuaaguggagaugacuaguaggcaaauuggauaaaccgguaucgagcucacgggauguaaagaguguuauuaaaaugaugguucauggaauguaaggguaagaaaucauggauaagaaggaaaggaagaaaggagaugaccgagagauugaaguaaaagaauuagugagcuaaagucugugaaauuauaguagagaaaauuaaacaagcaagcuaaaaagaagucagagaacaggauacccaaauuagccauuauggagauggaacaguuucuaguggugauaaggucuggaguaaccuugguugugcuuagcugaguuagaauggagcagaacgucauugaagaugacaucaaggaacucgaaggcuaaggucuuuaugggccacccacguggauuguugcuuguucagugugacagagacuccuaguuguuuacucaguauccaguuucuacuucuuccuuacuagcagaacgcuaggcaauaugcauuggaaaaacuauacauagaauuaaauucaacugcauauaacaguaacccccaauaacaaugccuuauauuguauaugaguuuauuuuuauuaaaaaaucagcuucguuucacauuuuuuacagaauuuaugguauuuauuagauucuaacuugaguaaguuauauacaugauuuauuaaaucuggucaauuguaauccagaauguauguacuguguuuuauuuauaaagaaauauagagagaaacauuuacaagauuggugugauggcuccuccacagggauuagagacccagacuccugucauuuuucucuccauuguucuuaguaugcugcuuccaucauuagggaugcuuucauggcuuaagaugacugcuggagcucagggcauuauuucagcauuauaugaagcaagaaggaggaaggggaaaaaggcaaaaagggcaucccagaagccccacccaacaacuuccgcuuccauuucaucugauaaacucagguugauggugggauuuaggaugacuagaaucugagagaggaauuugauagguggcaguaacuagggaaagagaugagggaguugaauggcaugaccuuaaaggggcugcuuuauuauaagagagugaaguaguauucuggcagaguguggcaagugcacagguucugagggggugugugugggugaaggaaguuuaucagacauuuuucaggaauuagcaaggaggcacgugcagcuggaguagaguaaguaagggggagaguuguggagauuaaggcuggcagguaaugagccagugucauguaugguguuaauaggucauauucaggauuaugcuuuaacuuuugcuuuaaaugagauagaaaaccauuggaaaguuuugagcaaagaaugacaggaucauauuuaaguuuugaaaagaucgcucuggcuguaggguugagaauagacugaaggggucaggagaccaguuaggagguuacugcaauaacuagagaagagacgauaguaguuuggagcagauaauagcggugacgaugagagaaguggccagauucugcauauauaguagagcaaaaaagauaugcuaauguauuugaugaguguuugaaagagaaaaguuuuggaugacuucaaagucuuuguccagaacaacuguaaguauaaaaacaauagggagaaguuguccaaaaugaggauaauuguauugcuacagugaccuucuguagguguaaucagugucuuccuguuuuaguauauuccuguuucuugucuccuuuucuuuuuucucagugcacauuuaacuaguuuucaauacauucgcuauuuugcucagccaacaaaugacuguuaacaauuacaaaguuguuucagccuuuaucgguuaggcuucuuugguugcaaaacaaaccaaaauugacuuuguucaauugacuuaagcaaaaaagguaguggaugagaaggagggaggggaaaggauaauagagguaagucacagaauaaggaaaugcuaaagaauuacaccuuggggcugggcgugguggcucacgccuguaaucccaguuacucuggaggcugagucaggagaauggcuugaacccaggaggcagagagguugcagugagccgagaucucacaauugcacuccauccugggcaacaagagugaaacuccgucccccgccaaaaaaaaaaaauuacaccuugggagaacccugaacuaaaguaucucacugagaucuagauagcauaauggacauaaugguuuuuaucaggguaacgucuucuggacaaaucacucauauaauugaguaucuaauuuaauaaugguacugagcuagauacugagggcggggaauaggaggggcaauccaaagcugaauaaaauauauuacauaccuuuggaggauuauaauagaguagaauuaaugaaucaugucuaucacuuauucaaauuagaauguaauaaauaccauaaaugcuacaaaagauauuaaacaaagaugauuagaugauuuuguaugacuaaccauagcaauauuuuaacauuuuagauacaaauagauuuuaaaggaaagauagacauaagaaaaugucagauaaauuuuuuuuuuuugcccacuaaacgcaaaauauuuauguuguggagacauaguaaauuaugauacauucauagagcauaauacuaagcagccaucagaaaugauguugcacaaguaugccuaaugagaaggggaaaugaucauuuuguuuuaagugaaaacaaaaaaagauuaugaaaucacacaaauagaaaaucugaaauuuaacaugaguggggugugugguguauguaugagagagaguaguacacccuccaaguuauugaguucacucaagggguguguguguguguguguguguguguguguguguguguguacacccuccaacuuauugaguucaaucaagccuuauuagguauuuuuuuuugagacagaguuucacucuugucgcccaggcuggagugcaguggcgugaucucaucucacugcaaacuccaccucccagguucaagcgagucuccugccucagccucccuaguagcugggauuguaggugccugccaccaugccuggcuaauuuuuguauuuuuaguagagacaggguuucuccauguuguccaagcuggucucgaacuccugaccucaagucaucugcccaccuuggccuccaaaggugcugggauuagaagcaugagccacugcgccccuccccaagccuuauuagauuugaauguuagcaucaauaguauauugaagguggaggugaggcuaguauugaaagugaagagagaauaaucaggcuauuguaauuaucuaaguaagagaggauaaggaccugacccuaagauaggaaguagaaaagagggaaucuugugggagagaugguaagaugauggaauugauagaauuuggugacugacuucuguaugugugugggaguggaugcucugugugauaacagagagaugaguuucuagucuuauaugauuggguaaauggucauacuccuauuuauuuaaaaguaccuauaacaugggaguagaaagcucugaaaauguggcauaugaucuguuuuaagaaaaaagaggaugaggggaaauagagagagaggaaagugaggaauuucuuuugacgacuuuuuggacaaacuugcuauuuuaguucacucccuuuuuacuccuaguucuacuaggaguaaacguaguaguuuaaacuaguaauuaguaauuuaguaaauuuaaacuaauaauuuccaagucagaauuuuaacagucaugacugauuuuuaagccucuauguuaucuugaggaucuuguuuuuaccagcuauaccuuaaagaagcucagcuuugaaagggcuuugugacauaaccagguuuuggaaagaucaagguaugaaaaugcuguaacuuugaaggcagcauuagggaguuugcuugugcuuucuuuuuuuguuuuuguuuuuguuuuuugagacggagucuuacucuguugcccaggcuggagugcaguggcaugaucucagcucaccacaaccuccaucucccggauucaagugauucuccugccucagccuccugaguagcugggacuacaggcacgggccaccauacccggcuaauuuuuguauuuuuauaguagagaugagguuucacuauguaggccaggccagucuaaggccagauccugaccuuaggauccacccgcuucggccucccaaaguguugggauuauaggcgugagccacugcaccuggccgcuugugcuuucuugggaacgacauuaaugcugugguugaaucuuuccuuuguuuaaacaaaccaaaaguaagauuugaaggcugccuggugggcugaauuucucuuuugguagaauguuuuagcuuuuugaaaauaaguagaccucuuuacuuuuuaaaaguaacuuuauugagauauaauuucauacugcgaaguucacucauuuaaagcauacaauucagugagugauuuuuuuucauauuuacagaguguauaaccauuacuguaauuuaauuuuggaacauuuucaucaucccagaaagaaaccuuguaguaaucauucccuaggcaaccacgaaucuauuuucugucucuggacguuucauauaauuugccuauucuggacauuucauauaaaugggaucauaaccauauguguagaccuuuuggcuuucaaaguuucuuuuuuuucuuuucuuuuuuuccuaaaugauuccuguuuuuuuuuuuuuuucacuuacucuguugcccagucugaagugugguguggcacgaugauggcccagugcagccucaaccucccaggcucaagccauccucccacaucagccuacugaguccuacugggaccaccauggugugcaccaccaugccuaauuuuuuuuuuuuuugagacagagucuugcucuauuggccagguuggagugcaguggcacaauuucagcucacugcaaccuccgccuccuggguucaggugauucuccugccucacccuccuggguagcugggauuacaggcacgcauuaccaugccuggcuaauuuuuuuuuuauuuugaguagagaugggguuucaccaugcuaaccaggcuggucuugaacuccugagcucgugauucacccaccucaaccucucaaaguguugggauuauaggcgggagccacugugccgguuuuguuuuguuuuguuuuguuuuguuuuuuaauagagaugggggucucacuauguugccuaggcuugucuugaacuccucggcucaagcagcccuccugccuaagccucucaaaguguagccaccauauccggcccuaaaugaguucuuuuuguauuccguaauuuuuagaguucaccuuaaauuuuacagugucuauagauugauaaauuugcuugauacuuaauucaugcuuauauccuuaucacuaaaugcauaauauaugucaaauaaauuauuuguaauggauuuuuuauggacauuaaaauauauucuuuauugauauuguuccagugucugacuuucauuuauaauuucauauuaccauuuuugcuccuaucuacuacucacuuucuagcuaaaguguuuauacuuacagugauggaaaguuuuugacuugggccuuccuuauuccugcguauuauuuaauuuuacaguguuugguagaagcaaggucaaaaguuuacugaaaagaaaaugaagcccauuaggagacuauuagguauaucuuaauauuuccuuucucaguuccuuuagauccuuccucauuguauuaucugggucacacugguugagggauucuaccuuccuaauguaacgucaguuguguuuagaacugccuugacauacguaccugcuugauuggcguccucuucuauuagucaccagaguacagagauacucaguuccaaugauaaaaauaguauacauucccuuuaguuagaaucuucuuagugcaaauaaccuuggaccuauggguccuguccaugauaaaaggcagaacauuuuucacuuuuuucuuugaguuucucuuccugugacuucccccuccuuguuauauguuuuacauuugacaaagggggaaagaacacucaagauuccuagucauaugccagauaaauauauaauagacauuauuuuaaaucuauagcugagcuugugaaaaaguaaggaaaauccuuaggggcaaaaaaaugaugagggcauugaaaaucaguguuaaguacauaagcuaaaguuacggcugcucuggaugacuaagagacuuaguuuuaacaaccacaugggaauaagagacuuuuuuacucccuugcagaaagcuaaguuccucaaaggguuuccacauuauugaaaagaugaucuagaaaaaacauuugccccauggcauagagaaaugucaaggaaguuuguccacuccgugugggcuuuaggugagaaagguuucucugagaauuuguuaccugggguugucuucacauagguucaguuuagaauguuccucuuuuucugcaguccaggaaacccaaagccaagaaauuaacauauaaaguagucuugaaucugcaacaguccuacggcaucaggcugaagcaagugcaaaacuucucuauagggauauccucaaucuaggccacaccaaaucucacagcuaaaggugcucuaaaaaaaaaaaguuugggccgggcgugguggcucaugccuguaaucccagcacuuugggaggccgaggcgggcggaucacgaggucaggagaugagaccauccuggcuaacacggugaaaucccguuucuacuaaaaauacaaaaaauuagcugggcgugguggcaggcgccuguagucccagcuauucgggaggcuaaggcagaagaauggcgugaacccgagagguggagcuugcagugagccgagauggugccacugcaauccagccugggcaacagaacgagacugucuccaaaaaaaaaaaaaaaaaaaagaguuuuaaaauagaccuucaaaaaauauagucacugaaacuuaaaauuugguggacaauaucaaugguagaauggauacauuaugguauauucauagaacagaauacuauuaagcaauggaaaugaauaaauugcugcuaugcauaagaucauggcugaauaacaauaauguugaaggaaggaagccagauguaaaauaauauauacuauguuauuuuauuuauauaaagcuaaaaacccgggugcggguaacauuggauuuuuguccugggugauaguuacauggcuguuucacucuguuauaauucauugaauuuauaauuuguauacuuccuccauuuaauagaaagcagauaaggaaaauguaauaaaugucauagaaaagauaggauaaauagaaagcauaauaaaagaugguagagauaaauccaaaugcaucaguaaucauacugaacauaaaugaauuacacuuauugaaacaaagacagauuguuguagcauguuuucaagauggcugauguuaguuccuucccuccacaugugcaccacccccaucuagugguggaguuuauuccucuguucauaccaaaucugggcuggccuuagugacuuguuuggugaaauguggcagagauaacauucugggacuuucaaggccaggucaugaaaaguuuugcagcuuccaucuaggccuauuugaacauucucuuuuggauugcugugcuauggaacauuuagucuuggaaccuagcugccaugcugugaggaguccaagccagauggagaggcucagcugagcuccuagccaacagcuagcaucacuuuucagcuacgugaguuccaguuccagugggcaucauauggagaaaagcccaggcccuaggcguauggcucccagucuaguuauccucaaucaauggagccaccuuaccugaggccccagauguuauagagcagacacgagcuguuccugcuauacucugucugaaucagaauugugaguauaauaaaaugguuguaguuuuaugccacuaagcuuuaggguaguuuguagugauagauaacugaaaccaaauuugguaccuugaaauaaggugcugccaaaaccuacaauuugcauuggcuuuggaauuuggugaggguuaaagauggagggaccuugagaagacagugaaggcuugaaacacagagagaaaaguguuauuggaggcugggaaaagagugaaccuuuguuauauagugauucaagguuuauugguacugccacaugugguuacauagaccauagaaaauguaucuaaugacuucaguguaucuaaggagauuucuaggcagaauguugaaaaaauguuaccuaguuuuuucuaaguaugauaagguacaaauugauaaaugaacuaaaaaaugaacuacuaaguuuuaaaacagaacuuagaggaaauauuucuaacccaggaaugguuguguuauuauagaaaauaaaacuuuuucucaucucuaguugcuucaaauggccaaugacuuuuauuuuauuauuauuauuauuauuuugagauaguuuuucugucacuuaggcuggagugcaguggugcucacugcaaccucugccucccgggaucaagugauucuccugccucaaccuccugaguagcugggauuacaggugcccgccaugaugcccagcuguuuuuuuguauuuuugguagagacaggguuucaccauaucagccaggcuggucucaaacuccugagcucaagugauccauccgccuuagccucccaaagugcugggauuauaggcaugagccacugcgccuagccugaccaaugacuucuaaauaaauggcuucagaggaaagauaaaauucaagaugcuaccaauaaaauauggccucaaaguaaagaucucagugaugcaacuguaaaucccuuugcuaagacuuuuuuuuuuuuuuuuuuuuuuuugagacggaguuucgcucuuguugcccaggcuggagugcaauggcaugaucuuggcucaccgcaaccucugccucccugguucaagcaauucuccugccucaaccucccuaguaucugggauuacaggcaugcaucaccacgccuggcuaauuuuguauuuuuaguagagacgagguuucuccaugauggucaggcucgucucgaacucccgaccucaggugauccgcccaccucggccucccaaagugcugggauuauaggcaugagccacugcgccuggccgacuucagaaagauuuaagacaaugccucacaaaaccuuucaauuagauaaagggauaucuagaggucuuaagggaauacuucuuaggcuuacuauguuaaacaauagggcuucuagggaucuuaaguguguuuucucacaguagccucacauaagacuugcgauagaaaagguggauguggcuuuugucugcuggagugaaucccaauaagauucauaggaaauccacaagauuuuaaagaaaucauaauaauaaaagaggaacagagacaguagaaagugaaaauaggccuuuagauuuccaaucaucuauaggcaggaaacaagcuuauaaggccacuccauugcaaaaauuaacccaucucuuauguaaaaagaagguuaauucagaaacuuagaggguggagccaaggguuguggagagucauucucaagguguaggacuuggcuguaauagaggaacuggugauaugugucugauuagauuucagaauuguuaugggccaguaacuguuaugugucuccuguuccuucucccuuuuuccucacauuuugaaugagagugucuauugugcuuaucuuaagucagucucacuauuguauguuuguauguugggugugugggagcagauaauuuguuucuuuaauucagaucaggaggaacuauacugcaguagcuguaccugaggaacugcaucugaggagccucaaccacaucuggaccugauuuagauaucgagauucuggacaucaagcugaugccauaaugaaaugagacuuuugaaggucuuagaagagggugaguguauuuugcaugugggagggccuuguuggggccagaggguggucugugguagcuuguauccaaaguggccgccaccaauuucuucccuucuugcuauucagugguggagucuauuucccuuguccccuugaaucugggcuggcuuuagugacuugcuuaaccaauagacuguaacuuucugggacuucagaggcuaggucaugaaaagccuugugucuucugccugugcccguuggaauccucucucuuggacugcuugcacauagaacccggucaccaugcugugagaauccccagccagauggagaggacacauguaggcacugguugauagccccauugagcuaccagcaaagagccaguaucaacugucagccuuaggagugagugaaggaaccauguugaauaauccagcccuagcagacaccaucuggagaagagccaagguuucagacuuauggcacauguuaagacaucucagccaucuucauccuuucagggcaucccaccugaguuucccagacaucgucaaucagagacaagcggucucugcugugcccugccagaauuuguggcccacagaaucaugagaauaauaaaaugauuauuguuuaacacuacuaagauuuagaauaguuuuuaaauuuagccguagauaacuggaacauggccaggcgcaguggcucacaccucuaauuccagaacuuugggaggcugaggcgggugggucaccugaggucaggaguuugagaccagccuggccaacauauugaaacccaaucucuacuaaaaauacaaaaauuagccaggcaugguggugugcaccuguaaugguugcaggcgccuguaaucccagccacucaggaggcugaggcaggagaaucucaugaacccgggaggcagagguugcagugagcugagauugugccacugcacuccagccugggugacacagcaagaccuugucuccaaaaaauaaaaaaauaaaaaaauaacuggaacauugccaaacugaauagaaaauaauccaagucuaugcaguuuguaagaaauacaccuaagacauaaggaaugagagagacuggaaauaaagauauggaaaaaucuauuccaaaagaaagcuggcauagcagguuaauaguagccaaaacugauuugaaggcaaaaaucauuauuugcguuaaaaauuaucagaaaaaaauuguaaaggaagaauuaagcaagaagcuauaauuccaaaucaguaugcaucuuauagcauggccuuaaaauagauagauagaauacaaaauauguagauagaauauaggaagaaaauauauagauacaaauaugaauaaauuuauaaaucuauaaaauggaaaaauuuaacaugucuuuuugaguaauugauggucaaacagacaaaaacaacuugagaagauaacagaagauuugaacaaccaaccaacaggcuucauuuuuuggauauguaccaagccccacgcuuaauagaugagaauauacauucuuuuuagggaguuuuaaaaaaauugaacacacacugaauucauaaaucaagucucaacaaaaccaaugaauggauauuaugcaaacuauucucguacucaauucaguuaagacugaaauugagcaaaaagauaaccaaaauaauuuuauauauuuggaaauuuaaaagcauacuucuaaguaacucauagaucaaagaaaaaauaauaauggaaauuauaaguaaagccgaaugauaauauaaauacuguguaucagaauuauggguuacaacuaaagcagcauuuagagggaaauuuauaucaucacaaagaagaugaggguaagaaaaacuaauuaagaacauuaaaaaagccaaagggaaauuuacagccuuacaugcuuauauuagaaaaaaaacagaguucauuauuuauuagucuuaguauuugacugagaaguuauuuuuaaaaagaaaugaauaaaaaccaaggaaaguagaagggaagaauaaaaaaaaaaaccagaacugaaugaaauugaaaacaggcugggcacaguggcucaugccuauaaucccagcacuuugggaggcugaggcagguggaucacuugaggucaggaguucaagaccagccuggccaacauggugaaauuccgucucuacuaaaaguauaaaaaugcugugcaugguggugggcaccuguaaucccagcuacuugggaggcugaggcaugagaauugcuuaaaccuggaaggcagagguugcaguaaguugagaucaugccacugcacuccagccugggcaacugucucaaaaaaaaaaaaaaagaaaaaaaccacaaagauauaaaagaauuaacagcaacaaaaguugguuuucuaaaaaaaaagauuaaaauaagacaaagcccugcaaagauuaaucagcaagacagagugaagauacagauaccacuaagauugaacaagaagacauaucuacaaauacagcauagauuaugaaauaacaaauguauuauuaacaaaucuauggugcuaaauuguacagcuuagauaaaaagaacagcguugugaaaaauauauauaacuuaccaaaauugacucaaggaggaauacaaaccugaagagaccuauaaucauuaaauauuuugaauuaauaaguaaaauacuaccuaauugaaaagaggcacagaugcaauuuuuacaauaguuuuauaaagggguauaauugacaaacaaaaaacugcagauauuuaaagguuacaacuuggaaaguuuugacacaugucuaaaaccaugaaacuauuguuacaaugaagauaaagaacauauuuauuaccucuaaagucucucucuuuuuuuuuuuuuuuuuugagauagagucuugcucugucgcccaggcuagauggaguggugccaccuuagcucacugcaaccuccgccuccuggguucaagcaauucuccugccucagccuccugaguagcuggaauuacaggugcgcaccaccacacccagcuaauuuuuuuguauuuuuaguggagacaggguuuugccauguugcccaggcuggucucgaacuccugggcucaggcaauccaccugccucggccucccaaagugcuaggauuacaggcgugagccacugcgccuggccucuccugucucuaccacccaguuucaucccuaggcaaucacugaucugcuucauauaauaauagagucugcauuuucuaggcuuuuaaguggaaucaaguaguauguacucuuuggggagaggggagugggguaauucuggcuucuuccacuuagcaucauuauuucgagauuuauuuauguuguugauugaucaaaggucuuuuucauugcauaguaguaccaucguaugguuagaccacauuugauuuauucguucaccuguugacagccacuuggguuauuuccaguuugaggcuaucauaaauaaugcuucugugaacauuuauuagagauauguuuuuguuccucguuguuaaauaucuggaagugugaugguuggauuauauaaguguacgguuuaauuuuuaagaaaccgccaaacuguuuuccaaagagguuuugccguuuuacauucccaccagguuugaauuccuccacauccucaucaacauuugguauggucagucuuuauuuuuagccauucugauuagcauaaaauaguauuucauugugguuuuaauguacuuaagugacuaaugcugagaaucuuuucauguacuuuuugucauuuguaugucucuugugguaaagugucuauuuaaauauuuugaccauuuuauuuuauuuuuuauuuuuuuagagauggggucucccuguguugcccaggcuggucucaaacuccuggguucaagugauccuccuccaucagucucccaguguguugggauuacaggcgugagucaccacauccagucucuuuuuaccauuuuuaauuaauuggguuguuuauuuucuaauuauugaguuuugagaguuauuuauauauucuagauauaaguccuuuaucagauagaugauuugcaaauauuuccucccagucuguggcuuauuuuuuuuauucucuucacaaugccuuucgaaaagcaaaaucuuuguauuuucaugaagcccaauuuaucaauuugcuguuuuauggcuuguaguuuuggugucauaucuaagaaaucuuuguccaacccaagauuagaagagcuuucucuuauguuuucuucuagaagcuuuauaauucuggcuuaacauuuuauaccaauggcccauuuugaguuaauuuuugcauaugguacaagguuuguauugaagcucuuuuuuuuuuuuuuuuuuugcauaugaauaucuaauuguugcaguaucauuuguugguaagacucuucuccacugaauugcucuugcaccuuuguugaaaaucaguugucuacggauguguggguguauuuuuggacuuucuucuguuccauugaucuguuugucuaacuugacacaacuaccacauuauuuuuauagcuauaguuuuuauaagucuuaaaaacugauagagguaguccuccagcuuuguauuucuuuuucaaaguuguuuugacucuucugcgcccuuuacauuuccaugugaauuuuagaaucaguuugucagauucuacaacaaagcaucugggauuuuuauuggaauuguauugaaucugcauuuggagagaauugauagcuuaacaauauugaaucuuuuggccaugaauggcauaucuguaccaucuuguggacaucuuuuauuucucucagaaguguuugguaguuuuuuuuuuuuuuccugccucagccucccgaguagcugggauuacagacgcacgccacaagaccuggcuaauuuuuguauuuuuaauagagaugagguucgccauguuggccaggcuggucucacacucccaaccucaggugauccccccaccccggcuuccuggccaguguuuaauaguuuucaauaggucuugcauaucuuuuguccaauguaucgauguuucauguuccauguuucauguuuuuguuauuacccuggaaagggguccuaaucuagaccccaagagaggauucuugguucucaugcaagaaagaauuuguggugaguccacagaguaaaaugaaugcaaguuuaagaaaguaaaggaauaaaagaauggcugcuucauaagcagagcagcccugagugcugcugguuggcuauuuuugugguuauuucuugaucauauauguucaacaagggguggauuauucauucaugaguuuugcaggaaaaggggaggcauuucccacaacuaagggguccccuuccuuuuaggguaacuucugauguugccaugguauuuguaaacugucacggcacuggugggagugucuuuuagcauacuaaugcauuaucauuagcauauaaccagcagugaggacaaccagaggcaccucuugguuuuggucagcuucuuuaccgcauccuguuuuaucaguggugucuuaguuaccugugucuugugccaaccuccuaucucauccugugacuaagaaugccuagcuuccugggaaugcagcccagcaggucucauuuuacccagccucuauuuaagauggagucgccuugguucuaaugcuucugacaauaugguugcuuuuugcuaauauacagaaauaucaauugacuuuuauaaauugaucuuauagucuuuaaguuugcuaaauacuuuuuuuuuuugagagagucucgcucuguugcccaggcuggaguacaguggcacgaucucggcucacugcaaccucugccuccuuuguucaagcaguucuucugccucagccucccuaguagcugggauugcaggcgcccaccaccauguccagcugauuuuuguauuuuaguagacacgagguuucgccguguuggccaggcuggucuggaacuccugaccugaagcaauccaccugccuuggccucccaaaguguugggauuacaagcaugagccacuaugcucggcccuaaauuugcuaaauucuuguuuuaguucuaguagcuuuuuuguagauuccaucagauuuucaacugaggcaguuuuuugucaacuaugaguaaagacaguuuuacgacucgcuuucuagucuagauacuuuauaaguucuuauuuuauuguacuuuucagaugaucccauacaauguugaauagaaguggugagaguagacaccaauaaguaugauauuagcuguuguuuuuuuuuuagauccccuuuaucauguugagaaaguuuccuuguauuccuaguuuucugacaguuuucaucaggaauuucugguggauuuugucuaaugcauuuucuguaucuauugaaaugaucacaugaucuuuuuaauuuuguuaacauggugaguuacauugauucuuuuuuuuuuuuuuugagacagagucucgcucugucgcccaggcuggagugcaguggugccaucuuggcucacugcaaccucugccuccugguucaagugauucuccuaccucagccuccugaguagcugggacuacaggcgcccgccaccaugccuggcuaauuuuuuguauuuuuaguagagaugggguuucaccauguuagccaggauggucucgaucuccugaccucaugaucugcccaccuuggccucccaaagugcugggauuacaggcaugagccaccacacccggcccauugauucauuuuuaaauguuaaacucaccuucuauucuuaggguaaauuucacuugauugugauguauucuuuuuauauauugcugggcuugguuugcugaaauuuuuaaaauauuuuuucaucuauguucaugagaguuauuaguaugcaauuuucuuuaggucuuugcaaggcuuugguauuaggauaaugcugacaucauaaaaugggguaggaaauguuucuucuuuucaguguucuagaagaguuuuuauagauuuccuucugaucuuuauuuucuuucuucugguugcuuuguauuuuauuaguucuucuguuucuagauuuuuuuuuuuuuuuuuuuuuuuuugagacagggucucccucugucacccaggcuagagugcaauggcgugaucucggcucacugcaaacuccgcauccugggcucaaaugauccuucugccucagccucucaaguagcugggacuacaugccuggcaccaccaucccuggcuaauuuuugcauuuuuuguagagauaggguuuugccauguugcccgggcuggucuugaacuccuguacucaagugauccgccugccuuggccucccaaagugcugggauuacaggcgugagccacugcaccuggccauguuucuugauucuugaaauggaagcugaagucuuuuauuugagaccuucuuuuauuaauaggaauguuuaguguuauacauuuccuuuagugcugcuuuagcaacauuccacaaauuuugauguacuuucauuuucauucaguuagaaacacuuccuaauuucccuuuugauuuguucuuugacccaucaguuacuuagguauguauuacuuuacuuccugauauuugggaguuuugcagauauuuuccuuuguugauuccuaauuuaauuccauuaugguuagagaacauacuuuguaugacucuaauucuuuuauauuuauugaggauugauuuauggccucaaauauggcuuaucuugguaaauuuuuuauaugcacugaaaaaauauuuuucuauuauuggugcauuuuucuuguguuuuuuguucuuaugguucauuuagcaucuuagaucuaugaguuuauugucaauaucaaauuuggaaaaauuuggccacuauuucuuuaaauaucccuguuuauccucucuuuacuucugggaacucuaguuacauguauauuaaacugcuuaaaguguucccagaauucacucauggucuuuuuauucuuuuuccacucugguuuacuuuggguaguuuuuauuaugugucuucuaguucacucaucucuuauguuuugucugaucugccaucagucuuauccaaugcauuuuucauauuagacauuauucuuuuuaucuguagaaguuggauuuaggccuuauuuucuuucucccauguuucuacuuagcuuuuugaauauggaauaacuuuguuaauucccuugucugcuaauucuaacauauaugucaauuuuguuagcuucaguugauugauuuuuuucuucuucaugggucauauuuucuuugcauguuugauaaauuuuuguggauuauaaacauugugaauuuuaccuguuuagguacuggauuuuuuuuuuauuuguucugugucacaguuaauuuauuaauacaguugaauccuuuccuuaagauuuguuucaaaaacauagagagaagagggggagaaaaaaaaauauuuguuagguggggccagagcaguuuuccaucuaggguaguuacuccccaggauccuuggaauacucuaccucgugccuuguuaauuacgggguuuuccaguuuggcuggugggaacaggcauuguucuuguucuguuugagugccaguuaguguucccucuaguuuucuaaguaguuccuacaugcacucacuggucaguaccccacugaguacuuaagaggagcccacugcagagcuccaggugcucccagcaugcagcgcguuuuccaguacuccauccugcacacugucucugccuuggccuucccagacucucagcucaaucucuucaacgaagauagcccugggcucuacuuggguuccuccuucauuaaacugcaccuuggaaauauucucaaggcaguaagcagaagcauucacagaacuuacuucacuuguuuucugucucucagggauugcuguucuucauugccuaaugugcagugucuuugaaaccaucauuucauguauuuucucugcuuuuuuuguuuguuuguuucaggcagguagguaaaucuuauacuuguuauuacauauuggcuagaaauggaaguccauuauuuuaaauacuucuuaugugcuugaaauguuucaggauaaacauauagacuaaauggauauauuugccaaagaugagguacugacagaaauuuucuagacuuuaaaauuaaguuucaccuucuucucuuccaucauuuugagacuaaaguuuuauauuuuaaguguuuuuugguauuugcuugugcuuugcuuuuuaucuauaaaaaagagguuuaauauguucuaugguugugugacucaaacaauauaguacuuuuuguaccacaggcccugaggucugaacucagcaucacuaucuuuuuucauauuagcuuccaaauagcaucagguggucauuuuuaaaauuuaaaaccagucuaccuaucuuguuugauuugaucuugugaccuuagggaagaaacccacccaggaauagaauaaagaaacuuuuuacauccugaggcuuuaaaaaacaaaaucaaaauccagcuauuuaaaaaauuuuaauaucuuuaaaccuuucuacaauggagucauuuuuuuaaaagaaagcacuguccuuugccugguuaaugaauaaugugaguacuauuuuauuauaaauaauugauuuccaggacuuccugggguaggaagaauguguccuagcugaauaaauuaagggaagugauaaggacugaauucuguuaguggaaguaauaaacgaaagaaaguuaugugguugggguugacugugagcagagagugauuccguaguuaagaugaagggauuuguuagucuucucagagaggaaggacaagcgugaggaauaggaaaauuucaccuguaggugggauggaaaaagcuuggaauaauuggccgggcaugguggcucacgccuguaaucccagcacuuugggaggcugaggugggcggaucaccuaaggucaggaguucaagaccagucuggccaacauggugaaacccccaucucuaauaaaaauaaaaaaauuagcugggcaugguggcaugugccuguaaucccagcugcuugguaggcugaggcaggagaaucgcuggaacccaggaggcagagguuacagugagccaagaucgcaccacugcacuccagccuagaugacagaguugagacuucgucucaaaaaaaaaaaaaaaaaaaagcuuggaauaguuguuugggggccauccugagacaaugugauucucacauaugggaguaugaagauaaggaaucucuuggagaauucuagcuugugacuuucacuccugcuuucucuuucuccucuauguucaguaugcaauuguugauuaauugaaaaggaguggaaaugaaaaaacuaaaaaauuuuuuuuucaaacuagaaaaaugucuuaagaaauugaaaaugaaaucauuaguuucuagagcuuuauuuuuggcaaacuagaauaauccaaguuuuauuuuacuaauuuuauagaauuauagcccuaggaagguaagcaaauuucuguuuucugcuacaauauuuuuguaauggugaaaucuaguuaaaauauuuuggaguauaaaaaauuagaaaacaugguacagaagaggccagugcugcucagggguuaauaaggcugggacagccagcucuagcuguaagcauauguagguuuuaauauacuaaaggccgugagcuacagcuuuugcuuucucucccaucuauggccucccucguguauuuauauauguagccucccugauguguggauguauggauguauuuacagcuagcaucagcuaugguuagggcugcauucuuuucuuucucucccaucugaggccuccuggagucauucuugcaagaguucacacaaguuuguugaacugaauuaaacuucaaguuuuuguuagaagaauugggcagggaucagagcauagagauuccugauggagaauccaucaggcaaggaaaugaacagcucuuuguguccugagaugaccagcuucuccuacccagaccaggaaggauuguuuugccagucuucccauggugucagggaaccaggauugaggagucuaaauuucaguuuuggcaaguuggaaaagaaaaaaagguacaaaaaaaggaacuuagguugaacuuacugccaaucuuuccccagagggaaauguucuuccugaccuuguagaauccaugugauuaaaguucuucauguccuuuuuagaguucugagcaguaauccucuauuuucuuucucucucucucuuuuuuuuuuuuuuuuuuuuugagauagggucuggcucugucacccagguugcagugcaguggcacgaucucaaccuccaccuugcuaacugcaaccuucaccucccaggcucaagcaauccucccaccuuggucucuugaguagcugggacuauaggugugugccaccccacccagcuaauuuuuguauuuuguguagaggcaggggucucucuuuguugcccaagcuggucucaaauuccugaacucaaguaaucugcccaccuuggccucccuaagugcugggauuaggggcaugaaccaccaugccuggccuaaauccucuauuuaaaccagggccaccuuccuacccccaaccuccaccaaaaagaaauuuuaguuauaucaaaccaacuaguuuuaggucacagugucuuucuuuggagggugaaaaugaaagaauugaggcuacacaauauaaaaugaaaugguaaugugagcauuaauuagaauuauagguguuuuagagcaguaguucucaaacuuuuuugucucggggcccuuuacacucuuuauuuuuuauuuuuuugugugagauggagucuugcucuguugcccaggcuggagugcaguggcgcaaucucagcucacugcaaccucugccucccgguuucaagcuucucuccaugagacuugccuuggccuuuugcuuuuuuaccuuuaccugguuuucaaagacaaauauaaauaugagaggaggggaguuaguuuuuuuguuuguuuguuuguuuuguuuuguuuugagacaggguuucacucucaucacccaggcuggagugcaguggcaugcgcuuagcucacuacaaccuccaccuccugggcucaagugauccuccugccucagccucccgaguagcugggaccacaggcacaugccagugugccuggcuaauuguuuguauuuuuaguagagauggguuucaccauguuggccagccuggucuccaacuccugaccucaagugauccaccugccuuggccucccagagugcugggauuacaggggugagccaccacuuccagcuccuuuacacucuuaaaaauuaaggaucccaaagaguuuuugucucuguggguuauaucuauaucaauacuuacaauguuaggaauuaaaccugauaauuuaaaaauauugauugauugauugauuuaaaauagcuauaaacccgccauguguuauuuauuuuaaauggagacauuuaauaauauuuaaauauuaauaaauugaaaauaauaaucccacuauauguuaacauaaauaauauuuucaugaaaaguaacuacauuuucuaaaacaaagacauuuaaugggaagaaaagcauuguuuuauauuccugccaucucuuugauggccaaauucauaaaaaacuguuggauucucguaucugcuuuugccuuaucugauguguugccacacaucuuguauccucuggaaaacuccacuguacacuuauaaaauaauaagaguaaaaagaacaaauauaaucuuaggguuaucaugaaaauacuuuuaaccucaagcacccccuccagggauaccucaaguaguuucuggaccauauuuugagaccacuguucccaaacuguuuaugugugagaaaagagaaacacaagaguuaucaccauuacuucuacagcagauuuuuccuuguguuuaaucaguacuggcuguuuagccuaauuaagcaguauaacauccagacuccagaauugaagugggugguauagcugaaaacuccaagcacuguaccgggaguaagucucaguuuaaugugcuuuuuaaaaguaguuguuguucaguguuuuuguaggcuauugcuaaccagugggagaggaaaguuaaggcagcucucugggaaagaaaaaccaaggaauuuuagagauuaaaaaugaccuuuaaagauaaucuggucaucgaauuuuagacuauuggauuugaaagucagaugcugagaggucaucuaauccaacccuuaagcuuuuuagugauuauaauuaguacuugugauacacaggcuaaguucuuuauguagagcuccuucuccccacgucauuuugauguuuacuguuucuuuugaauguuuuuuauaauggaaaaugucgaucauguacuccauuacucaccuucaacaauugugaauucauggccacuuguuucacauauagcccuguccacaccauccacucccuggauuauuggaugcaaauugaagaauuuuauagcuucaccuguaaacauaucacuauaucucuaaagauaaagaccuuaaauaacuucaauuccauuaucaugcuaaaaaauuagcaauaauuuuuaauagcauaaaaacccaauguucacauuucccucauuguguuauucauaaauguauauuuuuucaguauguuugaaucaggauacaaaugaguaucauauagugcaguuuauugauuugucucuuaacauuaguccucucuucuccccugcuuuuuguuuugcaguuuuuuguuguagaaaucaagucauuuguguuggcagaauuucccugagucugaauuuugcugauuacaucucuguggugucuuuuaacguguuccuuugucuucugcaacuccuguaaauuuguauuuguauuuauuuuaauuuaauuuuauuuuauuuuauugagacagagucucgcaucacucaggcuggagugcaguggcgugaucucggcucacugcacccuccaccuucuggguucaagcgauucuccuccucagccuccugaauagcugggauuacagaggcccgccaccacgccuggcuaauucuuguguuuuuaguagagacagggucucaucauauuggccaggcuggucucgaacuccugaccucaagugaucugccugccucagccucccaaagugcugggauuacaggcgugagccacugcgccuggcaguacuucuauuuagaagagugcucagacuucuucaugagugguguuaaguacuuccaucagaagguacauaaaugucugcaugucuuuuuuguuuuaaaauuuuaucuauuuauuauuauuauuuuugagacaaggccuuguucugucacccaggcuggaggugcaguagcaugaucauagcucacugcagcuucaaccuccugggcucaauugaucuucccaccucagcuuccugaguagcugcgacugcaggcaugcaccaccacgccuggcuaauuuuuguuuguuuguuuguuuauuuuguagagauagaguuuuaccguguugcccaggcugguccugaacuccugggcucaagccaucugccagccuucgucuuccaaagugcugggauuacagguauaagccaccacaacgggccuauuuuaauuuuuauuuuacuuuuuugagucagggucuugcugugucacccaggcuggagugcaguggcacaauuacagcucacugcagccucaaccuccugggcucaagugauccuccugccucagccugccuaauagcuaggagcacaggugugugccacaaugccuagcuaauuuuuaaauuuuuuuuguagagaugggaucucacuauguugccuaggcucgucuugaacuccuggguucaagcaguccucuugccuuggccucuccgaguguugagauugcgggcgcaagccaccucguccaaccugucucuuuuugugugauguuaguaacuauugaugauuuuuacuuagauccauuaaaucauuaagagcuauacaaugaugauauucuaguucuauuauucuuucauuuauuagcuggaauacuucuauaaagagaaaccuccccuuuucuaaucuucgauuuacccagugguauaauacauauuggaaagucaggaugaauauuuuguucuuuccccuuguuuaccaauuuucagaauacuguauugguucacuagcauucuccaauuaggcauugguuuugguggggguuuuuuugguaucauaaacucuuggguuuaaacauuuuugaauauguuucaauucauugcauuuuuuuccuuuucuagugauuuuacugauauauuucuucuuucuuucuuuuuuuuuuugagacggagucuugcucuguugcccaggcuggagugcaguggugcaaucucagcuaacugcaaccuccgccucuaggguucaagugauucuccugccucagucuccugaguagcugggauuacagccaugcaccaccucgcccaacuaauuuuguauuuuuaguagagaugggguuucuccauguuggucaggcuggucucgaacucuugaccucaggugauccucccgccucggccucccaaaguacuaggauuacaggcaccaugcccaguggcauauauauuucuucuaauaaacucagcuugaugaugaggacgugucuuagacaucuuucuguccauggugccuagugcguggcuuucaauaaaugucaaaugaaugaguugauauucugagcagcauuuaaaaauaagagcuaguggcugggcacgguggcucaugccuguaaucccagcacuuugggaggccaaggcgggcggaucacgaggucaggagaugagaccauucuggccaacauggugaaacccugucucuacuaaaaauacaaaaauuagccgggagugguggugggugccuuuagucccagcuacucgggaggcugaggcaggagaaugguaugaacccgggaggcggagcuugcagugagcugagauugcgccacugcacuccagccugggcgacagagugagacucugucucaaaaaaaaaaaaaaaaaguuuuggaggcaugacagaggagcaaaguccaguauuacuuuccugugugagcugaagaaagugcaguauaacaguaaaaaauaauaugguugcaggugaaagaaaaacauguuuuuuaaaaagugaauguggccgggcgugguggcucacgccuguaaucccagcacuuugggaggcugaggcagguggaucaugaggucaggaguucgagaccagccuggucaagauggugaaaccccaucucuacuaaaaaauacaaaaauuagccgggcgcaguggcgggcgccuguaaucccagcuacucaggaggcugaggcaggagaaucgcuugaacccgggagguggagugugcagugagccgagaucacgccacugcacucuagccugggcgacagagugagacuccaucucaaaaaaaaaaaacaaaacaaaacaguuaauauuauuuaauugccauuuguuaacagacguggcauuguuuccacuauuguuuccaguggaucuuuuaauuauauuuauuaaaauauaaaaaaaggaguaauucagaguccuugucuuuacuucacuugcuguaagauaaguaacauuuaaaagccaccuuuccuccccucagguucuuuucucuuuuaauauaaauggcaaagagcauacauguuuaugacagacauguuccccauaaguuuauucauuuauucuacaaacccccccaaaauuuugcagggaaguaaaacaaaacuaaguacccacaauaugugaggcaccgcucugaacauuuuugcauggauuauacauaucauuuauucuuaccacaacucuauaaaguugguaggauuauuaucaucgucuccuuuuuauagauuaaguaauugaagcacagacauuaaguaacuuacugagggcauacaacuagugaauauuagugcuaggauucaaaucaugcauucuuuuaccggagccucugcuguuaaauuacuuucagugacuuuacccgagaccuuuuuuuuuuuuuuuugcaggauggggugguauucauaaaagaauuuuauaaucaugugaauaauaaaauuuauugccacaaagucuuuuuuuuuucuuuuuuuuugagacagggucuugcugugucacccaggcuggagugcaguggcgugaucucaguucacuggaagccccaccucccagguucacgccguucuucgccucagccucccgaguagcugggacuacaggcacccgccaccaugccuggaaaauuuuguuuuuguauuuuuaguagagacgggguuucaccguguuagccaggauggucucaaucuccugaccucaugauccgcccgccucagccucccaaagugcuaggauuacaggugugagccacugcgcccggcccaaagucugucauuuuaugaugacaaauauggcuaaguuuuuuuuuaauggaacuuuauuccuccaaaaaaugacuuuuaauuuuucccaggccaucauuucaugguugguauuaagacaaacaauuaugaaguguugaagaauuaaguuccuauuauuacuguaucauguauuacuguaaaaaaauuagaauucauagaauuugcaaaucuugaacauuuuuaguaggacuacugcuuguaacaauuugcuuaccaucacuuucccuuugauuagauaauuauaacuuguuuugugugguuauaaacagguucauaacauucucauacaugaguccuaaagaggcagccauccuaguuucuucaucugucuuugcuucauugucaugaauuuaugcguggauaaagauaaaauaagucacaagcacuauaauaaucagcaguugucacagcugugaguauagcauauguaauagagcccacugguuguccaaaauugcuugcugacuagggcuauauaucauuccuuucucucccacucaguaaaguuaaaugugacacaagaaugaaaaugauguuaaggcugggcacgguggcucacgccuguaauccuagcacuuugggagucugagacaggcagaucaccugaggucaggaguucaagaccagccaggccaacauggugaaaccccaucuguacuaaaaauacaaaaauuaccugggcaugguggcacacaccaguaaucccagcuaguugggaggcugaggcaggagaauugcuggaacccaggaggcagagguugcaauaagccgagaucaugccacuguacuccagccugggugacagagugagacucugucuuaaaaaaaaaaacaaagaaaguaaguuauguuaauagggauugaauuuacuuuaacuuauucauuagaaaggaacuuaaauauuaggaacaaguuauuugggacacaguuuuauagcuucuagacugagaaacguuacucuuaaaagcauauugcuuugggaaugauaguaagaggaguaaagaauaaaagcauauugcuuacccacuuuuaaaauuauuuauuuauuuauuagagauggggucucacuguguugcccaggcuggucucaaacuaccaggcccaagcacuacucccaccucugccuccugaguagcugugauuauaggcgcuugccacugugccuggcuuucucaaguugaucagugaagacagaguuuuuggguuuuuuuuuugguaucuuucaaaguauggcauugagaaacucauuuguaaugguugcggaaaaggaauuuuuaaaaaaggaagcuaagaaauaauaaaugcuaaacuuauuguaauaaguuauaguuguugguuuuccaagacuaagagguuaaaaguacucuuaaagcacauaaaaguuauauacaaauauauguauaccccuucaacuaauaaccagagucuggccuugaaaauguucuaguagaagccacagauugauugugacuaaaacuggcuggacgcgggaggccaagaccagcggaucacuugagcccaggaguuugagaccagccugggcaacauggcaaaaccccaucucuacaaaaaauacaaaaaaauuagcugggcaugguggcacaugccuauagucccaguuacuaggggggugggaggacugcuugaauccagccugagcaacagagugaacccuugccucaaaccccucccccuaaaaaaaaaaccccaaaaacuuauuugaggaaacccaauacacacauaacauuuuuucaaacaaaaaugauaaaaauugcaacaauuaauuuaaguucuuauaggucagggaucuaacauguucaaauuguucaaauauuuauagcaguaaucucuuaacugucuuuuggaauauaguauaauuccaggagagagauggcuuaguaugaauuuguauauaguauugagauuaagacuuggaugugauuuguuccaaacuaauuuagagauuguuaauucacuuuuaggaacuaauuucacagucaacgugauuuuuuacuuauugguugugaaaagugcuuuaucugguuuguuugguaguaauggagaaagauuauuuagauuaauguuuguauuauuucacuuuguaucuaaucaguuauuuuguagaaaaagaaacauucuucucuucuuuauugggagacugaaagguguauucuagcuggcauuuaaauauauguuuaguugguagaacaauuacuuuguguaccuaugaugaauguuauuuauuuggacacauuugccuuuuccuauuuuuuucuuaauugguuugacugcaucucuaaaagcucucuuuagauugaugccaaaaaaucccacaugucugacggaagugccaggaaaguguuaaugcuucaauuuccuugauucuugucccuuaauuuuuaggggucauugaaaucagaaggguuagacucucuagaggcuguuggucuguuuaagaacuauuccagagaaggaaauuaacacuuacaugccuguuaguauuaggaauuugauguauuaacucauuuaauucuuagaauucugugagguagaugguauaucaauuuuucugauacagcaauugaagccaguuaucaauuuaccauaagucacacaccuuaaguggcaagaguguaaucugaauccauaucggucucuaaauaucucucuuucuacuacaccauguuaaucuauauccaccacaacacuguagcuguucaucugaacaggauaucuuuuauuagcaaauauuuuaauaagauggggcagguauugagauuaguagacguguuaaggagauugcaauaugugauguauagaaaaauccugggacuauaacuucauaaauuagaauuuuagauccacuauuaacguguacccuggauaagucauauguugccuuuguuguaguuuuccagucuguaaaaaugaagauguuaauaauaucuauucugccuucccagugggguguguugaauguguguuugcuggcuuugaaaaugauaaaacuuuaccaauguaaaguauuaaguaaugugguucucaggaguuguguggcuugauggauugguaccauucuuuuaaccaagaaacaauuaguugaucuuggcaguaggccauuggaacucaaagaaauagcaucugucaaucacagucauuucuuggaaggaagaauugaaaaauggcacaggaguuauucuccuugaccucuuucucugaaagggaauuugauuaggcaagcugguuucauaauagaguagagcuucucucuucucuccggggaauugaagcugagcagccaggcugguucugugaagccagagcaaucugguuuuaaaggauuuaacuaaauucucuaugauuaagguuuucugagggaugugcauugcugagcagcagcuuuaaaaauguuacguaugagucagucugugucccuagacugagaacagaguaguggaacugguuuaaguucagggaauagucuucaacaaguucauagcaucuugaagagaagccuagacucugaaagcugaaaaaauaggcaguaggagaccauuguauagacuguagaacugagaccccaucuagucauuauuugguauuucuccacaccuuuguuagugagcugacucaaguacuuuauaauauagaaaaauaaaacuaaaggucaacaaucaacauacaguaggugugcaguaaggauaugaauauguaauaaaaaugauuguaaauuuaugccuaauuauugucuuacagugaaggccgugaauggccagagaaacuacuuaaaacauuugaguuucugaaacuacaggcauccucagaggguuaaugcaugcucuuaguagaacucaaaugucucuaauuaggaagaucuuaauccuuuauucuuccaacaguugcugacuuugcuggggaguuguucguauauaugcagaauuaaagccacugguuuaaguaauuuggccaaagucaggauaaaaauagauuaguuucucuaaagcuucucugcguuuauacuguuaccuuuauuugcuaaauagauuuuggauaaauauauagcugguuuuagaucuuggaaucuuaguacuguagacagccacuugccuucgcugcuucaauccccauuccaguauguguuauuccaacucauuggagacuuuagaagugugauuagaugagucucauuuuggaggaaucauguaggauuaccccuaugauaguuacuuaaaauucuuaucacuauauuuaggagaaaacacauuuagauggaaguaaaaaaucaaggaaauaauaggaagaguagaagagagguugcauaaagggagccagugaguaaccucuguacaccuuaauauuccaucaaccacagacuuuucuuccaauuaaguacuuucccaaagaaucacaaacaucaggggaagaaagacaaaauuauuuucugguguuauguuggcauucauuggauuuaaauauuuuggggccagguaugguggcucacgccuauaaucgcagcacuuugggagacugaggugggaggaucacucaagcugagggguucaagaccagccugggcaacauacugagaccccaucucuacuuaaaaaaauuaaaaaauuaguugggcauguaacacaugccuguaguccagcuacuugggaggcugacguaggaggaucccuucagcccaggaguucaaggcuacagugagcuaugaucaugucacuguacucuauccugguugacagagugagacccugucucuaaaaaauaaaaauaaauaagaaauuuuggcuuccuagaaugguccaugcaguugauagagaguaaaugccugguuuauuaaaauggaaagguuaggaugcuuauaccuauuuuucacauaaucuggaagguaaauuaaguaaaaauuucaggacauucugauacuagguaguuuaaaacaauacucaaaugguuucugaaaauagccuuauaaaggagaauuaaacuaaauuggcucaguuggaguccuuacccuugcuuggugaguuagaguuuucggaagcuuaaaguuuauauucuuuuugagauuuaauauaugucaaccuuucugaaguggguagccaacuugugaagacuguguguacacaugcacacugaucuauuguagccuuggcacauugugugacuuuaaguagggugauuggggaugugaaagguaaaaggauuguagagagguggcugcuccaaagaggaggaauuucugaaaacaucacuguuuauuccaauuacaaauuuuuuguagugcuauguccccugguuaaugauggugucagugguugccugugaguccuuugcacucuaguaugcuuugcuuugaaguaaacuucaucuuaggaccgggcugaguugugcauacugcugaaauuaaagguacugaaaaagcauaggguagacaggccccaagggagaagcgacuguugggagcuuuggaaaacuagcgaacagcuccagagcacuggugcuuggggagcagaagugucacauguugagauaggaaauuuagaaugccuuugcuugagaccuaauuggucuccuuccuccuauagacugcuagaaauuucuacguagcucuggacuacgggucccgaaguuggaaccaccauucuauuccugucauuuguaguauggaaaaguaacuuuuuucuuguuuauaaaaugagaaaaauuuuugagaagaauuuuuuuuuaaugagugaaaguauaugguguuugauaggguaauugagagcuguaaucaaaaucauuaccuggcuggaugcaguggcucaugcuuguaaucccagcacuuugggaggccaaggcaugggaagauccuuugaaccugggaguuugagaccagccuggacaacauagggagagccagucucuaaaaaaaauuaaaaauuagcccgacauggugguggacuaauccacuaauagugucagcuacucaggagucuuaggugggaggauugcuugagcuggggagguugaggcugcagugagccaugauccugccccugcauuccagcuugggugacagcgagauccugucuccaaauaaacaaaucauuaccugcugaaauagucauucccaguuuauauaaucagauagcuagaggguaacuauagacaagaaagccugugguuuaauuugauaggaaagacucuaaccucauugagagaaaacgaucagaaaauauuccuuuucuaauggcaagagaggaaaaacuuauaaauuagguucauauuauauagggagugggguauucaccagccagccuauuucugauuccuuagugaaaucugauuuaggaaauacaagguagccugguuuuauuguugaacaagggaaggagaaaaucacuuugucuuaucuaguuaacuaaauauuucaagguaaggauaugaagauaguuuaaauuuccguuacaacugguaucaaauuuugcuucucugcuuugauuagaaacugucuccaccugcuggccgcaauucacuuggcauuucaugaggacaccugguuuuuuguuuuguuuucuugaaacauauaacagcuauggaaaguacuuaggcaggguuguagugacuaaaauaccucuauguagcuuuuccuaaaauucccagaaggauuuuggaguuuuuuccuaaacuuugcuugggggauaauggaaaagaagcaacguaaggccuuacaagaaccaaaccaaagcagcacauuugcaguguuuguuugauauuugucauucuaccaagugauuugucuauuuuauguauuauauuaaacuguuuaagcuuuguuauuuauaauuaaggucauuauuuuccaaauugcuguuaguuucaccucuuuugccuguuuggaaauaauuaucacaaucauuacugaauuauacaauaaaauaaaacuuuucuuggucuaaagguaggcaagcuuuuucuguaaaggcucagaugguaaguguuuuaggcuuugcaggcuauauguuuuuuguuguaacuacucaaaccuguuauuguagcgaaaaaaaguauauaggcaauacauaaaugaaugaguuccaaaaauacuuaauggaaaccaaaaauuugaauuugauacaauuuccaugugccaugauauauuguucuuuuuuaaauuuuuugacauuuuuggggggagaaucagggacagacuggaaauuuuucaaccauuuaaaaauguagaaacuauggggcaugguaguccaugucugugaucccaugggaagaucgcuugaggcugggaguuugagagcagccugggaaccauagcaaguccccuccucuaccaaaaaaaaaaaaacaaaaaacuauccgggcauaguggcucaccuguaguuucaacuauucaggaggcugaggugggagaguccaacuuguuuuuuuuuuuuuuuuuuuuuuuuuuuuuuuuuuuuuuuuuugagauggagucucgcucugucccccaggcuggagugcaguggcgcgaucucggcucacugcaagcuccgccucccggguucacgccauucuccugccucagccucccgaguaggugggacuacaggcacccgccaccacgccgugcuaauuuuuuguauuuuuaguagagacaggguuucaccauguuagcuaggauggugucgaucuccuuaccucgugauccacccgccuuggccucccaaagugcugggauuacaggcaugagccaucacgcccagccagauuccaacuuuuaggaguacuuccguaacaaagaaaacuugucagagggguguuguaccuguuccaucucaucaccaaccacauggcauagaaguacagaacuuuguauauguggaagaugauucuuuacccacacauguaggaucaugaccuguugugguuugauuauauacccacgguuuagauaauuuaaguucaaaacacugaaauaauuuuuuaaaggagaagacucuuuuuaaaauuuuugagaccagccuggaaauuuuauacauacaggagaaaacuugaaaaauuuuuuuauuuauuuaaaauuuuuaauuuucguggguacauaguaggugcauauauuuauggaguuuauggaauauuugauacaggcauauguugcgcaauaauuacaucaagguaaaugaggguaucuaucaacucaaccauuuaucauauuacaauccuauuauacucuuuuaguuauuuuaaaauguacaauuaaauuauuauugacuauaguuacccuguugugcuaucagauaccagaucuuauucauucuuccugguuuuuuguacccaugagccauccccgccucccccccagccuccucacuacccuucccaaccuuugguaaccaucauucuacucucuaucuccaugaguucaauucuuuuaauuuuuaucucccagaaauaggugagaauaugcaaaguuugucuuucugugccuggcuuauuucacuuaacauaaggauaucuacuuugauucauguuguugcaaaugacaggaucucauucuuuuuuauggcugaauaguacuccauugcuuauauguaccacauuuaaaaaaaucuauucgucuguugauggacacuuagguugcuuccaaauacuggcuguugugaacagugcuacaacaaacaugggagugcagauaucucuucaauauacugacuuccuuucuuuugaauauauguccaacagugggauugcuggauuauauggugguuuuauuuuuaauuuuuugaggagucucuaaauuguucuucauaguguaugaggguuuccuuuucuccauauccuugccagcauuuguuauugccugucuuuuggauauacgccauuucagcuguggcaagauauuucauuguaguuuuucuauguuuuuuugagauggagucucacucugucgcccaggcuggagcgcaguggcacaaucucagcucacugcaaucuccaccuccuggguaagggauucuccugccuuggccugccaaguaguugggauuacaaaucugaauaauuuuuguauuuuuagugaagaugugguuucaccauguuggccaggcugaucucaaacuccugaccucaacugaucugcccaccuuggccucccuaagugcuaggauuauaggugugagccacugcaccuggccuugagcaucuuuucauacaccuguuugccauuuguaugucuuuugagaaauaucuauucagaucuuuugcccauuuuuuaauugaauuauuagauuuuguuuccauaggguuguuugagcuccuuauauauuaugguuauuaauccuuugucagauggauaguuugcaaauacuuucucccauucuguggguugugucuucacuuuguugguuguuuccuuugcuguguagaagcuuuuuaacuugaugugaucugauuuguccauuuuugcuuugguuccugugcuugugggguauuuacucaagaaaucuuugcccacuccaauguccuggagaguuuccccaauguuuucuuuugguaguugcauaguuugaggucuuagauuuaaaucuuuaaucuauuuuuauuugauuuuuguauaugugagagauagaggucuaguuuuauucuucugcauauggauauccaguuuucccagcaccguuuauugaagagacuguucuuuccccaauguauaguuuuggcauguuugucaaaaaugaguucacuguagauguauggauuuguuucuggguucucuauucuguuccauuggucuaugugucuguuuuuaugccaguaccaugcuguuuugguuacuguagcucuguaguauaauuugaagucaggucguguuauuccuucaguuuuguucuuuuugcccaugauagcuuugacuauucugucacuuuuguaguucuauauaaauuuuaggauuuuuuuuuucuauuucugugaagaauguuauugggauuuggaaucuauagauucagugcaaucccuauuauuacacugauucugcuuuagguaggauggacauuuuuacaauauugauuguuccaauccguggacauggaaugucuuuuucuuggugcaggggguauucuuuucaaugucuugcaucaguguuuuauaguuuucauuguagauauauuucacuuauuugguuaauuccuagguauuuaauuuuaucuguaguuauuauaaauggcguuacuuccuugauuucuuuuucggauuacuugcuguugguauauagaaaugcuagugacuuuuguguguugauuuuacugaauuugcuuaucaguucuaauagguuuuugguggcgucuuuagguuuuuccaaauauaaggucauaucaucuacaaacaaggauaaugugacuucuuccuuuccaguuugagugcccuuauaucuuucucuugacucauugcucuagcuaggacuuccaguacuauauuggaucauaguggugaaagugggcauuguugucauguucuaaaucuuagaggaaaggcuuucaguuuuuccccauucaguaugauacuggcuguggguuguuguauauguuuuauuaugcugagguauguuucuucuauacucaguuauuuuuaggguuuuuaucaugaagugauguugaauuuuaucaaaugcuuuuucagcaucaguugaaaugaucauaugguucuuguccuucacucugaugauaggcuguaucacauugauugauugguguauguugauccauccuuauauccuugggauacaucucacuugaucaugaugaaugaucuuuuuaauguguuguugaauuugauuuguuaguauuuguugaggauuuuuacauaaauguucaucagagccuguaguuuucuuuuuuuggugugucuuuuucugauuuugguaucaggguaauacuggucucauagaaugaguuuggaaguauuccuuccaccuccauuuuuuggaauuguuugaguaagauugguguuaguucuucuuuaaauguuugguaaaauucagcagugaagccauugggucccaagcuuuucuuugcugggauacuucuuuguuuuuugagauggacuuucacucuuguugcccaggcuggagugcaaugacgugaucuuggcucaccgcaaccucugccuccgggguucaaguaauuccccugcuucagccucccaaguagcugcgauuauaggcauccgccaccacacccgguuaauuuuguauuuuuaguagagacugguuucuccauguuggucaggcuggucucgaacucccaaccucaggugaucugcccgccuuggccuccgaaagugcugggauuacaggcauaagccaccaugccuggccgacugagagauuuuuaacuuugacuuugaucuugcuacuuguuauugaucuguuuagguuuuagguuucuucaugauucaauuuugggagguuguaugugucaagaaauuuauccauuucuucuagguuuuccaauuuauuggcauauaauugcucauaguagccucaaaugguccuuugaguuucuacaguaucagcuguaaugucuucuuuuucaucucugauuuuauuuuggucuucucauguuuuuucuuagucuggcuaaagguuugucaauuucauuuaucuuuucaaagaaacaauuuuuuauuuuguugauauuuuguauuguuuucuucauuucaacuucauuuauuucuccucugaucuuuauuuauuuucuacuaacuuuggguuugguugggucuugcuuuucuacuuauuuaagaugcauuguuaggcuauuuauuugaugcguuucuacuuuuuugauauaggaacuuauagcuauaaacuucccucuuuggcugggugugguggcucacaccuguaaucauagcacuuugggaggcugaggcgggugaauugccugagcucaggaguuccagaccagccuaggcaacauggugaaacccugucucuacuaaaaauacaaaaaauuagucgggcauugguggugcaugccuguaaucccagcuacucaggaggcugaggcgcaagacucacuugaaccugggagcuggagguugcauugagcugacacaagacugucucaaaaaauaaaaaauaaaauaaaaauaaauaaauaaacaaacaaacuucccucuuaguacugcuuuagcuguaucccauagguuuggguauguuauguuuccauuaucauuuguuucaagaaauuccuucauguuuguaccauuuccaaaauucuuguuauugauuucuaguuuuauuccauuguggucagaaaaugcuugauauuacuucaguuuuuugaguguuuuaagacuugucuugugaccuaacauauaaucuguccuugagaaugauccauguacugaggagaagaauguguauuuugcagccauuggaugaaauguucuguaaauaucuauuagguccauuugguuuguagugcagauuaaguccaguguuucuuuguugauuuucugucuggaugaucuguccgaugcugaaaaugggauguugaagucucuagcuagcuauuguuuuggagucuuaucuauuuagcucuaauaauacuuccuuuauauaucugggugcuccaguguuggguacauauauauuuaaaauggcuacaucuucuugcugaauuaaccccuuuaucauuauauaaugaccuuuuucugucucuuuuuguaguuuuugucuugaaaucuauuuugucugauacaaauacaguuagucuugcucuuuuuugguuuccauugauauggaauauuuuuuuucauccuuucauuuucacucuauauguuucuuuaaaggugaaguguguuucuuguaggcaacagaucauugaaucuugcuuuuuuauccauucagccacucuaugucuuuugauuggggaguuuaguccauuuacauucaauguuauuauuaauaaguagggacuuacuccugccauuuuauuuguuuucugguuuuuuuuuuggucuucucuuucuucuuuucuuccuuccuauuuuccuuuuaguggaugugauuuucucuggugguauguuuuaauuucucccuuuuuauuuuuugcauauccacuauauguuuuuagauuugugguuaccaugaaguuugcaaauaauaucuuauaacccauuauuuuaaacugaugacaacaccgauuguauaaacagacaagcaaaaaaacuaauaaaaacuuuauacuuaggccgggcaugguggcucaugccuguaaucccagcacuuugggaggccgaggcgggcagaucacgaggucaagagauugagaccaucuuggucaacaaggugaaaccccgucucuacuaaaaauacaaaaauuagcugagcaugguggcacgugccuguagucccagcuacuugggaggcugaggcagcagaaucgcuugaauccgggaggcagagguugcagugaacugaaaucgugccacuggacuccagucugggugacagagcaauaauccaucucaaaaacaaacaaacaaacaaaaaaaaacacuuuauacuuuaacuucauaccccccacuuucuaauuuuuuguuguuucuauuuauaucuuauuguacugugucuugaaaaguuguaguuauuauuuuugaucaguucaucuuucuucugaaauaugaguuuacauaccacaauuaccuaaguucaaaaacacuugaaucuguguucuucuguguacuauuaccagugaguuuuauaccuucagaugauuucuuauugaucauuagcauccucuucuuucagauugaagaacucacuuuaguguuucguauaagacaggucugguguugaugaaauccuuuagcuuuuguaugucugggaaagucuuuauuucuccuucauguuugaagcauauuuucacuggauauacuguucuaggauaaaagauuuuuccuucaacacuuuaaauaugucaugccacucucuccuggccuguaagguuuccacugagaggucugcuggcagauguauuuggagcuccauuguauguuguuucuuuucucuuccugcuuuuaggauccuuucucuauccuugaccuuugggaguuuggauauuaagugcuuugagguagucguccuuggauuaaaucugcuugguguucuagaaccuucuuguacuugaauacugauaucuuucucuaggcuugggaaguucucuauuguuaucccuuugaauguacuuucuaugucugucucuaccuucucuuuaaggccaauaacucuuauauuugcccuuuugaggcuauguucuagaucuugucggugugcuuuauucuuuuguauucuuuuuucuuuugucuccucuggguguguguuuucaaauagccugucuucaggcucacaguucuucugcuugagcaauucugcuauuaagagacucugaugcauucuucagugugucaauuguauuuuuccacuacagaauuucugcuuuauucuuuuuuuaauuauuucaauuucaucguuaaguuuaucugauaagauucugaauucuuucuuaugucaucucgaauuucuuugaguuuccucaaaacaguuauuuugaauucugucugaaaggucacauaucucuguuucucugagauuggccucugaugccuaacuuuguuuguuuggucagaucauguuuuccuccuggucuugaugcuuguggauguuugucagugucugggcauugaagaguuggguauuuguugacuucuuagcaaucugggcuuauuuguaccugugcuucuugggaaggcuuuccagauauucaaagggacuuggguguugagaucuguuuuuggucacugcagccauaucugcauuaaguggcaccccaaacccaguaaugcuguaguucauacagacucguagagguaucaccucgauggucuuggguaagauccagaugaauucucuggauuaccaggcagagacucuuguuaccuuacuuucuuccaaacaaacggagucucucucugucucugugcugaacugccuggaccuaggggugagguaacacaagcagcccuguggccaccaacacugggacgcauugggucaguccugaagccaguaaaguguugaaucuuguccagggggugcugugaccacuaccuggcugcugcguauguucacucaaggccuuagggcucuacagucagcagguagugaagccagcuagucuugugccuuucccuucaggguggcaaguucccuugggcccugggcaaguccagagaugcuguucaggagccagcgcuuggaguuggaaaccuuagaaagaaaucuacuuggugcccuauuccauugcagcuaugcuggcagugaaaccacaagacaaauccuuccuauucuucccuacccuuuccccaggcagaggagucucuucccauguccaccaccaccaccacaggccuaugaguaccagggcaccacugauguucacuuaaggcccaagggcucuucagucagcuuguggugaaugcugccaggccuagaacucacccuucagggcagugggcuccccucuggcucaggguaggucuagaaaugcaaugcaagagccaaggccuggaaucagggaccccaagagccuguuugguacucuuccccacuuugacugaacugguaccuaagcugcaagacaaagucuccuuuauucuuuccucuccauuucucaagcagaaggauucucuccucauagccaacacagucgugaauuugcugggacacaccugaagucagcauggcucaagagucuuaccuaagacccauggcagguccuagcugguugccgcugcugauuauuuagagcccaagggcuguuuagucagcaggugaugaauccugccaggacuguuucccuucuggccuaagauaugucuagaaauguccgggagcuagggccuggaaugggaccuuaugauccugccuggugcucuuuccuacuguggcugaacugguaucuaaguuguaaaacaacauccucuuuacucuuccuucuccucuccucaagcagaagaaaggggucucuucugaagcugggagcuucaagcugcacugccuuggguugagggaggggugacgcaagcacucccuuagccacccuggcugacaucucacuaaguuaugugccccucaaguccccuggcuccaagcccagcacagcacuaggacuugcccaggaguuguaguccuaguggccuagacagccuuucaaguuuacuuagaaccccagagcacuuuagcccaugguagcaggccuuauggaaguuacagauaugacugcuggguugggugauuccccucuggcuagggcuuuucugaaugcucccucuguggguaccugcugaguccugucugguguugccagcacugaguuccaaugcaaaguugcacaaucacugagcucucccugccacagcauacagauugcccaugugggugcugccaggggaugggagagggguguuguugcauuucaagauuguuuuuccugccuuuuucaguaccucuuucagugauauguaguuaaaaccagguacugugauugcucacaugauuuugauucuaauugaaggugcuuuuuuuguguagauaguuguuaaauuugguguuccugcagggaggaugaucaguggagacuucuauucagcuaucuuacuccaugucuucucaggagaagauucuuuauguucauuuaaaaaacagaaacauucagauaguagaauuauucuaagacaguuucaaaaaagaaacuaucauuacaacugaagaauaauuugcuauagugaggagcaugugggguugguauugggugcccugggccacaugaucugggcagcaugguauggaucauucauuauaauuucagugugaugucacuguggucauguggugguucuuagucuauuuuggaagauaacuauuuuaaaacauugaauuaaaaauauuuaugguuaugggcugggcacaguggcucaugucuguaaucccagcacuuugggaggcugagaccaggcagaucaccugaagucaggaguucgagaccagccuggccaacauggugaaaccccgucucuacuaaaaauacaaaaauuagccgggcguggcggcgggcaccuguaaucccagcuacuugggaggcugagucaggagaaucacuugaacccaggagguggagguugcagugagcugagaucaugccacugcacucuagccugggcgacagagcaagacuucgucucaaaacaacaacaaaaauuaugguuaugucagguacaguggcucacaccuguaaucccagcacuuugggaggccaagaugggaggaucacuugaggcuaagaguuugagaucagucuagaaaacauagugagauuccaucucuacaaaaaguuuaaaaauuagcugggugugguagguacaugccuguagucccagcuacgugggagguuaaggugagaggaucacuugagccuaggaguuugaggcugcagugagaugugaucacaccacugcacuccagccugggcaacagagcaagaccuugucucaaaauaaauaaaugaaagaaaagaaaauuuaugguuacaaaugguucaucauuuuaguuugucacauauaaauaucuucuauucuuuugguucuuguccgcugccagcccccgcauuccuggaucaauuuuacagucugccuucucuguuucugccugugccuuaaaaacugagugcuauaaaguuauggaauugcugccucucuaagcucaugucucuaaauuccaaucucauuugaguucucuuuaccagucaccauuuuuuuuuuuaauuuuacguugguugguucccuuugccuuuuccuucagcagcuguuacagacuucuacucaucucagaccccuuccuaaucucugucucauugucauacaacccaccuuggaucugggacaccaaaaaguuuaggcuuucucuugugaacucuuucaacuuccuucugacuuucucauuacaugucucuguuugaccucauuuuuaccuuuuuccuuucugucccagaggaagagguuuagcucuucccauuuuagauaguugugacaucugucuaaauauaugauucuugauaccaucucauccaccuccuuggugacuuaauaacaucauuuauauccuugaucuucagucuuucccucuccauuaacuucauucccauuuaaaaaaaagaaaaaagaugacaaaauagaccccauaaaucucuaauccuaucuauauauacucuuuuagauuuaucauuucauuuucuguuugguaauagagcauuuauggucaccuuuucucugaaaccaugcuugcuaagaucaccaaggaucuccugucaaaucauucauucuuucaguggaaucaccagggaguuuauaugaagugauggagacaaggcugagaauggaccccaauggacaucaacauuugagggaauuggugaaggaaaagauaaugaaggaaauuagaagccaggguugaaggagaaagccaggagagugugguauuccaaaaagaagagaguuuuuaagaaggaggggaauuaaguguuaaaugcuauacagauguaaaauaaaaucaguauugaaaauaauucacugaauuuagcagcaaagcagugaaguguuaggauaguugguaagguuaaauugcacuggugagagacauuauuuguagggaagcaaaacaagcugggguagaaaacuguuuugaaaauauugacugugaagaauaagggaguuagaguugcuggagaggguugcaagcucuagggaaaauguuuuuuaaagcaguauauaacagacuugaugggccaggcguggugggucaugcuuguaauucuagcacuuugggaggcugaugugggcauaucacuuugagcucaggaguuugaguccagccugggcaacauggugaaacccuguuucuacaaaaauuacaauuagccaggugugguggcucacaccugcagucccagcuacucaggaggcugaggcuagagaauuguuugagcccaggaaacagagguuguagugagccaagaucacaccacugcacuccagccugggcaagagugaaacccugucucaaaaaaaaaaaaaaauguacgacagacuugaauauguuuaggugccuauggaagagaguuuggagaggaagaaagcaagauuggaagaagaagggaauaaaaauggacugaaguccuugaaaagaaagaaaggaacaugauucaaagcaugaauaggacgauuggccuuauuuacauagaaacaggauaucuuauacaguaagagaccuauuaauaugggaugccauggggccaguccuugaauaaguucaucucuuuucugucauggugaucguaccuauuccugugguuuuaaauaucaucuaaccuaaaugcugacaagucccaaacucuccugaauuccagacuugcaucucuaacugccaucuuuauauguucucucaggugucuguaaacauuucaaaacuuagcaugucaaaacugaauuccucugaaacuuacuucuucuacacucuggucuuaaccccaccccccaccgcgccagcaacuugggcagaaaguccuauugucauuguugacuacccucucuaauacuaaucugucagcaaauccuuuuggcucuacuuucaauauauucauagucuaaccacuucucaccacuuuggucuaagccacacugucacaucuuacguggauuauugcauagccuuccagauggucucugcuucuuuauugcuguuuccgucgucuguuuucaguuuauagcuggagggaacuuguuaaaaccuaugucagaucaugucacuguuagguucugacucuugcaguggcuucucaugucauggauaaugaaaggcaacggccuuaaaauugacuauaauuauauuaaacuaugaacucuuacuuauauuucuccuuguucauucugcuacacucuuuuuuuucuucuucuuuuggagacaacguuucgcucuugucauugccccaggcuggaguacaguggugcagucacagcucacuguagccucgaccucuugggcucaggcaguccucccaccucagccuccugaguagcugggaccaggcuggagugcaguggcgugaucacggcucacuguagucucuaccuguugggcuuaagugauucucucagcucaaccuccugaguagcugggaccacaagcguucaccaccaugccuggcuaauucugaaauuuuuuuguagauacagggucucccuguguugcccaggcuagucuucaacuacuggauucaagugauccuccugcuucagccucccaaagugcugggauuacaggcaugagccauugcacccagccuccuucauuuucuuuucuuucuuucuuuuuguugucuuuuagagauggaguuuugcucuguuacucaggcuggugugcaguggugccaucauagcucacugcagccucgaauuucugggccuaguccauccuccugccuuagccucccaaguagcugugauuacaggugugagccacuaugcucagcucugcuacacuccuucagaucucuaguucuuaauaguuuuuagucaggaggucaauauacaagauuaccuuuuugcuacaguuaccuauaacuauuuagacuuuuuuuauuugaaaaaauugagguguaaaauacacagauauuaagucuacagcauauauaacaccauccacauugagacauugaacguucucaucucucuagaacauucuuguauacucuuucccugucagaagcucccugccucucacccccacccguauguaaccacuauucagacuuacaucaccccauaaauuagguuuucuguuucuaaacuugagcccuacuuauuuaauacuguuagguguaauacuauagccugacccucuucaccaaucccugcuucugcacuugcuacuuuuuacccugcaguacuuuuucuuucuucugucucucuuaaccacuuucuaacauauaauuuaauauguuugauauuuauugucucucuccuagaaucuaagcuguacaagggcagggauuuuuguucugcuacaaccacccaaaacagucccuaauacacaguaaguguucgauaaauauuagugaaaugaaugaaugagaggucuggugaauggauauaaauuuguaggcaauccagaugggaggauucagaaauugaagaaaaucucauguuguauuuuuguuuuuagagaauaagggauaaaauugucuuuugggaguacagaggaggugauaggauugggguuuugaagacagugaaggaaguuugaaauguuagaagcaugggagauugaggauuugggcaauguagauuuauugcuuauuguuggaggcucaguguucuggccgugagugugguucauguaauaccagccaaugugguugaaugacuuacuucagcagaacuuagcucagguguagaaacagagaaaguugacaguguuuuuugcuguguaguuucaguggacagccagacagacaaaggaguuagccagauacugacugaagugauaauaccuugaguuuuggcuagccugagaaagaagcgauagucaagaaaaacagauugggauaguacaaaaggaucguuuccagagguaugguugaguucaaacuauuuccaaauagacacaaugaaaaaaauagaaugggauauugauaaaaggauuagcaguugucauaaaaguuaagauaccauaguugauugguuuuaaggaauacuuucuuuuccauuuuaacauuucuaaaguugagaugccaguuuaauugguaacacuuucuuuuuacuauuaugugaaaugauggugagucuuccaauuaauggcagauuugauaaaauacaguauuugaauguuagauuccagaaauguagcauuuauagguacugacaagguuaccagggcacagccauuagagaauauaacuaaaaaggagucgagaucaaguaucugguuagauaaauuaugcccauggacuucaaagacccagagucaugagcuaguuguaagaguuuucagcaaaugacauggagugacuagagguagcagauggcagcauagaaauagguagauaggaaaauucaccuucaagucaucccuucuagucucaugugucacuuucucagaggucuucccauaaaucuccucuccucaagucuaacuaugguuuuccucuguacugucucauaauaucuuauacuuuuucuuguguaauucuuuauucauuucuaauuaaucuuuuauuauaugauuauauuauguuuuucuuucaccagauuguaaacucauugacuguaggaauuguuuuugugcauugccuagcacauugucuuagcccauucaggcuguauacaaacuaccauagacugggugacuuaaaaacaacaguuuauuucucauaguucuggagaccaggaaguucaagaacaaggcaccaauagauucaguuucugguuagggcccacuuccugguucauagagagccauccucuagccauguccuugcauaguggaagggaugagagagcucucagcucucuuuuauaagggcacuaaucccauucaguccucaugaccuaaucauuucccaaaggccucacuuccaaauaccaacacauuggagauuagguuucaacauaugaauuugggaugggagugggguggggacacauaggacacacucuaggcacugaauaaaugaauugaaauagagaacguaagcugucugugaccagauuaaggauauaguacucuggaauaagguucuagaagccacaauggcaguacagaguacauuuuacuaaauuugauucuguuucagugguuggcuuauuugcugcuuuuuuuagcuuuaucuguuuucucugagccucaguuuccuccuguuagauuaagauacuaaugccuauuuaacaggguuaugguaaccauuaagugaguuuaguauggaaagcacaucauacagcaccuaccacauaguuggugcucuguaagugauaggcugaaauggccaucuucauuuuuuuccuucugaaaaaaacccuaugucuuaccuggacuauugcagcugacaccugacagucuugcuuuugucccuccucccucucuuuucuucucuacacuuauguugaauaauucuucuaaaauauugaucauguaaucuucccuuuuuguauuucuauaacgucugcucauugcuugcaugaucaaguucaaacuccuuggcuuggaauucaaagcacuucaggguccaguaccuugguucuuuccuaauccccuacuguccugugcugccauuucucuccugccuuuccuguuauacuccagcaacaucaugucauuuguuucccuugcaucccacauguucagcacucugccuuugcucuggaauuucucucugauugaaauguccuccuccuaggucugauggaguccuauucauucuuaaaguuaccaccuuucccaaccuuuauauauuuuccuauaauugcgugauuacacuguguuauaaauguaaauuuacaugucuuucuuuaaacaagacugugaguugcuugagggcaaaagcuauguauuuaccuuuauccacaacaccuguauccuagugggugauuaguaaaaguugauugaaccaaagggacuguggagaguuuacaaccuauuuauuuuacuuaaaacaguuacucgaaggaggagauagguuugaguguagguuuaacagggaaaaaaucuuaggugggaauccaguagagaggggagaaaauggucaguuaugaaaauuagccgucagccauuuuaguacuaaugucaggcugaaauaugaacaauauucauuggaaauuaacaauaggacacaauucuacucuuguuucagaggcggaagaggagaugcaagagaucugacagaaaaaacuaaaugaaaccccagagggccagagagacuugacagaaauggcagauaacaaacuugguuugggcuugaaaugugaucuagcagucaaaggaaagccagugcuauucugggcagcuaacaaagaagaauugugccacggcauagggaguuggcaagagcccaccgggaguauuacauuuagcacagugucagcaugauagaaacagaagguggugagcucugagagcaacuguagugcugagggggauaaauacaugaauuuaugaagaucaguuaacaaauucaagcaugcaggguugacugaauuccaacuacaagauccaggagagacacucccaaauauuugaaggguguuaacauuggaagaagagaagaauuauuuagccuggacuacagaacuuuguaagaaggugaaaccaagggcagggcaaauuuauaccucucuaaaagaaaugcccugauguaguuuuugggugauucgggugccuucaucccucaggacuuuuuguaguaugaagcuguaaggccaaaaugaaggauuugagaguucuuucucuggagaaaugguugagaaauauuuuggucuugugaauaaagaguuuuugucccagagacagguuaugaaggauugauuuaauauuuauuagccaugcacaguauauuaagcacuguauacaacacaguacauaguucuugagguucugaaauaaaaugacuggccauuauaugcuuuaugcauucucaguguguuucaguaguuuagaaacuuuggcaaauuuccuaagacuuucccuuuggaauagaaugauggaggaauucggccaaauguaaauguaaaacaacaacaacaacaacagaugaaauccuauugaaacgaauguuuccuuucacaagauggcaaaacauauauccuugagucgggaguuuccucagugauggggaugaagaagccuugagcugauaacacgauaacauguuuguucuucaggauauuuuaaaugccagauagaggugcuauauugucuucauugcgggccaggucucuguuauuucucaguucaagauaggucaagggaaaauucguugauucacuuagagacaguucuguuuccugaggcaaagguacuugaauuuucaagugaaauggccaaaaagcccacaguauacuuagauuuuuuuaaaaagcuuauaucucuucuuuuacaucugggcuucuugacuuccaucugcuugucuacagaagccaucaugugauuuuaaagauaauguuggguaugaagaauguggagucagguucuauuuaacuaggcaauugagucuuuccucaauuaacuaaauuaucuuaugcucccugugucaguguggauccuccaagacagacuuagaggcauaaaauuuauugaaccacaaacaaucaauugggagggagccaggaguaggcagggagagcuuuuugaauauggugcaagucuaauaccugugaaggaagaccgggaagaaaaggcuggguaggaaaucuugcagaccacagcauaguugagaaaaucccagccaugcagauguagaguccccaggcaaaaguugcuuguuagcagaaucccguauggggcaggugggcaggcacuacuaccccugccuugcucagucacuggcugggagcagcuuaggcaaagagugcuuucaguguucaugggguugguggcuagaggcugaacugugguccauacaauagguucucuugaagcagaucugagcaacacaucuucuugguuacuacacuucccuagcaagcuuauuuauucauuucaugacaagguucaccaaguuuuaaugugucuugccauauaacauuuacaauagcauaauaaauacuagggaagauagaaauaaaaguagaaacucaaagaacuaacuauuacuauuccucuagauaaacaaaaauuuucugggguauuuuucaaggaggauucacacugaaaauacugagugauaaugacuucauugucuauaauacucgugcaauaaauauauuuaguuguuuuauuuucuaauggcucuuuuauguaguguguuuugagaaaacccaaggguuuaacauuauaacacaacucauugaugauaaguauguggaagcuaagauuauauggaagagucagguagcugacagucuguaugguuaguauggagaauagaucucugaauuuucagagaaggaaauggacugaacagcauuuaaauaaucuugcauaaauaugacuucuaucaaacaaauuuuguguuauucuuuuuuuaagagacaggucuugcuauguugccauggcuggacuuaaacuucugggcucaagugauccuuccgccucaugcucuugaguagcugggacuacaggcaugugccacugugcccagcuuauaaaacaaaauuuugguaaaaagcuugaaacaacagacuauucaaaauuauauuccuuaaaauagaaagucuauuaacagacccaaaacauauguaauauaagauaaagguggcauuuuaaauccauggugguggguaagauuguggaagauaacggauuauuuaguaaaugguguagagaaauuuggguagccaauauggaaaauaaacucgucuccauaccucacauuuuauauuaggaaaaauuccaaauggaucaaauauuaaauguaagaaauggaacugugguccuaguaaaguacuaaaagaaaccaugggagaauuaaaaaacauaauuguguauaguauagugugauaaaauauuccagaagccacaaaagaauagacuguauuuuuuuuuuuuaauuucaguaaguuuugggggaacagguggugguugguuacauggauaaguucuuuaguggugauuucugagauuuugguacacccaucaccugagccagacaguaaauucgacuauauaauuuuuuuuuuuaauuuggggguaggggaugguggcauggcaaaaacuacuauaagcaaaguuaaaagacaagugagaaacuggggaaaauauuugcaacucacaaagggcugauuucccuaauauauaaagaacucuaaaaaucagugagaaaaacaagaauaauccaguagaaauaaugggcaaagaaugugaacagauaguuuagaagaaaugaaauacaaaugucacuuaaacucaugaaaauaaacacaggcugggcacaguggcucacaccuguaaucccagcacuuugggaggccaaggcagguggaucacuugaggucaggaguucaagaccaaccugggcaacauggugacaccugucucuacuaaaaauauaaaaauuagccaggccugguggugcccaccuguaaucccaacuacguaggaggcucaggcaaucccuugaacccagaaggcagagguugcagugagccaagaucacaccacugcacuccagccugggcaacagagugagacucugucgcaaaaaaaaaaaagaaaaaagaaaauaaucacugucuaacucuugauuaggggaaugcacauaaaaacuacucagagauacuauuuugaugucucagauuagcaaguaccuggaaauuugguaauaaacucuauuagagaauauguggggaagcagacgcauguuggcaauuacuuaucugcugucuuaccacaauagauuuguuugcauuuucuagaaucuuaaacauacaauaugaacucuuaucuggcuuccuucacucagcaaaauuauuuugagauucauucacguuacagcacguaucaauaguucauucguuuauaacugaauggauauacugcaauuuguuaucagguuuacuguugauggacauuugggugguuuucaauaugaggcuauuacaaauaaagcuguuguaaacauccgugaacaagucuuuguauauacauaugcuuucauuuuuuuuuuuagguaaauacaaaggaguguaauagcugggucuuauggcagauuuauguuuagcuuuuauuaaaaacugcaaacugguuuuuaaauugguuguauuguuuuauauucaugacaauaguaugugagaauucccauuucuccacauuuuagucguucuaauggguguguagugguuuuuguguuuaauuugcaauuccauaaugucugaugauaaauccaugugcuuuuauuuuuauuuaucuuuguaaaagugugggugucuuuuugccuaauuuuuaauuggguuguuugucuuuuuguuguaaguguucuuuauauguucuaaauauauaaauacauugccacauaauauauuuuguaaauauuuucuaccagucuguuuggcacagugucuuuuuaucacuguuuguuuguuuguuugagauagagucuucuucugucaccuaggcugcagugcaauggcacgucucggcuacugcaaccucugccuccuggguucaagcgauucuccugugucagccuccuaaguagcugggauuacaggugcaugucaccaugcauagcuaauuuuuguauuuuuaguagagaugcgguuucaccauguuagccagguuggucucgaacuccugaccucaagugauccaccgcccaucccaaagucuugggauuacaggcgggagccaccacgucuggccuuaucacaguuuuuaaaaaaauugagauauaaauaauaugccauaaaaucuuccuuuuugaaguucagugguuuuuaguauauucacaagguuguacaaccaucagcaucaucugauuccagaacauuuuugccauccucuaaauaaauuccccuacccauuaguggugguauuuuccuccccccagccccuggcaaccacuaaccuacuuucugucucucgauuugcugauucuggacuuucauauaaauggaaucauacaauguaugaucuuuugugucuggcuucuuugacuuagcacauaucauuacuucauuccuuuuuauugccaaguaauguuacauuguauggauauacauuuuguuuauccagucaucaguugaugcacauuuguaaaacacaaugucuguaucuuaaccuugaauccuacaaccaagcuagacucauauuagcuuuaguacaguuuuuuuuguaaauuccauagguuuucuacauacauaauuguuucaccuguaaagacaauuuuacuuuuuucuuuccaauuugauuccuuuuauuuccuuuuuuuauugcacugauuagaacuugccauacaguguuaaauaaaaauacacagaagauucuuguucucaauguuaagaagaaagcauucaguuuuucauccuuacguauaauguuaacuguaauuuguuguagauguucuguaucaaguaaaagcguucuguucuagucuuaguuuuccaacaauuuuuaucaggaauggaugguggauuuuggaaauacuuuuucugcaccuauugagaugacuguaugguuuuucuuuuuuaguuuguugauauaguaaguuauauugauugauuuucauaugccagaccaaucuugcauuaugagauaaaccccacuugguugugauauuauucuuuucauauauugcuggaauagauugucuaaaaauuuguuaagaacuuuuacaucuguguuagugagaaacauuagucugugguuuucuucucuuacuaugucuuucuaugguuuugguauauggguaaugcaagccuuguaggauggguuagaaaguauuucuccuucaguuuucugggagcguuuguauggaauuuguauucuuucuuuguuuuuuuuuuuuuuuuuuuuuggucuugguuuuguuuuuguuuuuuuuuucagacggagucucacucuguugcccaggcuggagugcaguggcacgaucucggcucaccuuaaccuccaccucccagguucaagcgauccuccugccucagcucugcuaguagcugggauuauaggcacaugccaccaugcccaccuaauuuuuguauuuuuaguagagaugggguuucgccauguuggccaggcuggucucaaacuccugaccucaggugauccaccugccuuggccccccaaagugcugggauuacaggcuaguucuucuuuaaauauuuggaauucaccaaguaagccuucugggccagguuuuguguguguguguguguguguauaggaagguaagguuuuuuguuuguuuguuuguuuguuugcccuguuacccaggcuggaguccaguggcgugaucuuggcucacugcaaccucuuccuccuggguucaagcgauucuccugucucagccuccugaguagcugggauuacaggugccugccaccaugucuggcuaauuuuuguauuuuuaguagaggcgugguuuugccauguuggccaggcuggucuugaacuccugaccucaggugaucugcccgccuuggucucccaaagugcugggauuacaggcgcacugcgcccagccagguaagguuuuauaaaccacaaauuuaauaucuuuaauaaauauuucuauauauucuauauuuauagagcuauuuagauuuacucuugaaugaccuuugugccuuucaaaguauuuguugaaugucuuagcaaaaagcuguucauaauuuuucuuuuuucuuuuucuuuuuuuugagacagggucucacucuguugcccaggcuggcaugcaguggcaugaucucugcucacugcagccucugccuccugggcucaagccauccucccacuucacccucccgaguagcuggggcuauaggcgugcaucaccaugccaggcuaauuucguauuuuuuuaggggugggguuuugccagguugcucgggcugaucucaaacuccugagcuugagcucaagugauccaccugcuucagccucccaaaaugcugggauuacaggugugagccaccaugccuggccuauuuucuuauuuuuauuuuaaaauuguagaauucuagugaggguuaccucugucauucuugauauuauuccuuuggaucuucucucuuuuucuccugaucggucugacuaaauguuuauguaguucauugaucuucucaaagaacacccuuugguuccauugauuuucucuauugcauuucucuuuuuuauuuuaaaauuucugcuguggaaaaaaaucuucuguuugcuuaugguuuguugauucuuuuucuaguuucuuaagguggaaacugagguuuuuuaucugagacuuuucuucuuuucuaauagagguauuuuguacuauaaauuucccucuaagugcugcuuuaggugcauuuuugauuugcuguguuuuuagucuguuuaaaauauuuuuaaauucucuuguuccuuuuacuccuggguaauauggaaguauuguauauaauuucaaaauauuugagggauuuuccagacauguuucuguuuuuuaauuuaauuucauuguguucagagaacauacuuuguaugacuugaauucuuuuaaauuuauuuaaauucguuuuauggcccacaauauauuuuauauuguuaaauguucuguguacccucaaaaagaauauguuuucugcucuuguuggguugaguguucuauaaaugucaauuaggucaaguugguuguuaguguuguugaagucuucuguaucuuuccugcuuuuucuauuuguccuaucaauuaauaagagaaagguauugaaauuuguaguuagaauuguagguuugucuauuccuuuuggcaguuuugucaguguuugcuucauguauuugaaacuuaguuaucagauacauaacauuuaggauuauguccucuugaugaauugacuucuuuaugauuaugaaaugauauccuuuaguccuggugauauucuuuguucugaaauauacuuuacuugauauuaauauggcccuuuuagcuuuuuuuuuuuuuuuuugacagagucucacucuuucgcccagguuggagugcaauggcgagaucucagcccacugcaaccucugccucccagguucaagagauucuccugccucagacucucgaguagcugggauuacaggcacccgccauugugccuggcuaauuuuuguauuuuuguagauuucguagauuuuguagauuuuuguagauguuggccaggauggucuugaacuccugaccuuugaugauccacccgccuuggugucccaaagugcugggauuacaggcaugagccaccgugcccugcccagcuuucuuuugauuaauauuagcauaguauaucuuuuuccauucuuuuucuuucagaaugauuuuaucuuuauauguaaaguagaugucuuauaggcagcauauagauaggucuugcuuuuauguagucugacaaucucugccuuuuaauugggauguuuagaccauuuacauuugaugugauuauucauauggauguguguaaaucugccaucuugcuguuuguuuucuauuuuucccaccucuucuuuguucucguuuucuucuucuguuucuuuuggauuaauuaagcauauuguaaucauucaguuuuaccuccauauuggcuuauuacuuuuuauuuuuguuuugagauggagucuugcucugucacccagacuggagugcaguggcgcgaucuuggcucauugcaagcucugccucccggguucacgccauucuccugccucagccucccaaguagcugggacuacaggcgccugccaccacgcccggcuaauuuuuuguguuuuuaguagagacgggguuucaccguguuagccaggauggucucaaucuccugaccucgugauccaccugccucagccucccaaagugcugggauuacaggcaugagccacugugcccggccuggcuuauuacuucuaacucuguuuccuuuuuuguaauuguuuuaggguuugugguguaaaugguguacaucuuuaacuuaucagacaccuccuucaugugauauuacagcacuucacauauaguaugucaaucuuaugauaguguacuuccauuucuuuccacucagccuucacauuauuauugucauacauuuuaguucugcacauaacuccacaguaccuuuuuauuuauuuuuuuauaaaaaccuucaaggauaucuaaauaauuguaaaaaauguuuguauuuaccauuuuugguacuuuucauucuuuuguguagaucugucuuuccaugugguauaauuuuccuugugccugagggacuuccuuuaauguuucuuguacugcaagccugguagugaugcuuuuuuccagcuuuuauacaucuggaaaagucuguauuuugccuuuguuuuugaaggauauuuuuacuggguauacaauauuagguuaacaggguuuuuucguuucgguuuuuaaagauguuucauugcuuuauugucacuugcaugguuuccuaugagaagucuguuguuaaccauacuuuuuuucauuugcacauaaugugggguuuuuuccccucucgaugcuuuuaaguuuucuuuaucacuagauuugagcaauuugauugugauguuccuugguguaguuuuguuuauaccuuugugcuugggguuuguugaggcuuuuggauuaauggguuuguaguuuucaugaaauuuagaaaacuuucagccauuauucuauuuucuauaccccuuuucuuaccuuuccuuuggagauuccauuuauauguaauuagaccaguugaaguugcccuccaguucaugaauguucuggguuuguuuuauuuuguuuuguuuuuucuuuuucuuuuuuuuuuugagacugacuuuuacucuguugcccaggcuggaguguaguugugcaaccuccaccuccuggguucaagcgauucucccgccucagccucccgaauagcugggacuacaggcacgugccacuacgccuggcuaauuuuguauuuuuaguagaggcgggauuucaccauguuggcuagguuggccucaaacucuugacuuaaugugauccgcccaucuuggccucacaaagugcugggauuacaggugugagccaccucgccuggcuuaaguuuuuuaaaugugauuuuuaaaugacuccauaauguguuccacuuggcugaaugucuaagauuuucuuccuuuuuuucauuaaucgaaauaauagugugaugaacauuuguauacaaaaauauuaguauacaucugugaucauuuucuuagaauaaauuucuccuuaagacuuuuaauauguguugcaaaaugcuguccauauauuuuuguaucacauaaaaaacaaaaaacuccuggcugggcacaguggcuuacaccuguaaucccagcacuuugagaggcugaggugaguggaucaccugaggucaggaguucgagaccagccuggccaacaugguaaaaccccaucucugcuaaaaauaaaaaaauuagccgggcgugguggcaggcgccuauaaucccagcuacuugggaggcagaggcagaagaaucgcuugaaccaggaggcagagguugcagugagcugagaucaugccauuacacuccagccugggugaaagagugagacgccaacucaaaacaaacaaacaaacaaacaaaaauccuccuaugaaaacugcuaguuuuaauggcaggggaacauucaacuacuugaacuccuauucuuuaggagggccaggauugcuugcuugacaccaguauaucagaauuuuaaagugaaacuuaaaggcuaagaagaaacucaccauaugaagaauaggggaaauaauuacaagcagaaugaacugcagugcaaagccucaagauacaagggauguuagaagaauggagagaaaccgaggguagcuagagcauagugagaaagagagucuguccuaaaaggagauugcagagaggcaaggacuggaucauguaggacccugagggucaaggcaacuaugcuuuggacuuuauucuaagugccaugauaagccauugaaaggcuguaagcuggggaguuuaugguguuguguagaggaaggugguuuagagaguggcaagaguggaagcaggaugaccagcuagaagauacgauucuuuacuauuucucgaucacuuuaucauauauauuaacauauguuacugcuauggacugaaugucuguguuccucccaaauucauauguugaagcccuaauucccagugugaugguauuaggagguggggccuuugggagguaguuagguuuaaaugaggucauaaguguggagucuccaugaugggauuaguacccuuauaagaaaaggaggaaacaccagagcuuccccucuccaccauaugaggauacagcaaaacaauggcuaguugucugcaagccaagaagugggaccuugcugagaaccagauuuguugcacguugaucuuggccuucccagccucuagaacugugaggaauaaaugucuguugguuaauccaccuagucugugguauuuuauuauagcaggucaagcagacuaaaacaucuaggaagugauaaagaagaaaauauauaucugagacggagucuagcucugucacccaggcuggagugcaguggcgcgaucuuggcuuacugcaaccucugccucccagguucaagcaauucucugccucagccuccugaguagcugggauuauaggugcccgccaccuugccuggcuaauuuuuguauuuuuuguagagacgagguuuuaccaucuuggccaggcuguucuugaacuucugacccggugauccacccaccuuggccucccaaagugcugagauuacaggcgugagccaccguaccuggccaagaagaaagauauuuuaauauuuuaauuuauuauuauuauuuuuuuucagacugagucuuacucugucacccaggcuguagugcagugaugugaucauuacucacugcagccucaaacucccaggcucaagcgauccuccugacucagccuccccaguagcugguacuacagguaugcaccaccacacccagcuaauuuuuuaauuuuucuuuuguagagacgaagucucacuguguggauuagccugauuuugaacuccuggccucaagugaucuuccuaugucugccucccaaagggcugggauugcaggcaugaggcaccaugcccagcugagaaaacuauuuuaaaaguaaugggaaacuaucacauuauucccuuuggcuaguuaugcugcauuuccugauuuggcuuuguuuguuuguuuguuuugagagagagucuuacucuguugcccaggcuggagugcaguggcacaaucuucgcucacugcaaccucugccucucggguucaagugauuugccugucucagccucccaaguagcugggauuacaggcaugggccaccacgcccggcuaauuuuuguacuuuuaauugagaugggguuuugccaugcugaccaggcuggucuugaacuccugaccuugugauccaccugucucagccucccaaagcgcugggauuacaggcuugagccacugcgcccuuuuuuuguuguuguuuuuuguuuuuuuugugagacagggucucacucuguugcccagacuggugugcaguggcacaaucucagcucaccgcaaccuccaccucccaggcucaagugauucuccugccucagccucccaaguagcugggauuacaggcgugugccacuaccacccaacuaauuuuuguauuuuuaguagagauaggguuucaccauguuggccaggcugcucuugaacuccugaccucaaaugagccacccgucucggccucccaaaguguugggauuacaggcaugagccaccaugcccagccugauuuggcuuucuaaugcuauugcugcauaccuaacauuuuucuucuauuuuaugacaucccuaaucaguauuuaagcuuugaauguuuauucuccuguuuugccuagauaauuuguuuuucuccuuuauuuucuuaaauacauggaaucuuuuauuaugccucuaauauaguguucucaaacugacuugaauguggauuuuaaauuuuuuaaaaugaaauaucugccugggacacccuuugaaaagcuaggccagaggauuggguuccagugauuaccaaaggcuuauggucaaccaaaugagagaaugcaguaaaagaauuacaaccaaaugcaaccaaagcaaugagagaauaccuugcaggaucugguccuggaacugcuauuaauguuuuuuauuuuguuuuguuugagauagggucucauucuguugcucgggcuggaguacaguggcgcgaucacagcucacuguagccuccaccuccugggcucaagcaaucuucccaccucagccucucaaggagcuaggacuacagggcaagugccaccaugccuggcuaauuuuuuuuuauuuuuuguacaaauaaggucugccuaugucgcccagacuggucucaaacuccugagcucaggcaguccucuaccuuggccucccaaaaugcugggauuacaggcaugagccaugagccaccaugccuggucuauuaaugucuguagauugauuucuuagauaaugauguagagauuauguuaaucaugaauauggaugugauauuacaccaaggcaggaaugaaggcaauuuugugagaggggaauggggcuuuggaaucugugaaucagguuaaaaucuuaguuuuagccuuugcuaggcugaguagccuuuggcaaguugccuaauuucuuugucuucaguuucuucauuuguaaaaugaauaggaugacaccuacuuugugugguuuuugugaagagcagauaagacguauaagguauaaauuucuuuauccacuuuuauuguuguucuguaccaucuuggaagauggggauagaaucuguuauaauguuaauaaauuggagaaggggcaaagcaaacaaggaaauuuagugagaauaguucugaauaaguauaaauauagcauguaggaucaacagaguauaggguuuuuuacuuggauguuuggaaccuugggaauagaaaaccuuuuuuaaaaauuuaauuuaauuuuuuaaaagacagaugaggucucacucuguuguugccgaggcuggaguacagaggcacgaucauaggugagcuugagcucaccuccugggcucaaggaauccuccugccucagccuccugaguagcugggacuacaggaaugcaccagcgugcuuggcuaauuuauuuucuuuguacaaguggguuuucacuauguugggcugguuucaaauuccuggccucuagugauccucucaccuuggccucccaaaguacugggauuuuaggcgugagccgcugcacccugcccaaaagcuguucuguuuguaauagugaaaaauggaaacaauaaaguaacaaaagaaugauuaaaugaaccauauguaguacacucaugcaaugaaauauuuuccagucuuucaaaagaaugauacagaucuauauauuuggacauggaaagguuuccaggauacucugguacauuuuuuuuuuuuuuuuuugagacggagucucacucugucguccaggcuggagugcagugucgccaucccagcucacugcaagcuccgccuccuggguucacgccauucuccugucucagccuccugaguagcugggacuacaggcgcccaccaccacgcccggcuaauuuuuaguagagacgagguuucaccguguuagccaggauaguauccaucucccgaccucgugauccacccgccuuggccucccaaagugcugggauuacaggcgugagccaccacgcccggccucugguacauuuuuuaaaaaaggaaauuaauaaaccacuuuuguaguaggaugguguaugaccauauuuguauuuuaaaaauuauguuaugaacaugucuaugaacucauagauaaaggucuggaagggugaacuucaaaucguuagucaucauaaacaacuucuauaccuuaggcuugcauaaauaaaaaugagacugaaaagguacuguaagaagccaucagagauuguuuucuaaauaugauauaaaacccauuauucacaagaccaauacauuauuuacauaaaaauuaaccuccaaauaugggaaacuuccagcaguucugaauugauggguuuucuauuagaauccuauauuuuuucauucuaaaacauagauuauuaaaagauuugcauauuuuuaauguauaaaacucugugcggaugaaggggugagaagacgaacauuuuuauacacccugauagaaauauaaaucggugcuuuucuggcggguacuuuggcaauagagaacauguuaucucuuuugacguagaguucuacuuauaggaauuuauuuuaaugaaaaacaaucacagacauaaagauuuagauuuagcauuuauugcauuguuauuuauaauauuauaaauuuauaaacaacaauaucugacaauaaaggauuuuaaauaaaguaggauacauuuauucaguggacuacuagccacauaauauauuguagaaguguaaaauugaugcaacguauguuguugagugcuuacuauuuaccagauuuguucuaaguacauuauuauuuaauccuggccgggcgcaguggcuccaugccuguaaucccagcacuuugggaggccaaggcgggcagaucacgagcucaggaguucaagaccagccuggccaaaauaaugaaaccccgucucuacuaaaaauacaaaaauuagccaggcgagguagcacacaccuguaguccuagcuacucuggaggcugaggcaggagaaccucucgaacccgggagguggagguugcagugagcugagacugcaccauugcacuccagccugggcaacagagugagacucccugucaaaaaaaaauuuuaauuuaauuaaaaaauauauauauauauaauuuaauccuuagaauaagcagugagacaaucauuucuuauuucauuuuacauauaaaguaacuugggcacugagagagguuaaauaacuugucuaaaaucacauagggagugggaaagcugggacucacuuuuaucugccugacuucaaaauucauaccucaauuacuauauuuaaugauuuuauaaauauaaaaauauggcauaauacuuacauaaaaaaaguuauaagaugauaucauuguuuugaagaaggauuuauucuaaaaugucagcaguggaaauaguugaguauugggauaaugguuaauuuuugucucuucuuuuauuauuguuuuccacagugaacaugaaugacuuucauaacuacaguuuuuaagagauacucauuucauagcagaaggguggaguguauuaaaaaaauaaauauuccuucuuccccucuguuucuggguguauuucugagauauauuucugaguuuggguguauucacuccugaaguugcauguaauugccucuuggcacuaguuuauaaaaacuagaaaguugaaacagugauguuauucugagaucugaagauguaggcagaugaaauauguuuaaauaaugacauuuuaaccauuauucaguuuccuagaucugggaccggggccacugguaacaggauucagaagccagaagcacaguaccacacagugagcaauuccccagacucgucucuuugagcuuuucacuagaaaauccuucuucaccucuccuuucucccaauuccuuuuuauuaagagucuuuuaaccuggaugaacauaauuugagccgaucauaaacaaauagcucucuuuuuugccugacuuuaugcauuucuguugccauguaaaccaaauaaagcuagcugugagcaaaccagcugcugccugcagccuccuucccuagaggaagggaaaggguggugaagguaauugggaaggacuauaagaaggguagaaauugagggaagagaguauucuauuuacauuucugguccugauucucacucuguuuauuuggcuauuuagaauaugaugacuauaguugacuuagucauucuucccagcagcugagagauaugggugacuaauaauuuuuucucuauuuguuugcauguuggaaaugguuacuauugagggguggaauuaauagagucuaagcuauauuucagaacuggaaaacuuggaaaaugaaugguuguagggaauagcaugggauuuaugauuuuuuguuucaaagaguuacgcuuuggguacuggcauuaaaaaguaguuccaggggccaggcacgguggcucacgccuguaaucccagcaccuuaagaggcugaguccagaggauugcuugaggccaggaguucaacaucagcccuggcaacuuagcgagaucucaucucuacccaaaaaaaaaaaaaaaaaaaaaauuuuuuuuuaaguuccaaggugucuaauugaaugugcccuagaggcacugugcaaagacuacauauagguggucagugacugucaaguauuuacacucacaauugaaaggacaugacagcugaggccuaaaucacaugacguaguaacuagguaaguacuuggaaucauuaaugaaaagacaaugagguguuugcuuaaauuauaaauauugauuagggguaguagagguaauacguuauuaugagaagagaaaagugaguguggcaguuacucauuuaguucagauauggggaaaaaaagucaucucuucucugagcucaggaaacuuuggaagucaaucagcaucagauacaccaauccucagacccuauagugccacccaaaacuaaauauucuccuucagaugguccaguucauccuuaagcuaggaaagagcaaaaauuaaauaagaagaaacauuguaauaaucuuaaguuucucacugggcuguaagguugauagugaacuuauguguaaauauccaaaaacauuuuuuugaaaaaacauuuuuuucauggcccagucuucauuucuuauugucuaauuauacacauaugaguaaugcauguauuuauuccuauccccuuuuucuuacacaauaggguaguauaauaugaaccuugcuuuuuucccauaugaguacaaagaaaguuuccucuuuuuauagcuguauaauauucuguuguuggauguaccucaguuuaugccaucagaacccuguuaguggauaguugaguuguuucaaaucauuuuaagcuguaauuuuacugacuuuaagucucuuuuguuagcaaucccacuuugaggccaggcuacagaaguuaguauauagaaaacaaaugaauauaaguaaaaaacuacaaauccaacuuuaguucuaaucugggcugugggaagauggcugccuaacuucaaaguuaugcuaccuucaugcaguccucucuauuuuguuuuucuuugcugccgucuauguauuuggugauguuugguuuguugucuucuaauuuuucuuucaugguuacuuccugauccuaucuaauacaccagccuuccuaacuccuaguuagagcuuuguuagaaaauuguuagacaugcagaucuuuggauuuuacugucgacagacgauagcaguuuucagucuagaugaugaugggauuccuccuaucuaccuugccggaagcucugugaaaaucuuaauacuuggauaaugcacuucuacuaucacugcuucccugcuaacaaaguacacuugguaacaaauuuguauuagugauacuuaacugccccaggaggcugguaccugcuacugcuggugggaugucaaaauuucuuccugcucaguagggguagagacaagcagaauugagaaaugcuguuuaaaucugugaauuuaaaucuggguucuuuggaggaaggcauaaaggggugauugauuaauaucauuuuggcugcucuucugccacaaggaauaugaguagaauaaagaaaggaagaagaagauacaaagaaauucagguuagagaagaaacacuacauugagaaucaagaagcauggauuuugaucuguauuguuacuaauuuggucugugauuugaucuauauucuguuaaugauuuggucugugauuucacuucucugguccuaaguuuuugaccuaugaaauuagugguuuggaauuuuuuuaaaaauugucugaaauucuaaggcagaaaagagaaguaaagcagcaggccgggcaugguggcucaugccuguaaucccagcacuuugggaggccagggcggaggacugcuugagcccagccuggacaacacggugaaacucugucucuacaaaaaauaaaaauaaaaaaauuagccuggccugguggcacaugccuguagucccagcuacuggggagguugaagcaggaaaaucacuugagcucaggaguucaagaccacagugagcuauaugaucacauaccugcacuuuggccuggguaacagagugagacccugucuaaaaaaaaaaaaaaaauccauauuguuauuaaauaauauaaagaggagagcuugucuguuaaagaaaaauaccuauuacaguuaguguuguugcauagcaaauuauucccagaauuuaggggcuuaaaguaaucguuuacuuugcuucugauuuugugggucaggauuaugggaauggcucagcuggauaauucucauuucggguuucucaugaggcugaugucagauggggcuacagucaucugaaagcucaguugggcuacauguccaagauggcucauucacauggcuggcaguugauuuuggccaucagucagagugucugcauguagucuuuccagcaugauggucucaagauagucagguuuuuuacaugguggcucucuucuaccagcgugucccaaagaagaccagacagaaacugcgugacuuuucugaccuugucuugaaaguuacguagcauuacuuccccuguacuguauugguugaagcagauacaagcaugcccagauucaaggggacagguccuaaaucccacuuccgugagaagaaugucagagaauuugggggccacguguuuaaaacugccacauuuucucuucauagaguagauggcuucuauugagaauagcacauaaguacugaaguuucuuuucuuuucuuuucucuucucuucuuuucucuucucuuuucuuuccuuuuuuuuuuuuuuuuugacggagucccacucugucacccaggcuggagugcaguggcaugaucuuggcucacugcaaccucuacucccagguucaaacgauucuccugccucagccucccaaguaacugggauuacaggugcaugccaccaugccuggcuaauuuuuguauuuuugguagagacaggguuucgccauguuggccaggcuggucucaaacucuugaccucgagugauccaccugccucggccucccaaaguacugggauuacaggcuugagccaccccacccagccugaaguuuauucuuucuuuuugcuugguugaagcacaaccaagcaaaagaaauguguuuaaaauuaugaucacagaauaaguguuacaaauuuuucagugguaacuuaauccagauaguaauaacccauacauuaauuucuugccuuucucuuguauggagauuaugcacaggaguuuggaccuuauucuguagacaguugggaaucacuugaggcaggaaguauagaaguugauuagaaauagguaagacuggaggcaaaaagaguagcgccaauucuuuucuuccccaagcagugcaggugagcagugagauccagaacuggggcaguggcaguugggauagagagauguuuaauucaagacauaguaaaacauuaauaaaacguaauuuuuuuuuugagacagggucucacugucacccaggcuggagugcaguggcacgaucacagcucacuguagccgcaauccccugagcucaagcaauccucccaccucagccuccugaguagcugggacugcaagcgcaagccaccgugccuggcuaauuuuuaauuuuuuguaaagacgggugucucaucauguugccuaggcuagucucgaacuccuggacucaagugauccuucugccuuggccucccaaaauguugggauuacaagugugaaccacuacaugcuggcuaacauauuuguaaagaaauuauuuauauucgaauagcuaguaaauaaaugaacaaaauucaaaauguucaaaaggauagauaauaaaaauaaguuuuuuaucaucucuucuccccuacuugcccaguuuuccccuaaggcuaucacuauuacuauuuuuuugaguguauuuccagagauucuaugcauauacaaacuuacuuuuaucguacuguauucacuauucuguaccuugcuuuuuucacuuaaaauauaucuuggagauaguuuauaucaaaacauauauagcugccuugcugucuuaacuauagaggauuccauuguauagauaggccguaauuuauuuauuuauuuuuauuuuuuauuuuuuuggagauggagucucgcucuucucccaggcuggaguacagugacgugaucucagcucaguacaaccuccaccugccggguuaaaacaauucuccuaguucaggcuccugaguagcuaggauuacaggugcacaccaccacgccuggcuaauuuuuguauuuuagcagagacaggguuucaucacguuggccaggcuggucucgaacucuugaccucaggugauccaccugccucaacuucccaaagugcugggauuacaggugugaaccacugugcccguccaugccauaauuuaagucagucuucuauaaggauuuaaauuauuuucagucuuucuuuucuuugagauggaguuuugcucuuguugcccaggcuggagugcaauggcacaauccuggcucacugcaaccuccaccucccggguucaagcgauucuucugccucagccucccaaguagcuggaauuacaggcaugcgccaccaugccuggcuaauuuuguauuuuuaguagagacggggguuucuccauguuggucaggcuggccucaaacucccgaccucaggugauccaccugccuuggccucccaaaguguugggauuacagguaugagccaccgcgccuggccaguuuuucuuuacaacaaaaaugcuuuaaugaauaucuucauuauuucauacauggggaaguauaucugugggacagauugcuagagguggaauugcugauuccaaggauguaugcauuguacuuuuuuuuuuuuaagagacagggucuugcucugucacucaggcuggaguucagcuuacuauaaccuagaacuccuuggcucaagcaauccuccugccucagccuucugaguagcuaggacuaaagguguguaccaccacgccuggcuaauuuguaaauuuuuuuuuucuguagagacuggaggucuugcuguuucccaggcaugugucaaacuccuggccucaagugauccuccugccuuggccucccaaagaacuaggauuacaggagugaccugcugugccuggccuaccuuauaaauuuugauagauauuacuaaauggcuuuucauggagaauagaaaccaguuuauauucucaccugcaguggaugugaguagcuguuuccugcaacuucauuagcacuguguuaucagacuuucggaucuuuccuguucugauggaugaaaggugguaugucauugaaguuucaauuuacauuucucuuuaaggccauuuguauuuauuucucuuucuauguaaacuggugacaugcucugcguacuugccuguuggauuguuggucuuuuaaaaaaucaauuuguuggagcuuuuuguauauugaagaaaaagguccuuuguaauaugaauugugaauauuucccccaauuugucauuugucuuuugauuuuaauguaguuuaauagagcuuaauuucuuaauagugucuuauguaguuugugucacauauaggcccuguccacuuuacgauuauuuuaagugaugggucucuuucaaauuucugcacauccuuuguguucggaucucacuuccuacuuuaauggaaaaauagaagcuauuaagacuuucaacuugcuccuuuccuuuuauuuggaaaggcauccuguuuccuaaguugguauugauuuguuaucuaauucucagugcccuuauuauauuucagugauguugccacauugauucuucaacuucucccucgguucuaacuucacauuagccauuuagguucuugucucuuauguuugcuuauuuguuuguuuuaaagaaccaguucuagguguagaaaaacagacacucauacguucaugguggaagugcaaucuuggugcagucaauuuggagggcaguuugagaguuaauaucucucaaaccuaaaaauguauguagucuuugaccaaauuauuucacuuuuuagaaauguacccuauugauauaccaaacauauaugaaaaguauauacaaagauauaaguuacugcaguguuugugauagaagaagacugguaacuaucuuuguuauauuuuucaguaguuauguauccaucuauguuuccaugccuuuaaugcagccauuaaaauucacaccauucuggggacuauuuuuugccauuuuucuuuucauuuuuagagacaggaucucucacuguugcccaggcuggcucaucgcagccucaaacuacugggcucaagcaauccucccacuucagccucucugguagcuaggauuacaggugcauucugccaugccuugcuaauuauuuuuuuuuuuuagagauaaggucuugcuuuguugcccaagcuggucucaaaauccuggcuucaagugauuuucccaccucagccucccaaagugugggacuacaggcaugagccaccucgccuggccacuaauugauuuucuuuuagaauuuugaaggaguacacuguuauccaguuuugcucuuguugcucucuuuuuccuuuuccucugcucuuuuuuuuuuuuuuuuuuuugagacggagucucgcuccgucgcccaggcuggagugcagugacgugaucucggcucacugcaagcuccgccucccggguucacgccauucuucugccucagccucccuagcagcugggacuacaggcgcacuccgccacgcuuggcuuauuuuuuguauuuuuuuuuaguagaggcaggguuucaccguguuagccaggauggucucgaucuccugaccuugugauccgcccgccuuggccucccaaacugcugggauuacaggcaugagccaccgcgccuggccccuuuuccucuguucuuuaugacuuucuguccugaucugccaguuuaaaaaaaauaguuuuucaggccgggcgcgguggcucacgccuguaaucccagcucuuugggaggccaagacgggcggaucacgaggucaggacaucgagaccauccuggcuaacacggugaaaccccgucucuacuaaaaauacaaaaaaauuagccgggcgugguggcaguugccuauagucccagcuacuccggaggcugaggcaggagaauggcgugaacucgggaggcggaacuugcagugagccgagaucgcgccacugcacuccagccugggagacagagcgagacuccgucucaaaaaaaaaaaaaaaaaauuucuccccuuugucguuuuaucuacuguuuauaaaauuguuuuuaacuuccucuuccaauucuucuguugaaauuuuaaauuccauuauuuuuaauuucuaagaacugcuuuuacccauuugaguuuuuuaaaaauuaugaauuguugaauuuuaucaaaugcuuuuucuauaucuauugagaucauaugauauuuucuccuuuaauccauuauggugguaauucuacaaaguaguauuuuaaauguuuaaucacucuugaauacuuuggauaagcuuauaugaucaugcuuuuuuuacauugcuguguuaguuugcuauuuuguucaugagcucauauuuuguauauauaucuguguccaugauugaaaucaguauauaauuuuccuuuguuguacugcccuugucugguuuuggaaucaagguuaugcugguuugaucaaaaguuggcuggggcugcaaauuauacugacaaaagacaaauuaacaagagaaaaacaaaguuuuucuuuucuuuucuucaaaguuuaugcauggcacauacauaaggagagcucagugaugaguaacucaaagagguaguuagaacuugggguuacauagcaucuuagcaaagaauagaaauuuuuuagagaagugacaagacaaaggaaaaggacauugagcuucuagggguagcaagugugggaacacaaauauauggagaaacuagguagauaaaggcuaguuagcaagguuuguuuguguugacucucagugccauccuuucuccagugaugaggcuuuuuaucuccuuccugguaagggaagugguugggggacacuuucacaaggguagaggaaagguggauguggggagggaggcugagaacuucugugucugcuuuuucucaacugccuucagugugaaauaguucuuaugccaggguagcauacucugaaccccuucguuagaauuaacuaaaagcauagcauauaauucuuugguaccacuuaccagagaaagaaagggaaaguauaggaaugaagagaucuggcggcggcaguggcuggcaggguggugauggaggugggaggcagaugaagauggaauggaggacugaguauguguaagucauugauagcaguaaaagugacuauuguccccaaagcuuucuugucgaaugccugugaauuucgagggugggaauaacacacucaugguuaucauaugaaaccuauuuguggcaagauaguagaaauaaaacaaacuguguaaucuguccacgaucuugagaauuuaccaacacuugggaaaaaauagcaagugcuuaaagagaagaauaucaguguaaaggagcauggacuacaagucuguuaagugguacaggcaguaauuacaaccauuaaaccacucagaagaaugguuuaucuccaggguuauaaagguaaagcuuuaugugggaaccagcauguacuuuggcauuaagagaagggaaggagaacagaaaguaaauagaaagaguuuaauaagaaggagacagagcaggcauuuuaaacugaggaaauuauaugcaaaaguacagggguggaguugggaagggacaccaguguugaaguauuccuguuacuuguugguaucaucauucacccuaucagcugguaggagagcaccagaaacccaagucuucuuagacuccuccuccccauuaacucaaagguaauauccagaagaaacaaagaacauuuguggaaggagaguaagagucaugacucaguuuugauccuaagugaccagaauaauagauuuuaaaaauauauggguagggagguaguuugaaggagacaauaaugaagagagagacccuuuccuuuaaaauaggaauaaagaagcaaaagguaggugaauauaccaagaacuuccaauuaaaagaugagggaacuuguaguaaucucccuucuguguguuagagaaugcggcuauguagcuuuguaccuugagggacuuaacaaggguuaauuauaaucaacuguugaaacacacuguucuaaacgcaguauuauucacuugccaccuauuuugggaguucauguauaagcauauaaaauuaccauuagacuguuucaaagugguagaccuuauuuuaaaguaagagcauuuauuuuacauguuuaaaauaagggauauguaaaucuuuccuuucucccuacucaccucuguucaccacaggcagucauuguugacaucaucuugugcuucauucuagaaaaauuuggcauauauguauauaauauuacacguuauguguuacaaguauauauuaacauacauaucuugauaauguauuuauacuauguaucuugaaacaauuucauuuacaucuuuuaauuaugugaaaucuuuucucuuuuccuuuggccucuggccccauuuccuuuauauagggaaguauacuauggggauauaaauuccaaauaccuguuuuguuugucuauccaauuuucuauuucauugcauucacauuggauuaaaguugcuuaaaauagcaaaacauuuuccuuuuuuauuuaaaauuuuuugucuuaaaaagcaugaggagaaggcauggaaauauuagucacauuucuugguauucaauauuccugugaguaguguuuauuaaaagcucaucuuucuugcuuggcauauccguacaguuuccucccacuagagggcacuaggauauuguuuguuuuuaguggucuguuuaugaugaacuuagcauuaauuuucauauguuuucuuauuuguccugcauuauaauaggaauuaaauugucaugcugaugucacuuuguuagcgauauauggacaauuaaggcaccuucccugcuaucaauuaugacuucgaagacuauuuugugcuuaauacuuaagaagaaagggagagggggagcuuagagcaaugggaaguuccagaaauagaccucuaccuauagaaugaacuggauuuugaaaaagaagccaagauaauucuguggggaaaaauuuuucuuuccaacaaauggugcuggaacaacuaaauacuguuugggggcaaagugaacuuuguuucugaucucauuccaaguauagaaguuaacucaaaauggaucauagacuauagaaaaaaacaaaggagaaaaucuucaugaccuugggguaggcaaaacuuucuuugcacacaaaaaauacucuaaaagaaaauguuuugauagaguucuccaaaauuagaaacuucuauucaaaagacacagguaaguaaauaaaaaggcaagcacagacugggagaaaauauucacaauacauauacagaaaaaugacugguauuuagaauucauauaaaggaaucuaaaacucaguaauaagauaaucuaguuucuuaaauggaggaaugauuugaacagacauagcacaguacauacuauaugaaugcuaauaagcauauaagauacucaacaccacgagagaagugcaaauuaaaaccacagugagauacugcacaccugcuagaauggcuaaaauuaaaaagagugacaauagcuacuacugaugagggugugggacaguuguaaugaucaugcauugcuggugugaaacaguuuauuauaaauuuaauauauucuuaccaggugacccagcaauuucacccuuaccuaugcauuuacccaagaaaaugaagcccauuguucacaugaagaccuauacacaaguguccaugacaguuugauucauaauggccccaaaguggaaacaacaccacauguccaucaauaaaugaauggauaaauaaaguaugguacacccauguaaugugcuauucagcaguaaaaaagaaugaacuacucauauaacaguauggaugaaucucaaaaacauuaaaugaaagaagcuagauauaaaagaguauuuuaugauuccauaugauuuguaugacguuccauaaaaggcaaaucuaucuauaguaacagaacagaucagugguugccucggguugugauaguagugagaugagucagcaacaaaagagaaaauaaacugaaguaaccaaaaauuauaaguguuaugaaggaaacaaagcagguggcaguauguauaaaggcccuaaguuggaaaagaagacuguugauggaguauagugaacaaaggagugaguggugggagagcuaaauaagcuaccaggucaugcggaaagaguccuuaaaaggggcaggaagcggggaggaaaaaaaagaguucuuacuaacuugacagggaacagacuguagcucaaauagaaauccuuccuucagcugggcaugguggcucacaccuguaaucccagcacuuugggaggccgaggcggguggaucaccugaggucaggaguucgagacuauccuggcuaacauggugaaaccccaucucuacuaaaaauacgaaaauuagccaggcauggugacaggugccuguaaucccagcuacucgggagguugaggcaggaaaaucacuugaacccaggaggcagagguuacagugagccgagaucaugccacugcacuccagccugggccacagaaaaaagaaaagaaaaauucugccuucagugggagaggguaagaaggaagcugugcauaugagguuugccuggugauuggaaagggagagaguuuacaucagacauuuuucuguuuucuuacauuuauuuucuuuuuuauauauaaaguaagucugccaccugaaggugaagaaguugaggggacaaacauacaguauucuuuuugggagaggauaggggaguaugugccuacuaaagaaacuuuguaagaugacugaagaacuaucgaugcucauuagauguuuaggaaggugauuuuaauaugaaaccugucagcuuagucacacaugguuuuucucuugcaacauguaacugcuugggcccaaacauggaauuaauuaguauaugucaucagaauuuagguuuugccuggcaaaaauaaugaagagagugaagguguuguugugguuggcuugcuuuagucuagaccguugaugacugagugaagguguuucuagagucacauuaucaagauggacaggaaaucuaggcuagaaaagaaggaaaaugaaacugggaaagaguucaugaauaggaagacaaugauaggaucauuggcuggagaacacagaauuauauacuggggccauuucugcaaaugaagugguaggauaggaugaagugaucucagagugacuuccagguuuccgaaauagaggcucaauuauugacauagguaauccuagaggaggaagagcagguuuggggggguaagaugaugaguucaguuuuggacaggcuguguuugaggaaccugugggauguauaaguggagauguccaaugagcaauuaaguauauagaucugagagaucugggcugucuaaguagagauuuagcaguuaucagcauauagaugauaacugaaacaugguaacagaaaagauuaucagagaggauuugugggauaagagaagguaaggguguguaauuuccuuuuucuacaaccagagugguugugguggugguugguauuugguuuuguuccuuuuccuucaguauugugucuccuuuuucaaauaaauccuaggaaauacaacauggaaugaugguaagagcagaguuaaaguccugucuuugcuguuuccuacuaugugccuugaguaguuaaacuucucagagccucaguuuuuucaacuguuaaaaacagugguaucaaaagaaugagaagacaaaccacagacggagagaaaauauuugcauaagaccuauaugauaaaggacuguuauccaaacuaugaaaagagcucuuaauaauaaggacacaaacaaccugauuaaaaagugggcaaaagacauggauagaaaacucaccaaagaagauauauagaugucaaauaagcaucuaaaaagaugcucaacaucauaugucauuagggaagugcaaauuaaaaucauuugaaauaccacuacucaucuauuaaaaugccaaaauucagaacacugauaacaccaaguuaucaacaccuaaugaggauguggagcaaaaggaacugauucguugguggguaugcaauauuauacagcuacuuaaagacaguuugguaguuuccuagaaaacuaaacauauucuuaccauacaauccagcaauuccauuccuugguauuuaccuaaaggaauugaaaacuuauauccacacaaaaaccugcucacagguguuuauagcagcuuuauuuauaauugccgaaauuuggaagcaauuuuaaagauguucuucaguaggugaguggguaaauaaacugugguacauccagacaauggaauauuauucagugcuaaaaagaaauuagugaucaagcugugaaaacauaugauagaagcugaaaugcauauuacuaagugaaguaagccaaccugaaaaggcuacauacuguaugauuccaaauaugugaccuucugguagaggaaaaauauggagacagugaaacgaucagugguugccaggggcugggagaagggaaggauaaauaggcaaagcacagauuuuuagggccgugaaaucauccuguauaaugcuacaaugauggguacacaucauuauacauuugucuaaacucauagaauguauaacaccaagagggaacccaaauguaaacuguggacuuugggugauaaagaugcgucaguguaggcuuauugauuaacuguaacagauguaccacucuggugcagguuguugacagugggggaaacuaugucuuugacgggcagaggguauaugggaacucucuuucuccucaauuuugcugugaaccuaaaacugcucuuuaaacgucuauuuuuaaaaacagaacagcugugauaugaaacugcauggagacaggucaaauaacuaaggacuacuggucuaaauucagaaucacccucagcuguauagguauuuauguguucacuuguggcuuagcuuacugcugcuuaaugggaaaguuuugcuucccuuccucaccucuguuuuuuguuuuuuugguuuuuuucuuuacagugauagugaacaauuacaguccuuggaaagacugaauuauagcuuaaugaauguacagauacaaaugucuggauguuuauauugccagggguagaaaugacgagggaaaacaugcaacccccacaauuaaaaggcguuuauuucacuauucuaaggaauauuugaaucuccuuucaguuguaucccuuaccuuguuuacuuuacacccaaguggcauuucauacuugaaagcuuuucagauagauauuacaguaccaaucuacuuuggguaccaggaccuccuuccccuguggauuccaaaacaauuucugaaaauaugggagaaggaucuucaguuauacccacguauacaaaauagcauaugucuggauuaaagauacaucuggaaauuuauccuacagauauucucacacauguagaauauucacuacagcauuauacauucauauguagaaugcauuacauucacauguagaaggauauucacuacagcauuguaucauggugauaaacaaauagcacaagguaggagcaaucuaaauguccguuggcagggaacugguuaaauaaauauugguauaucuauaaaauagaacaaugugcagaaguuaaaaagagugaggcaacucuguauauggauagugaaagucuucaagauaauguugagggggaaaacuggaugcagaacuacauguaugauaugcuaccaucuguguagaaaaagaaacaauaaccccccccccacacacacacauacaugcuuuuaugaaaagaaugucucuacaagaaugcacaaguaagauuucucucuagagaggauauucaggugcugaaggaaaaggguagagacuuuucaccauauacucuuuauaucucuugaacuuugugccauaguuaaaaacaaaugaagaaauaaaauucagauuuuagaaaccuaucuuaugggauuaucaugaggauuaaaugagucauguauauaaucuaaugcauugucuggcauguaguuaaguauauaauacuuacuaaauaugauacuuacuagccguuguuugucccuuccccuccaguuccauaauugcuguuuggaggguucacaggauuuauuuucuucaccuaggccaaggauuguuaaccugaauggaucaaugaaccuuugaaauugcaaauuuuguauaagcauaugcuuauuccagacuuuccagauucuagagagaagagggucugugacuuuaaucagauuugcuaaggaagggaaggucccauggcccuaaaaaguuaaaacacacuaaccuaagcuguuuugcuauuuuauguuucuuuccaccagaaaauacucugcugucagaucguuuucucuuuacagcuaggaagagacucuggcugacuuuuauuccucacaacuuuuaucuuuucuaaauauaucaugucuaggcaaguaauuuaaacuuucuaggucucaacuucuuaacuguaaaaagaagugauugaucuggacaaauucaaagguucccuucaucuugaaaauguuuugauucuaucuagguuuacucuguaugggcuuuaaaaauuagaaauauugucauaaaccaagaaaaacccuuaugcuaagaauaaucuuuagguagagaccuaaaucuugacugagggauaaaauuggagguuuguauauacaaauauaagaacuuaugucaggccgggcaugguggcuuaugucuguaaucccagcacuugggaaggcugaggcgagagaaucaccugaggucaguucgagacuagccuggccaacauggugaaaccccaucucuaccaaaaaaaaaaaaaaaaaaaacccacaaaaauuagccaggcgugguggcacaugccuguaaucccagcuacucaggaggcugagugaggcaggagaauugcuugaacccgggaagcggagguuguagugagcugagauggcaucauugcauuccagccugggcaacaaugcaagacucuguuucaaaaaaaaaaaaaaaaaaaaagcguaugccaaccugauuccauauagaacagccaugguuuauuuucacauuagcaauaaagcuaccuuacuaaagagauagggcuauguaagaugcccugguaguccuguugacaucucuguaaaaccucucccaucucaaggucuuuucucugcuuuguuuugggaaaaggggagaauaguagaaccagugaguuguaguucuacacuaauaaaaaaugccucuaucaauauugaucauuaucuguuacuugauugaaguccagaucauaguucuuauuuaugaaaaaccaaucugcauacuuuaacucagauguacauuuaguuauucauauuauuguacaacucaauuacucagaaacauuugucccaaauuuauacuguggucauuuuugccuauugcuucaaaaggcuuuauagaagaugggauucuugacuuacaaggcaguucaggguuaauccauucaacaagcaugugaagauaagggcauuucagauaaagcaugcagagguaccuggauucagguuuuagcucugugucuuaugagcucugaucuugggucagucacuuauccuguccauacuuguuuccucaguugugaaauggugauaauaaaagcaccuacuguauagcauuauaaggauuaaaugagauaauacaugccaaagcaacauaguauuuggaauguagaaagcauucaauaaauguagucuuuuuuuuuuuuuuuggagauggagucucacuuuugucacaugggcuggagugcaauggcguggucucagcuuacugcaaccucugccucccggguucaagggauucuuucaccucagccucucaaguggcugggacuacaggugcauugugccaccauaccugacuaauuuuuguauuuuuaguagagacaggguuucacuauguuggccaggcuggucucgaacuccugaccuugugauccuccugccucggccuuccaaagugcugggauuacaggugugagccauugcacccagccuccuucauuuucuuuuucuuucuuucuuucuuuuuuuuuuuuuuuuuaucuuuuagggauggaguuuugcucuguuacucaggcucucagcucacugcaaucucuguaucccagguucaagugcuucuccugccucagcuuccugaguagcugggauuagaggcucccgccaugaugccccgcuaauuuuuguauauuuaguagagacaggguuucaccauguugaccaggcuggucuugaacuucugaccucaggugauccacccuccucggccucccaaagugcugggauuacaggcgugagccaccgcgcccggccccggccuaauuucuuuuuuaaaagcaaacaauucauccuuaaguauuagaaauagcauaaauuuuauuuuauucuagaauauuauuaaauucuaaaauagcaguuuuaaauaauuuuaaauuuaugaaaguugaaaaaaguuuugaauuuuauuuuaaaacaagucaaagauauauacuuauuuuugguguuuccgcauaggcauaaggaacacuuuuggauuuuaaaaauaacaacuuauuggaugauagugaaguuacagagauuauaguagguauaccuggagauaccagcaggaacauaguagaaauaauaagccaaaaacacuuuuauuuauacuguaaccaaucuccuuggaaaacuuuagaaaacacaaaaauauacaagcauacauuccauuuauucagccugaugacgucaucacacauacagccucuggaaaaccccacucuacacucaagagagaaugaaaagugaaaaagacaaaggacauuuuaguauuaugaaaaugcuuuugaccucaaaagccccugaaucaaagggaaaggugaaaaggaaaucgccauuggcaaugguagaggcuauggaagauugggucuugcaaaauuuauuagaagacguuucugaagagaagaccuucugaggcaccccuuugcagguaaaaaaacauucauguccucuuucuccacaaagcuuuuguuaaucaccagaccucacaguggucucgcagcaccucuuaaagcagugguucucaaaaugugguccauggacucccaggagucccugauacuguuuuucaaggucugugaggucagagcuguuuucauaauaauacuaagguguuugccuuuucuaugguguugacauuuugcacuaaugguauauaagcaaugauagguaaguaauuaauaaccauuaguuauuguauuugucauugguguguacuugcagauaacaucuuucuuccaguuucacuuagaauguuuuugaugaagccauuaaaaugauuaguuuuauuaaauaucaauccuggaguauaauuuuuuuuuuaaugaacugggaaguacacauaaaguacuucggcugcaugcugaaauauaaugguugucuugagggaaagcauuccugauuguuugaguugcaaacugcacuaggcuccuuuuuuuaaucauguaucucuuuuacuuuacagagagaccaugguuauucagguuugggcaucuggcagauauuuucuugaaaaugaacgaagugagccugucucaaggaaacugacaguauuuguugucaaugauaaaauucaagcuuucaaauggaaauuagaauuuuggaaaacccaaacccgccaccaugagcuugacagcuuccagucaagcuguccccgguguagaccucguauuugagcuccagacucucacucuaccuaucuauauauauacuguguccacauaaauguuucauauucuaaauuuaacauguccacaauggaauuuuuuauuucucccacaaaacuuucucucuuucacccugccccaauuuuucucaucuuaguaaaucaccuccaacccaguuguucaaacuagaauugaagucauuauuucuuuuuccucaccuccuacguccaauccguuagcaagucuuuugaguucugcuguuaagauaaccucagaucugcuugcuuuucuccaccuuugccauuagccuauuccagguuaccaucaucuugcacuugaucuccugcaucagguaucucauuggucuucccuucuugccugucucuaauccauuuuccacacagcagcagauguaaauagaaauuauuucaugucacuccauugcuuaaaauccuuuaauaaugcccauuauacauagaauaaaauucaaauuccuuagcuuauaaggccuuucauguuuaggccuuuaccuccucauucuuuuuuuuuuuuuuuuuuuuuuuggugcagaguuucucucuuguugcccaggcuggaaugcaaugguguggucucucggcucacugcagccucugccucccggguucaagcgauucuccugccucagccuucugaguagcugggauuacagauggcugccaccacaccuggcuaauuuuuguauacuuuuaguagagaugggguuucaccguguuggccaggcuggucucgaacuccugaccuuaggugauccaccugccucggccucccgaagugcugggauuacaggggugagccaccaugcccggccauucuuuacauucuuuacauucuuuacaaccucauucucccuuucauucacuaaauuccagccacacaaguaaucuuucuauuccuuaaacaugccaaguucuuucuuacaucagggguuuugcaauuacuauuuucuuucuuucauauagcaagcuuucucucaucccucugguccuaguucaaauguuaucaccuuaaaacugccuuucuugauuauucuaucuaagguaguuucuuccuuuuauaccuuauuuagccucuuggucauuuccuguauaacagcauaaauuuaauuauuucaucuaucuauuuacuuaauuuuuuauccgucucccuuauuagauaaaaauaagcaaauaauuuuagauguguuaagauggaggugccuauaggaauaucauacagugacgccaucuaguaggccacugucuggaacuuaagcucagagggagauguuauuaauagauacagaguuuuggaaauuaccuguauguuaauaguaaaugaagccauggauacagguaagaggaagauuugacugaagaggacacagagacuagaauagaaucuucaagaauucccacauuugagggaccaaaaagagaagcccaaaggaaacugagaaugaagauauuuuggagaucaaaggaaauaugaguauaauaucagaaaagccaaaggaagagagucuuucaaggaagaaauauuaauaacugugucaaaauccugagaaguaaaguaagcugagaaguauccaauaggcguagcaauaaggacauaguaaccauggcaugaauaauuucaguggauuggcaagacaagacagaccauaauagauugaggacugaauggaaggugaagaguuguggauauacuguaauaaguuuagaaagccaaggaguuuggcauugaaggcaaucaguccccaagaaggugagagagaauuugauccagagcacugguggaaggauagauuuugaugggaagagaggaucuuccauuaaaacaggagggagauaggagaagauggauguggggaaguuuauagguuugaguauugagaaguuggaaaagaaauuguuuccauuuaaugauuuuaguuuuuucuguaaaauaagaguagaaguaauauacugagaguaagggauguuauagccagacauuugagaaaguauagaacauuaugacagcugguauggagacaagaagaaagggcugaguaaggaaauguaacaggauuacuagguuguauugaccuguguaucuggguuguuuucagcagcagaacaguccaggcguaggcaugaccauuugguaaugguagucugccuauguaugguuccuugcaagucuucacuguggaugacauugaguaagacuugcucuugcaaccgaacauagacucugguuaacacuacaaugucagcauugcauuaagaagauagauugaacuuccuuccacuuucucugucacugcuagacuuggcagaagauuuugacuacagcaucuuuaccuuguagagaacugcacuuagaagcaaaguugaagugauuuauggaccucacagaagggauuuauagcucccguaggaaauaauuggcucaugaccuuuaaaauuagaggaaauuugccuuggagucauccagagcgagugaacacagcagcacagucaguccucauuauuuucagauuccauauuugcaaauuugccuagucaguaaaauuuauuuguaaccccaaaugaauacccccgauccuuuugggaucauagacaugcauagaauggugaaaaauuugugucaccugacaugcauuaagaagcaaaaauuguccuggaauacaaaccuucaagaagaccuacagagcugaggucaaacaugacaauggucugccuuccuguuucaucccucauacuguaaacacguguccuguucauaaucuguuuagugccauauauuuuugaauuuuugugcuuuguuuuagugauugcacuguguaaaauuguccccaggugucaugguaaaguguugucuaguguucuuaagcucaaaaaggcugugauguguguuacugagaaaauguguguuagaucagcuuaguucagacaugaguuauagugcuguuaucucuggguucaaugauaauguaccaaaauacauuaaauaagaugucuuuaaacagaaauacauauaaaacaagauuauguauugacacaaaugcugagaaucacaugcaccuaaccguguauuuuuccuaggagcagugguucacuguuggcaaauuuaguguucauggcaacuuuauagaauguaacuaccucaaauaauaagaaucaauguauuuuauauauuuauuuuggaggaccuuaaaguaucucacagacauuagcucauucaucaacacaacuuccagaaauuagcugcuagagaaugaguuguuauuuggaggauaagggaaaauucacucuguaggucucccuuaagguuuguauucuaggacaauuuuugcuucuuaaguagacaguauuuuacccuuggauguaaaaagaucugcuugcuaauuaugguuauguuugauugauuugcuuuggaacuaauuggaauauucccuauuugacuucaauggggaaagguuaaaagguaaagaaagcauuuuggaaagcagucagaacuuuuuggcagaaaaguaccagguagagagaaauaaucauagugguuauuaucacaaauguaaaaaagguaaggauauaaauugcuggauacauauuugaauguguuauguugaaaauggcuacucacauauauauuauaggaacuuuucucuccuucaacucggcauucaaaccuuugucuagauccugcuaauucuuccuuuauaugauuucucaaauuuguuccuucuuuuucauuaauauagugauaaucuggaaauccagacuuuaaccauuuucaaaguugaccucaaaguugcucucauuucuuucagccacauuuucccuugaauguaagaguuacacaguaauaaaccaucuuccuuaagcauauuuuuaucacauucugcagacauauuacugcccuacuuagaaacuuucaguggcugcuaguugucuauuuuuaaauuacuauaaaccacugucucuucauguuccucaauucuccuacagccuuuccacccuauccccuguaauugaugucaucucauaauucauuguguguguaggggaaccucuagauguuaauuccuucaucuuauaaccaaaucuauaaagcugccugugucuauuccuuuuuucccuuccauuacaaaggaaagaaguauuagaacauaggcaucuuugaugaggggcauuauuuugucuaccacacauuucuuuuuuucuucucaauauaagagcaauguauccucauuccagaaaaauuagaaaacagaccagcaauuuaggaacuguguaggcccuguugaucuccuaauggaaacagagauccuuaguucauguugauuaagaagggagggucucugauuuacuuaaggccuugaagauacuccaaaaguuugucaaaagucacagagaagaaaagugucaccuuccacauaaaauccauggggaaaaggaguacuguaagacucuuggcaagguauuuaguuucucuaggucuuggcuucuuuauccuuaaaauaaggaauugaauuaacugauuuuuaaaauuauugucuuuuaauauauaaaggcugguaccuacauucuacuaaaaaucaaaagagaugaauagauaacaaacauagguuugcuaguuuuuuaaucaaaucaacguauaguguuauuucgggauucagucaguuacauuuucacagucaugaaagacaaggaaagacugagaagcuaucacggauuggaggauaccaaggaggacaaccaaaagcgaugugggauccuggaugggauacuggaacugaaaagggguauuaguggaaaaacuggugaaauccaacuaaagccugcaguuuaguuaauaguuaauaguauuauuagguaauaguauugcaccaaugugaauuucuuaguuuugauaauugcugugauuuuacaagaaguuaaccuuagaggaugcuaggugaaguacauauggaaacucuguacuauuuuugcaaguuguuucuaagucuaaaauuauuucaaaagaaaauguuuuuuauuaauaagagugggaaagcaagccacagagggagagaaguuguuugcaagauuuauaacugcaaagaacucaaaaucagaauguauaaauaacucauacaaaucaguaaagacugacaacccaauagaaaaacaggcaaaagacuugaaagacucuucacauaagaugauguccaaauagccaauaagcauauaaaaaugugcuuggugggccgggcgcaguggcucacgccuguaaucccaacacuuugggacgccgagguggguggaucacgaggucaggagaucgagaccaugcuggcuaacacgaugaaaccgcaucucuacuaaaaauacaaaaaauuagcugggcgugguggcgggcgccuguagucccagcuacuugggaggcugaggcaggagaauagcgugaauccaggagguggagcuugcagugagcugagaucaggccacugcacuccagccugggugacagggcgagacuccaucucaaaaaaaaaaaaaaagaaaguggggccucaaauagauauuugcacaucacuguugauaccagcacuguucacaguagccaaaagcuggaaacaacacaaaugccuaucgacagaugaauggauaaacaaaauguggcauagacauaaaauggaauauuauucagcuuuaaaaaagaaaggccaggggcgguggcucaccccuguaaucccagcacuuugggaggccgaggugggcggaucacgaggucaggagauugagaccauccuggcuaacacgaugaaaccccgucucuacuaaacauacaaaaauuagccgggcgugguggcgggcgccuguagucccagcuacucgggaggcugaggcaggagaauggcgugaacccgggaggcggggcuuccugugagcagagaucgcgccacugcacuccagccugggagacagagcgagacuccgucucacacacacacaaaaaaaaaaacaaaaaggaaugaaauucugccauaugcuacaauauggaggauccuugagaacauuaugcuaagugaaaugucagucacaaaaggacaaauagauuguaugauuccaccuauaugaguuacccaauguagucaaauucagagacagaaagcagagccuugguuaccaggggcuggagggaagggagaaugaggaauuguuguuuaauggguauagaguugcaguuugagauaaugaaaaaguuuuggagauggaugguggugaugguugcacaaugugaauguacuuaaugccacugaacuguauacuuaaaaaugguuaaagugguaacucuuauguacauuuaccacaauuuuuuuuuaagugguuguguugguaaugguaguggugguggcaagauauagaugaaaaccacagugugacaccauuaucuagaaaggcuaaaaugacagaggccaaggaucugaagcaacuggaauacugagaucuugcugguaggaauauaaacuagaacaaguauuuuuggaaaauuguuugacauuaucuagcugaacauaugcauacuccauaaccuagcaguuccccuccuagauauauauccguagaaauauuuucauauggguaccgaaagacauacaagaauguucacagcaacauuauuuuuuuauaguccccaagcugaaaacaaccaaaaagcccaucaacagaaaaaguggauucaguaaauuguggcuguucaugcaaugggauacuuucccacaauauaaauaaaacuucuaguaaaugcaacaaacuuggacaauucuuaaaaauacauuaaaaagaaaaaaagacaccuuaaauauuuuaugauguuuauaucagguucaaaaauaggcagaacugaucaguggugacaagagucaggacagagauuaccuuuggggaggagugaggguaacaacugauaggcgaccuaugagaaggcucuaggguacugggaauguucuaguuucuuaucuguguagugguugcauagguguguuaacuuuugaaauuuuaucaagcuguagcuuuguuauuuguguacuuuuguaacuaaguuaugcuucuauaaaaaguuuauuuuaaaaaagaauauagcgagaagcacacauucuacauucauuuaauggcauuauguuucauuauuuaacccccaaccuccagcucagugauaaaacugagggcccuaaaugcaaauuccuucccacucuuauucuuguuguuuugaaguuuaagaacaaguuuucaaguuuaagcuugacuuuucuuugagaacagcuuuagcuagaggugcuaacuaugcagcaaacugaacccugaccuaaguggagcucuaauuagccgggucagggaaauugagaauuuaaguccauacuccacuccuggauucuacaggucuuagggaguagagaagguagcuuagugacugcuuuagaauacuguaaucuuuguauuacuuaauuguuuauuugagaaacacuggauuagucaguggcaaggagguacauuuaguuuauacuaagcauaauuuuguuauagugauguuucuauuuauaauaguuuuguuaauuuuuacucauacccuguucucuuuuccuuccuuuuacucuucagcuaccuguucuauauuuaauucauuuuaggcuuugcccugagcuagcuagcuauuuuuuuuuaauuuuaauuuuuuuuuuuuugagacggaguuuugcucuuguugcccaggcuggagugcaauggcaugaucuuggcucaccgcaaccucugccuccuggguucaagugauucuccugccucagccuucccaaguagcugggauuacaggcauguaccaccacgcucggcuaauuuuguauuuuuaguagagacggaguuucuucauuuuggucaggcuggucucgaacucccgaccucaggugaucugccugccucagccucccaaggugcugggauuacaggcgugagccaccacgcccggccacuauucuuuaaaucauauauucaucuagcacauauucauggguuguuuacuaugugcugggcacuuggaauacaaaaauaggacauauaacuucuguucucagauugcuugcaguaccaguguggaaagagacaaaugaucaauuauaguaucaaugcugacaugcacugugauagagaucagucugggggauuacucaguaauucguguaauugauucuuaaccuagaccaggaacuggaaaugucuacugaaggaaauuacagcuaaucuauaaauuuugaaagacguguguguguguguaugugugugcaugcauaugccuaugugugcuuucauucagagugggaagguaagggaauguagagcaccaaggcuccagagauaggcagagaccaagucaugaaaggucuuauaugucaucaugcuaaggaguuucaauuuuauuuugaggauagugaggaguaacugggguguuauaaacaaggaagugauauggcauguauaaaugaauuuaaugaauugaaguaggcuguuacaugaauggaauuaucuagguaaacuuuuacuuuucaaaguguugucccagccauauugucaucaucucagagcuauucaaaauguagaauuuugggaccuauuccagacuuucuaaaucagaaugggcauuuuauuuuaacaagaucuucacaugauuuauaugcacauucaaguuugaaaagcaccgauuuagacagauaaugaugauggucaggcuuuauacagcuggugugaggaagauaggacagauugcaagagauauuacggaguacauguucuucccucuauuuggaauacucuucucaauuccccuccaacacacaccagguaacuccccgcuuauccuuuaccuuucugcuuaaauggagcuucucucuugccacggccccaauacacauaauuggugcccuugccauauacucccauguacuuauauuaucauuucucacacuuuuauauacuuauuuaauugccucucuccuuguacuguaagcaccacgaagauaaagaucauuuuucugugguacuuggcacaugguaggcacccaguaaauauuugugauuugauuaaaugaaugaauucuucauguauaagaagagaaaauggauuuggguaugcuagagagaaggauguacaugcuguaauuauuaacaauaauaguuauuuuauguauguguguguguuuauuuuuggacacccagucuuguucuaucucccagacagagugcaguggcaugaucauagaucauuguaacuucaaacucuugggcucuauccucccaucucagccuccccaguagccaggacuguaggcgcacaccacuaugucuggcuaauuuuuuuuuuuuuuaagagaugggguuuugcuauguugcucaggcugaauaauaguaaauuuuaaauagcacuaauaaguuccaggugcuaagugcuuuguucauauuaauuuauuugauuaucccagcaauccuauaggauagauauucuuaauagcccuauuuuacagaugagaaaacugaggcacaaaaaggauaaguaauuugccuaagguuaugcuguugguaagaagcgagauucaaaccaggcaguugaguacuacucugcucuaucuaguuuuggacaaaauagcuuccuggugcuuaguguuuuauauguauuaguuauuuaaucuuuauaaaaccaauguguagaagauacuguuauccugauuuacagacaaagaaacaaagguucaaaaagguuguguagccugaggauacacagcuaguaagugaugaaacuggccuucaaacccaagucuauucaacuuuaaaagccuauagucuuuaccuguaaugaugaugcuuccauguugaguccaaaaaauaccugugagguaugaauuuuagauuacugaggaacugauaaguaagauaccuaacaucauuuagguugugagauagggagaagggcucaacaaugccggugucugugauagcacuggcauuuugaguuugaaggaguaaaggagauuuaagguccagcaauuccagccagucucauacuugaccacauugagcuuugaacucaggugguuaggaacuuuagccuccauaauaagcugaaacuuaggugacuaaggaauaguuauugguuuucuuguuuuuuuuuuuuuuuuuuuuuuuuuuuauggucucagagaaucuagauggauuggaaauaguguuagaacuggaaggaaccaguucuaaccuuccacaguucacucuuccuuaccucccucucauuuuaugauaaggagauugaagaaggguaauuaggugauuugccaaaguccaauaaaacaaagccaggaaaagaagacagggucacauucuuguauuccuugcccugugccuuaucucuagguuccagauucaucaccuuuugauuaaaacuguucugccauuauaguaacaucuucacugccuggggguuuuuuuagcuuugagcccugaaaagaguaacuuuuugucccuuccccuuuggcccuaagcacauacucacugacuucagaucauccggcaggccauaugcccucauggaugacgauaguaucgagucaauacuugugggaauacaacuggcacagaggauuuugagcuguuuuuggaguuaagauucuucuaagcuauucagauacuuggucaauuuuuguacaacagaaagccgcaggagccgauacaguuugcauaacuuuuuuuugaaguugccaacuccucaccuacauguuaaggguaauauaaucauaugcaguggucucacuccugcccuggcuauagguguaucuucuaaggcacauuaugguaaaguggaauuauauuggaaacgaauuuauaacuaguacuuauaccuauaccuuaugccuuacacagucuuugucaguuaauaggccuucaguucucaaauguaauagcuacuauuuuauuuccauuucagaauuguugcagaaagacguagugagguugcaguguucaaauagucuauuuuaguuaaaaccuacaguaaggaaacaaaaaaaagucauaacuaaaaacaacacuuaguuuagccugccaaagugauauauuuuacuuguguuuauucuuuuauuuauuuauuugagauggagucucacuguguugcccaggcugcucacugcaaccucugccucccagguucaagcaguucucccugccucagccuccugaguagcugagauuacaggcgcccgccaccacgcccagcuaauuuuuguacuuuuaguagagacaggguuucaccauguuggccaggcugguaucaaacuccuggccuuaagugauccacccgccucggccucccaaagugcugggauuacaggcaugagcugucaugccuggccuauuuuauuuuuaaucuuguuucucuaaaagucauuuucuucugugguuuaacacuaucaugaagguugucaucuucuauuuauuuaauaaaucauuacauagagaaaauaggcugggcacgguggcucaugucuguaaucccagcacuuugggaggccaaggugggaggaucacuugaggugaacuccugggaguucaagacaagccugagcaacacagugagaccgcuaucucuacaaaaaauucaaaaaugugccaggugugguggugcacaccuguagucucagcuacucaggagguugagguggcaggaucacuugagccugggaguucaagcaaugaucacaucacugcaccucagccuggaugacauagugagacccucuuagguuagaauagaauagaauagaauauuaauuuuuuucuuuuaccuuaaaaacauuuuuuuuaacuuuuuauuauuuuuuaauuuuugagacggagucucacucugucacccaggcuggagugcaguggcgcgaucucggcucacugcaaccucuuccaaguucaagcaauucuccugccucagccuccugaguugcugggauuuuaggcacgggccacugcaccuggcuaaguuuugcauuuuuaguagagacgggguuucaccacauucaccaggcuggucucgaucuccugacuucaggugaucugcccaccucggccucccaaagugcugggauuacaggcgugagccacugcgcccagcuucuuuuaccuuuucuuuuuuaaaauuauuauuguuaccacacuagucuacacuaucaauauaaucuaguaauuuucuuaucacugaaauauucuaacgguugggcuucacucuagccauaaaauagacuuuuggccuuaauuuguuccuaaaaguuucauuauaaugcagaucaaaauggauuacaaugggugcagaucgagcaauggaaaauggauuauauauuccugcagagauaauauaauuaaggacuaaaacccuacuaaggacuucucgucaaauaagucauauagguguagucaguaauauaacuaagccucauaaauauaaaacaguguuccaaauucuauaaaauggacauaaacauauugaauacauugaguaugcaaguugcccccaaaguauaauuaagaauacguacagcauacauaaauuuuaaauuugguaauuucuuaagcaccuacuauaucgcagguauuguaggcaaaucaaaguaggcuaagccccugaagagccuggagacuaacaagggguagcacacauacauaggaacuauaauuugaggaauggugagaauagugauauagccaaagaacaauauuagaugaaggggagauuccuuuuuuaaggucagguuucaugguagaacuaucauuccuuuaaauauuugaaaaagugaagauaauggaagugaaggcagaaacgaaugcauuuugauuugagaaaaugacaugagcaaaggcauugagguaggaaagaacacagcaugauaauaacauaauuaagagcuaccauuaauuaacuccuuagaguauguacccuuuuaaaauccuugcaucaguccuguuagguagguagcucuuauuauuuccaccauacaaauuggaaauuggaguuauauagagaggucaaguaaguggcagaggcaggauucuaaccuaacucugucugauuccaaaaccaguguucauggucaccauacuguguagucuuuacauucaagaaguagcagauaauacaguuuaccuggaggauagaguauauauauauauauauggguaugaaguggauugucuucugggaaaggauuuguagaggguuaagaggcagugaaaaugaacagaaagggauagaugaaagguuugguggaggagggcacagaaauaauauccaagugauuguucuggggacugugggaaaagggggaaaucaaaggugccugagguuucauauaugguugccugaggacaguggcaucacaaacacaaaaagugaggagaagaaaguguuguuuggaggggggcgggaaaggaaagacagcaauaauguugauuguagauguguugcauuuaaagcacagaugaaauacaccauuggcaauuuagguaacagaugugacuucucauuuuaagaaguccucuggguuuaaaggaagacagaggacaauaauuagagguugcuaggagcuaagacuuuaucagaguugacacucugacuucagugggccuuauuuucccugcaucucaucacccuguguccugacaucacucaagucgccucaacuccauagcuccucuaugaccacagcuuccuuuacuucuaccucugcuguucuuauuucgccugcucuccacccucccugugaucccuugauacgucugaaugcaccugguucaacagucccuguuuucaccugccuuucucuccagucaaaccucuggccauucauuugaauucugcccucucuggcaucuuacaguaccucuuccauagauauuaccuuccucuccuccauuccaaauccaaaggaccauucucuuaaguaaugaaggccuuacagggugaugaacugugaaccccaaacaucugagacaggucucgguuaauuuagaaaguauuuugccaagguuggccaggcgugcuggcucaugccuguagucccagcacuuugggaggcugaggcagguggaucaccugaggucaggaguuugagaccagccucaacauggcgaaacccugucuacuaaaaauacaaaguuagccgggcgugguggugcaugccuguaaucccagcuacucgggaggcugaggcaggagaauugcuugaaccugggaggcagagguugcggugagccgagaucacgccauugcacuccagccugggcaacaagagcaaaacucugucucaaaaaaaaaaaaaaaaguuuauagaaaguuuauuuugccaagauugaggaugugcacucaugacacagccucaggagguccugaugacaugugcccaagguggucagaacacaguuugguuuuauacauuuuaaggggacaugagacaucaaucaacauauguaugaugaacacugguucaguuuggaaaggcgagacaucuggaagcagggagggggcuuccaggucauggguagauaagagacaaaugguugcauucuuuugaguuuuugauuggccucuucaaaguaggcaaucagaugugcauuuaucucagugagcagaggggugauuuugaauagaaucggaggcagguuugcccuaagcaguuccagcuugacuuuucccuuuggcuuagugauuuugggggcccaagauguuuuccuuucacagagccuauaaucauaauuauaauauugucacuguuagcuguagagaaacuauccucuucaaugggaauuaacacuguaaagaguccugguccuuaaagggaccaaagcaggcauaucuuguuaggcuuccuuugugccugaaaccugugguacucuuauuggauaauauacucuaggaaugaacuaagcaggugagauaggcuagcuuaccuuuuuucuaguuaugucuuauuuccaaaauucugaagugugcagcaaggagggaguugguauggagagauaaagcagaaacaacuucggagguccuuuaaggugauaguguacagggcuacugcacuggcauccuguuucuuccugaaaccagaucuguguguaaaauccagcauugguuagggacuuugaggcagcacuagucuugguuggaaacccuggcuguccucuaaaccuacacugugguggcuucugacuagccucagugaagucacuuugcaaucagcaccugugugucuguagcugcgggcccugaggccuucguguauguagcacagggagccagcagagggagcugucgucccagaacuuucuuagagcugcuaagaaauucugauuuugaaaaagaucuuccuaggcuccauccgaaccucccaugcaauaagacucuaacuugagauaugcgagaguuuggugccagaccccuggugugagcagauggggagcuucugcauagcuguuuaaacuugaaagcccuaggagcucuugauuucaaggaaacgccuguuuacugauccaaaucaagcaacucuugagaaaugggagugccuuccugaccucagucuuuauugaucuugguauccgcaccuccagugacguguccugaagggugggagagaauucacaagugccucacacacagggaaagaaggaaguccaacuauugcugcagaaaguccccacuggggaggugcggguagaguguuuggguagcauuaaaacagugagugcccugugagaagcacagugccugggugcagcacuuugcaucagcucugauuuugaaaucagacacagaaggcuuugaagccggccaguaagggguugucaggcaguugacuaaugcucuugauuugaaucggaggcugcugugaaaagggaugcagcuucugcuagccacugugaacuucugaaucucacuaggguugggucugcuuuggggcacucagauaaccccaguauuuccaaaccagcuuucccuuuugcuucaggacauaucuuacccaagccugcacuauggagaagugggacgguaaugagggcaccucagcuuuucacaugccugaguggauggugaguucacuggucguuuuguuucuccuucuguuucuugauaaugagaggcaaccauuucugacgggugacaaggaucaccucugagaagcuccuaccaagauccgugguuggaaaaacaguuauuacucuacguucugauuaguuccuagguacuaggucaccacuguuucuuaauuauccacgaagcugggaaaggugugagaguugccuggccagggcuuguugccuggucaucucuggugggcaggggcuuuccuccggcugcuggugugauguauggguuguguuuccugugacuguuuugcacuucuguuuucaaccugaugcuucauuuguuucucuggggguaaagaaaaagaacaaugaggagaaaaaacaaaaacagaacuuacagaaauggugcucucugaagucugcaaagauugcaaacauuucuccccucccugcccguauuuuucccuucagucacaacauuucccuauuucccccccagcuauccuuuauauauauauuucucuauggcaggaacugcagcucucuugguacaguucuucagaauaccauguuugccugaucaguaguuuuacuaaaaugauaauaaggacuuauuuguugauaagaacuagcauauaaaccuauuauauuggaucgaauuucaacuuuuaaagacaauaaccauccuuauguuucuaaauaguuucuucuagauuuagccugauuucuuacagcccacacagguuuauguuuacagauuuguguuuccccacuauggaaaacuaguuagacucucuaaaacauauuucaaguucuuuuuaguguuuauagaauuauggauuugaagaaauaacuauugauaaugagauagaauauauaguaggccuaacaaaggcccccugaggaacuuacauuucaacucauuguuacaacuauuuuuuauuguuuugggggagguuauugcuguucuucuuaaugucguuucagaacauuguguucagguuuuuuuuuuuuuuuuuuuugaaauggagucuggcucuguuguccaggcuggagugcaguggcgugaucucagcucacugcaaccuccgcuuccuggguucaagugauucuccugucucagccucccaaguagcugggauuacaggugugcaccaccauaccggguaauuuuuguauuuuugguggagaugggguuucaccauguuggccaggcuggucuugaacuccugaccguaggugauccacccaacucggccucccacagugcugggauuacaggugugagccaccacgcucagucuuguguucaauuuuaaaacauuuuguggaaagaaaaccuauccaucuacaagcuuauuccaaguaacauaguguuuuagaauuaauggaaggauuuauguaauacuucugauuggguugaguuuuuuugaauuucuugcuacucacuaauaacaagaagagggaaaaagaaauuugguuuucuuaagggaagggccacguuaagguaucaaacuuugguauuucuauaaaggaauauuacagaagaauucuacugaacauuagugugccaacucagaaucaaucaaaguuuuauaauaauucuuauuucugucauaguccucaccgucuuacaagcuuagcacauccccucaaaguucaguaguggcuccugcugaacuuucacccauuuaccuucuuucuaguuaaugugaaugggaagacugcccuaaaggaguuggugugaccacugcauaagggauaugaucuagggcuucccagcuuuuagaaaacacucuuuauuuaauaaaacacagcucuuuaguguugugucuugguugguaaaaaauaaauaaaaaaauuugcagccgggugcgguggcucacgccuguaaucccagcacuuugggggaggccagggcgggcagaucacgaggucaggagaucaagaucauccuggcuaacacagugaaacccggucucuacuaaaaauacaaaaaauuagccgggcgugguggcgggcgccuauagucccagcuacucuggaggcugaggcaggagaauagcaugaacccgggaggcagagcuuacagugagcugagaucgcgccacugcacuccagccugggcgacagggugagacuccgucucaaaacaaacaaacaaaauaauaauuuagaaaagcacagcucugcucuguucuguuuuuaauaagguauuacucucacuuaggaauuucucagccauucucucuuaaauagcaggaaaauaccuuugcucaguauuuugaacagcaauaaaaaggaauagggaggagcuagucuucaauaacacgauugucucauuugcuagcuuuucuuugccaaagacuuuugaggcuuucuuucagauaccacguaagucauugacuccugacuuggucugaaaguacuucauuagguugcuacugauagccacuuagccaagaaagcuaaccucugagcacccucuaguguauugccgauggauuuccagaccuuacuuguaaaauguuaaagugucuuuuaauccccaagaaaaaaaccguugcuccagcucccauguugggccaaaguuucaauuuaaaguuuuaacgagugucuuacucauguucccauuuacauauuaguguaaugaaauuuccacugaaacuaucccugccaccaaaggaaauaugagaagucucucaaaucuucuuucaggagaaaaauuuagcagagaagguauauuacaacaucucccuuuuguuaaaaaucaccagcaaaaagggacuucauaucccucagagaauaggacucacaccacauauaacagcugacaguacucacaucucugauuuccagcagggaaauaagccgggaugaagccugaagaaccccaaucucaagaacugacgagguagacuuucaagguuacguuccaucaaucacuggaaaacuucuccuggagccucugcuccucagcuguuuucaugugaaggauuuucuuagcccuguucagacagcuuuacugcugaaagguuggggaacacuuccuuuuaaagacugucuuuauuaauguguuuuacuuccccugagagaucuuuagucccuucugguaguaaccucgacugacaugcauggagaucagcaauaacuuuuucuguguuucaacauuuuaauauuuccuccuccucccacuccagcucucuguacuuuuccauaggaaaucugguugauugacuuucaugaguauccagccagcuugaugcccgauauucuuuuggcaagaaguaauccuuuucauagguaaagaguuaguucaagccgcucauuuggcuuggaagagagagguguuuugaggaauaucugaaccauaucuacuuggaaguagagacaaaaaucuccaaagugucugauaaauggugguagagguagcuugacuaucacucuaggucaggauuggugcuuaaaacagaaagccauuugaaaaacugaugaaaacuaugggcucucuccccaggauauuaaaaacacaaaauuuugcauacuguuguaggggguucuagacauccauggaauauagguuaagaacacuuaauuugaaagaauagaaauauuaauauuuuagacuugcauaucaauauguaguuuucaaaacccucucacaucuuauuaucucagcauacauuuuaaauaggcaaaguagauaugauuaucccuauuuuagaaaugaugacagaccuuaggaaguagagacacagauacauccuuuguaguauuacuuuauguacuugaaaaggaauuaauugguuucucuuggccuugauccucuuuaggauaaauagaucuucuguccuccccaugaguccuguuuuucuuaauauauuaccugucucuucuuaagagccuuaaguuacggaaagcagaauuagacccaguuuucuuuagacccuguuuuggguguaaagaaagaucaccucagcugggcguggugccucaugccuguaaucccagcacuuugggaggccaagguggauggaucaccugaggucaggaguucgagaccagccugcccaacauggcgaaaccccaucucuacuaaaaaguacaaaaaaaaauaagccaggcaugguuggugugcuccuguaaucgcagcuacucaggaggcugaggcaagagaaucacuugaacucugagagguggagguugcagugagccgagauggcaccauugcaccccagccugggagacaagagcaaaacaccauccccccaaaaaaaagaaagaaaagaaaggaucaccucauuguauucucugaccuuucaaauaaccuuuacuuuucugccugugaacgugccuccaugguuauagccaugauaggauagaaugguugguuaaguagagucaagagaaucagggcugcuuuacucacgcuuggagaaaguguuagagcagugguuuccaaaguguggucuucagacugguagcaucagcgucucccggggaguuacucaaaacacaaaaucuucaaccagagaauuggaagcugaaaaaaauuuuuuuuuuuaaauuacaaaauacaaaaucuugggcccucuccagaccuaauaauucaaaaacucuggugguuaagauccagcaaugugcuuuaauaagcucuccaggugauuuugaugcagcuaaaauuugaaaguuacuguguucuauaaaaacuuauuggcugugugcggcggcucacgccuguaaucccagcacuuugggaggccgaggugggcggaucacgaggucaggagaucgagaccagccuggcuaacacgaaguaagugauggaacuuuuuaaguuuuuuuuuaguagaaacccugucucuacuaaaaaaaacaaaacaaaacaaaaaagcaaaaaaacuagccaggcgugguggcaugcgccuguagucccagcuacucgggagacugaggcaggagaaucacuugaccccgggagguggagguugcagugagccgagaucgcgccacugcacuccagccugggugacagaccaagacucagucucaaaaaaaaaaaccaaaacaaacaaacagacaaaacuuguuaagugguaaggcuuuuccugucuccuaaaaugucuucugguucuauuugguauagauaugccaguccuucuggcucaaguuaucugacuuaagucauuggaccaaggagcuccuuuuuaccugagugagggaaaggggaaccagcuuaguacaugcggacuggggugaacauucuuguuaggaggagcaaaaguugagagauucaucaagcaagcaaaugaucugucucacuuugugaaauuaugaguaagagaucagaauugcugugggugauggugaauauucauauuugaguucaauuaauuucuguuuccauuucugguagugacauugggcaaaguugccuuaaagagcuguuagaguucuaauucuuauauaauuagguguuuuagaauugugacuugaucagggccccaagauuauccgggaugaugucauuucuaagauguaaucugauacgaaaaugaauuuaaagaguaauuuuaaauuaaauaaauuuaaagauaaaaggaaugauuugaggcuaguacaccuaggacuaggaccuuuggucuucugauuaauauuaugaggcaugguauaguagauggagcuuuggcucuagcauaaacacaggcucaaauuccagucccaucacuuacuugcugugagaccuuggacaaaucauuuguucucuuagaguuaaacuuuccugcuuugucaagugagaauaauacugccuaauucuuaagauucuuguacaaauuaauagaaguaacauauacacagaacugugaaaauaggcacuuaccaaacuuuucucuuccagagaugucaauaagcaguaugcaaugugaccuucucucucuaaauaaagauuauccuuaaaaaaaaaaaaaaaucugccggcuggguacaguggcucaugccuguaauccuagcacuuugggaggccgaggcagguggaucacuugaggucuggaguucaagaccagcugaccaaaauggugaaaccccauguuuacuaaaaauacaaaaaauuagcccgcgugguggcacaugccuguaaucccagcuacuugggagucugagguaggacaaucacuugaacccggaggguggagguugcagugagccgagaucgcaucauugcacuccagccugggcaaaaagagcaaaacuccaucucaaaaaaaaaaaaaaaaaaucugccauuuuauguccuuucuugugcucaacaagcagucuuuuuuuuuuuuuuaauuaaggaagaauugacaucacuuuccccccaaucucuguagcagacaguugaguguagcuuucuuccucacuaugucucuuucagaaaucagcaaauaaauaaugugauucuuugcccuuuugcuugaauauuuggcacguaguaagauuguugugauucgggggacucugaggagauaagaaacuucccuuuguagucgucccuuccaugaacacacauuuugugaaaaaagcaaacugggucacucugugccaaaucagcaacaaucuugagcugggacuagaaaccaaaugucaaaaccuguauaaaagaugcacaauucagaggaaagcagugaacugagaaaauugauuuccuuggugacagagcugaaaucaguguccccagucuggcuaauccaaggacacagaguguaggguagggccugccugaguacuuggcaccauuaauuuuuuuuucuuacuccuuuaaugaagucucucauuguuuaaguggcucugugguuaauuuuuuucuaaugagacuagguuaacuaaaaucaucugacauggaaaaggaggagguaagguugaaaaggaaccuaauuagcaaguuaauuauagcgagcaaaaaagugcagugguuauauaaauaagcuauuguuaugcgcaugcaaguugggccuugucaagggacuugcaagguuuagaggucagaggauccauguaauuagguguuuaggaaaaaaacaaguaaaagcaaaacagccacuagaauuaggaauggcuguugagccacuaacagaaaugccuuauuaaauuggggcuguacugcugaagggguuguuggagcugcuucagggauuccaaggaagaguagucccccacuccccagcccaaaaagcuggcuggaaccagagccaacagaauugcugaugaggaaaguuuaaaggccugaucacaagggucccuggaccacagagguggcaguggggcugguaaugucacuaugcugggcagcaagaagaaauacauuguuaauggcaacucugggauuaaggcccaggugaggcuaagcucuuauuuaccagucuugccgcugcuauagccauuauuguaaaaggccgacugcuuauacucuuuuuccccuccuuuccugcuuucaucccucccucuggcauaaggugagcuaccccucuuuuaacagucucuuucccucccuugccuuaaugccuguuggaauuaggcaguucucucucaaauggaaaaggaggauuaccuuaaaagacccugguuccagacaagguaggaaaguuagggguagaaucuacuaagguaccacaauuggggugggcagauuacaaaaccaauccauuacaaaauggacuguauauugguguuuaauuauuaagaggagguaaacaccagggagccacuuaacucauguucuggucgucagagaaagauacucguuucuugcggaaaauugcauaacuuauauuuaagugguuaaucucacucuaauauuuuucugucuuaaagaaacuugaauucggugucuaaccaguaagcaagguuuuagaacccuauguucuaaguggagaaagccuuguacaaccuagucuucuuuaguauuaaaagauagcaugaacuugucccaggaaggagggauugcuguaaauagaaaacacuauagagaagacagcucagcucagauaaacugguuugagaugauaaugcagcuagauagcuauaugguuuauucaccuugagccuacaaucuagaguauaagagugacuggcccccucuagugguguguguacauggugugugugcauaugcacccacauguacauguacgcaggugugugguuguguugggguuguguugagcaucugaaacacgguuuaucuauucuucuuuaaaggggacacuggaaaaguuccauuauuauuccuuuuccuggaugggcuucuaaaaaagaauaaagacaugugacuguuuugaacaagguuggugaaacggaagccagaguuugcauccugacugcuguccaccuccccagcuuuccaccuucccucuucuucccagcucuuuuugcccuuaaaaaucauuuuaacuuuagacuugguuuauguuugccauauuuagugaguauucaaacaaguauagacagugaagauagaauaggcuacuucagauauauugauucagcacuugauugagugccuaggauuugugccugcagauauaagggugaauaagaaucacagcuucucccuuuaugagccuauaguuuauagagaauaccgguaaguagacagauaguuacauucauugugguaagugcugugcuaggagaaaugcaauacaugaaaguucauguacguccuaugggaguacauagaaagggcacuuuaucuuuuuggaauaaauugcuaguugagcaaaauaaucaucuuugucauuuuuuuuaguucaugaagaacuucuuauccgaugaguuuuccuauugcugaaaacaauuugcaagcccuaaagcacucuguaggcuuuauuuguuguuauagcuaugaaaaugcuaugaaucccccuaaaaggcaaugugaagcuauuucaauuuggcauuggucccuugucgcaauacucaagugacucauuaguuaccucuaacugcaggaaguggagccgucaguuccugcuuucauucugguguacuguauguucugcccaucaaggaaccaucuuuuuaucauuaaagguagagucacuugucagaccuuugaucauuuucauuagaccuuccucuaugccaccuuggauccagaauaggcaauuauacaaacagagaaaacaaaaaaguuauuaguucaauaaauuguaugagcuuuuuuuccccaaacaaguauagcuuacaagugaccuuugauuuguagaguauuauaaaguaucagcuggaaccuccaacaauaggagaaagauaaaauuguaagaaaaucauuaucaaauaaucauccaaaaugcaauguccagaguaugauaugaggcuuauacauauucauucaauuaaucugcuccuucuacaucuauuauaguuaaugaucaaucuuacugcuuuuagguauuuuauaauaucaaauauuuaaaaauaaauuaauauuuacuuacuagccaggcgugguggcucacgccuguaaucccagcacuuugggaggccaaggcagguggaucacaaggucaagagauugagaccguccuggccaacauggugaaaccccgucucuacuaaaaauacaaaaauuagcugggcaugguggcacacaccuguacucccagcuacuugggaggcugaggcaggagaauugcuugaacccaggagguggagguugcagugagccgagaucaagccacugcacuccagccuggcuacagagugagacuccaucuaaaaaaaaaaaaauaaauuuacuuacuaguacuggaaagcuaacuaauauauuuuaaaaagcuuuaacaaauuagaguggcuaccugcaagaguuacgagagcauugaaccguagggguuggguagggaguagauuuauugaauuuccugcuauguuucaauuuacacacauugucucauugaacccucucuaaaaccugugagguaaguacuuuuaucucuguuguauuuauggaaaaaugagacucacuaaagcaucuugagcaacauuacacagcuaaugaguggcauagccagaauuuaaaugcaauuucagaauguucauucuuaaugaaaaggcuuuuuaaaaauuauuaaaucauuaccauuuccugagauucuugaaaccugaaugcaagugauuuugccuuccuguaccuugcaauuuucucaucuagauauguggagcuuacaaauaugauaaucucaaauauucuuucuuguaccuugcaauuuucucaucuagauauauggagcuuacaaauaugauaaucugaaauauucuuuccaguuuuacuuuucagugaaacuguauaaaauauuucugaauaugacucaauuuucuaaaaauuuaaccagaauaucccauucucuauuuguggggaguggggugucacaauuuuauuguaaaaagcauauagucaaagaguagccaggcacacuggcucaugccuauaaucccagcacuuugggaggccaaggugggugaaucacuugaggucaggaguucgagaccagccuggccaacauggugaaaugcugucucuacuaaaaauauaaaaauuagcaggucauuguggugugugccuguaaucccagcuaccaggaggcugaggcaugagaaucacuugaacccagaagguggagguugcagugagccgagaucgugccaccgcacugcagccugggugacagaguaaaaguccaucucaaaaaaaaaaaaaaaaaguguaucaaagauuuaaauuugauuagaaacauaguagguaaagaaugagacauugccagacacagugacacaugcuuguagucccagcugugugagaggauugcuugaacccaggaguucaaggccagccugggcaauauggaaagaccccaucucuauuuaaaaaaaaaaagaagaaugaaaaaguauucuuaucuucaaagggucuuaauaucccaaacauagguugauacaaucagaucaacuguuagggaaggugaaagccuguaauacaagccuugaauugcugucucaaaauggagguucuuuuucuuuauauaacuagguuucuuuuucuuagcagauccaguuugcugaccagaagcaagaauucaacaaacgucccaccaaaauuggacgucgcucuuugucucguuccauuucucagucaucuacugacagcuacagcucaggugaguacugaacugcuguggacccagcuguugaggcuaauaaguacgaucucaaugggcccuccugucuauccaaggcuaauuaagcaugaccaagacugugcuuugaauaaauacuucgagucaaaauuuagacuaaaaugcuggguggaauauuuggauuucucuuggcaauucagaguggagcuuaauagaggccuccucuuccaauagagucagaagagggugauuaaggaaauugaauucuuuaaucuacucagaagggugggaauaugucauugaugaucuuuccggaacaguauguguauauacuuguggucuuuuuuuuuuuucauccuuugaaaauaaaaaagaaauucuucaucccuccaucugguacuugcaaauuaacagggaaaccucaauugccccaagaaguaaugacacacuguagcuaguucaagcaagugagcccuuugccuucucuccuaagcugugacauuggacuucuuguuauuccucccauccuuugcacuggcauuaacucagauacaugugcccugggacugaguuaucauuuaaugccaggugagcuguuacuguguaggaccccuugaaggcaucggcuaguaugcuaaacgcugccuaguaugagucggauuuaauauggaguuaguuuauuuugcucuuguguugggaugugauagggagcugagugcuugcccuaguuaccucuucacauuauaaauaguaauauucauuagaaaauguuuauuaugaccugaaauuuuauuuguucuucguacaaauaggaaaguaauauuuguuauauaaaguugaaaaacaguuguuugggaagcuguagcuuuuaggcuggguagauuauuuauauacuuuuuacauuugucuuuuuacuuuccccccacaguaacagugaaugauguaaagcauaugauaucacuuccuauggauuuuuaucuaaagauacagaaucuuguacuaccuuuuuugugggguagcacaagauuugagacagggucucacucugucacccaggcaggagugcaaguggcauggucauagcucacugcagccuugaccucacggacucaagugauccucccaccucagucuccugaguagcugagaccacaggcacccaccaccaugccugccuaaauuuaaaauuauuuguagagauggaaucucaccauguugcccaggcuggucuugaacuucugagcucaaaugauucuccucagccuaccaaaguucugggauuacaggcgugagccacugcgccaggccaggaaaccuaucuuauucugcugaaauaagcaguguugaaaauucacaaacugguuaauguaacucuggaaaccacaauaauugugaaaaaugugaauuguaaaauaguuuguaacauuucaagcuguggguuugugcauguuaucuaaagauugauacuaaauaauaauaauaucaaauuuuaacuccagcucagucucuccccuacacacuagauauacauauccaacuauauuccugcagaggaaaccaauaccugccuucccacccaguccccauaggcagggaggguacuuuaaaaaauaucuauuuaccuggaagagaguaauuaaugcucuuaguuucuaagugagcacauaguggcuuggcauagcucauuggugaaugauauagacugguaucauccugguaaacuuggaccuuuuagauuaaacuauaugaaauuaucauuuuuauaagucaaaaauugucuaccuaauguaucuguuuaaugauacuaaguucaggcacaggaagucaaaacauccuggagaugaaaaagaacuuaaagaucucauucugcuucccucuaauugcugaccucuuuggaacauagggugcuacuuacuauacauaguuauuuaucuccugauaaguucuuauauaaucccuggaauuuaaagauuuuauuuaaaauuugcuggcuuugguugccugauuuagggguaucccacuguccugguuacccucaucuggaucuauuucagauuagguaucauuuuaaaaacauuaugccuaucaacauaauauucucaguggucugaacuaaucuacaggaaguguuaguucuguaaacucagugcuuuuaaaaugaaacccaaaauguuugcuucuuuagcagcugcaucacaugcacuguuaccuuguuuuguuuuuuguuucuuucuuuuucuuuuccccuuugagugaaugguugucaagcccuuuuaaacagacucugacuagaaaugccuacuauccugauuauuggacuaggaguuaggagagaccuaguuucuagucuuugauccauguuugauuuguugugugacgcuggaaaacucuugcaccuggcaucuucguaacacagacaauggaaaguuauauacaaugauagaaaaagaguuucaugugcaucgaaugaaaagccaaaaguaauggaacugacucacaacucucuaaauaugacaagacauauaugcaaauaugugucaauaaaaacuuggggcccauuuucagcauauguuauaauuuaaaugacuaggcugggcacaguggcucaugccuguaauuccagcaauuugggaggccgagacaggcagaucaccugaggucaggcauucaagaccagccuugcuaacacggugaaaccccgucuccacaaaaaauuuaaaaauuagccaggcgucguggcgcaugccuguaaucccagcuacuccggagucugaggcaugagaaucgcuugaacccaggagacagagguugcagugggccaagauugugccacugcacuucagccugggcaauagagugagacuuuuuuuuauuuaauaaaaaaaaauaauuuuaggcagggcgcguuggcucacgccuauaaucccagcacuuugggaggcugaggucggcgaaucaccugaggccggggguucgagaccagccugaccaacauggagaaaccccaucucuacuaaacauacaaaaauuagccaggugugguggcacaugccuguaaucccagcuacucgggaggcugaggcaggagaauugcuugaacccaggaggcagagguugcggugagccaagaucaugccauugcacuccagccugggcaacaagagugaaacuaugucucaaaaaaaauuaauaauuuaaaugacuauagaaauuaacacuggaaagccccaaagacucauccuuggaccucuucccuucucaguuuauacuuucucccuagaugaacucauuuaucucauagguuuaaauaucauguauugguguuugauucucauauuuuauccagcucaaaucugucuccuauauacuagauucauauauacaacugccugcugaguccuuucacuugaauguuuuauagauaucucuuuuuauuuuauucuauuuuuuuuuaagagacagggucuugcuuuguuguccaggcuggaguguaguggcacaaucauggcuuacuguagccucgaacucuugggcucaggcagucuucccaccucagccuccccaguaacuaggacuacagauguguaccaucacaucuggcuaauuuuuuaaaauuuuuuuguagagauaggggucucacuuuguugccuaggcuggucucaaacuccuggccucaagcaauccuccucccaaagugcugggauuacagacaugagccauggcacccagcccauagacaucucaaaccucccauguauuaaaaacugaacuccucaguuccaaccuuacccaucuucagucuauucucaacacuacagccaaauguauucuuuuaaaauaagucaugucauaucauuucacugccuaaaaccuuccaguggcuucccaaucucacucuuagguaaagccuaaaguucuuacaauggccuacauuucuguucaccucucuacuuccccaaaccuccucccuccccgagauguucauuucacucuggccuuacuagccuccuacuguuauuuugaaacacgccaugcacucuccugcuucgagaccuuuguaccuguucccucuacuuggaaugcucuuuuuccagauacaugcauugcuggcuaccuuaccuccuucaguucuucaccaaaaauuaucaacuucucacugaauccuauccuggcuacucuuuuaaauuguacccagcauggugacuauaguuacaacaauguguuguauucuagaaaauugcuaagacaacagauuuuaaguguucucaccacaaagaaaugauagggauaugagauaaugcauauguuaauuaucucuguugagccauuccacaauguguacauaucucaaaacaucauguuauacacauaaauauauacaauuuuugucaauuaaaaauuaauucauuaaaaguaaauaugauacagaacuccacccaacauucucugucaaauuuuccuccuuuauuuuucuucauagcacuuaucauauaacauauauaugauaauauauaucauauauauuauguugcuaauauguuuugcuaauauaucauauauaugauaauauauaucauauauauuauguugcuaauauguugcuaauauguuuuggucuuuuccuuucuauuuaaaugcaggauccaugagaacagagauuuuuuuuuuuucuguuuuacauugcucuauucccagcacuuagaacuguguuugacacagaagagguacucaauaaauaaauauuggugaaagguguucagagacguuauacuuuuauacccuuguugaggucccuaauauacucaguguguaugaacaacaaaagcagguuuaugagauuucaaaaaaagauacuuuccuguccaaagugcuuguuuugcugaagauacucagaggcuuacauaggcucuagccucgucucccuuccuaaggcuccuaguacuaaguuuugccaugcuuucauuuaggaaccucugccagcuuuucucaaccagggauccucaucugaaucacagaacacagaaaaugauuuuauagacuuuucuuaauuuuccaaaagaugauacauaacuaguacuuuccagaugcguaggagagaaguuaauucauuauguacaauggaugcuucaaggcauuaggacuuaauuucuagcagaacccagguugaaaaacgcugcauuaauccacgaaacuauuuuauaagaagcaaacuucuaaaaaacucuuccccuaaggaaaaaaaccucauaaaaacaaaugaacagaagagacuucuuuuuuaaucagaccguucucagugauauauuucugaauaagcugucuuugcaaugaguuacuugguuaaggaugaggaaagaagacagaagucccuucuucacgauugguucuuuuuguucccaaacucuacaauucuuauaaaguuugagauauuuucagauuuuuccaaacaacaaaauuuuguguuuguauuugggaugcuagcauagcuuuuuacacauuuccagaguguuacucaucagugaagucugcuauaacccgacacacaggucccuacuguuauuuccauuaccaaaugaauagguuaggcccaagaggaauugccugacauaaaauagucuaauaggacuaauucagucaggguucugacugcugcuucuccuagcaguaacucacaguaucacagcugcugagagguaaagcuuaaucaggcuugaaucauaaaauguguauacauguucugugagauagauuguggauucuugauucaucaugcugucuuuugauuuuggaaaauaaugaaacaagauaacaucccauaguaaaguuauauuguacuucauacuacuuuucuacguagaaacugaacccuuuugguuaucaucucauuuauucguaagauuuuuccggugguaguugggggaaagagagagcaugaggaaagagggaaucuguuacaguuuacaguuggauaaauugaaaauuggucacuuaaccacuuaggguugaagcuagaucuaggaucucaggacuacuuuaguagguuauugguuguucuuguuuauuuaaauuaugacucugggcuuuagaguaugcugacaauuacaaauauuuuagaaacucuguucaaguguguuuguacauacguguuggguuucucuaaauuuuccuaggaacaguccuuaauacuaucucaacugucaucaugaguuuguuacucuguggcagaaaugaguacggauucaaagaauaaaugaguaaauuuauuuauucauuuauuuauaauucauucauuuauaauucagcaauaaccuuuccacuguguuugcagaacuaauaauauauucucuuggucuggaucugucagccaugucguauccacauaguaguacaaucuagacaacugauauuuuugguucuuaccugauagcagguccguauaaagggcucuuugaggccgggcaugguggcucaagccuguaaucccagcacuuugggaggucaaggugggcggaucaccugaggucaggaguucaagaccagccugcccagcauggcgaaaccccgucucuacuaaaaaggcaaaaauuagccaggcaccguggugggcuccuguaaucccagcuacuaaggaggcugaggcaggauaauugcuugaacccaggaggcggagguugcagugagcugagaucgugcuacugugcuccagccuaggugacagaguaagacccuggcucaaaaaaaaaaaaagggaucuuugaaaacaaauacauuuuggcucaaagaaaaacauugguugaauuaacuguaacuacuugacuccuguuaagaaaguaaaacacuguuuuuuccagguuuuagaauagagaagugguguaaagauuuuuuucuuugaguugguguggggaaaugguaaagccagaaauuggaaugcuucucuuaaggggaaauuuucaaauuuuguuuugcuuuuugguuuucuucugacucauucuuagaaacuaaagaggcauaggaagggcaaucucuucuggguagaguuaggacuccagucucaaccucucaaaucacugccagccaaccaccugcuguuuggguagauuaguaggagaugauggagguauaaaaaaagauaaacugcuaaaugauuauguauguauaucauucuuuucccauucaaaaucuuaaagcugaguaagaacccuuaaagauguuauaucuggaacugaauuuaaaauaugugcuaaaguggguaauaucagguaucauuuauugagugcuuaauuacuguaugccaagcauugcaguaaacacuuuacauacauuaucuuacuuaaucugcuuaacaacuugacucugacaagucauguucuccuauuauauagucuuaugacauccugauuucugcuuuauagcacacauuacagauguauuuuuuaaagcucuaaauaauuaauuuuguaacuaguuauuucuuuuuugacucacugacuagacugaaaacuccaugaagauaaggaccaucuauaucuguccuguauuuccagcaccuaggcuaugccuaguacauaauagaugcauaacuaaaauuugaauaaacaccugagugugugaaugacugaauacgugaauaaauuaacaacucuuucaaacggaucagcuccacuuuauacacccaaaaacagagacugagacuuaaaccaaagacugacuccagaacacaugaccgcuauauuuaaauggccauugggaagcauaaaaaucaucaugacucugaaaaagaauuugagauuucaggauauucugaauaugaacacuuucuucaaaaguaauuuuccauaaaucuggaucgggauuagagauggcuguuaucuuuuuaucucucaggugguagaagcaugguuccccuaagccucugauuuauuagguauuucugaauauugauuaguaaaacagaugacuucccagaaagcugugucuggguucuguugccaaaaguacuuugagcuuucacucacccuaggagagggaaccacaaacuuuuuguacagauuagcuccuuucaagaacaaaagucucuuuggggauuuacuaauucccucaccuccccuggugcccauguucauuccuguugccucguguuaggacuuugcuccagcuccaaaagagauucugaagccccugcugcccaaaugguuuguagugccaugccugauuaacugggcaaggucagacuugccuuuuacagcccucgcagagguagacccuuugcuaagaaaucucagaaaugccuuaauucucugcauauaaguagaucagagcaucguagaccguaggcacucugagcuuucacaguuuucuacccuuaaaagugauggcaguacuuauuccauugagagauacaaagcguuuucuagagaguguuucuuaaccccccaaaaaacuuggggguuaagaacuaucuucagaagcucaaacacaaaucagggaaggacacugcuucaaauaaucuagcaaaugguuaguaacuacagaauccuaugaagacuaaaaagaccccagcuaagcaugugaauaguaguagcagcagcugccuguuaaccacgauaaaaaguuuuaggccuuucacacucuaguauauguugcuaaauggauuaguuaucagagcauuuuauuguaccaaaggaggauuuauucacuucuuugggagucuaaaaugccuaacgccagaccuacugaggccagcaagaagggagagcacauugaauacuucauugucaaugucuaauugggucugcaggcacaauucagccucaucagaguccgucuuaaaaaagaaagcucuguuaggucagacaaauacuuuuugugugguucuuaauuacuuucccauggauuccuuguuuucuaggucuuaucuguucaguaauuguacuaaaacacaaauuauaucaaacauuuaagcagcacacagagcagaguaguuagaaucccaaaaacccauauguuaaugaccacgaucuugcauuaggaacuuuaaccuaaugcuaccaugguguaaccuuuucuuuuugcguauucaaggaccucugcguguucugaagauaaaguuagcccuacauuucaaguuaaggcuauccaggaagaaugucuuuggcaaucucuuucagcuucccucuucuggcauguguauagccugcagguacuuaacagagguaaaaaaauuuauauggugcuagguggcuagagaagcuucaguuugcuccaugguuuggaauuuuagaggaagcauuuuuuuuuuuccgaguguuuuuuauucugucauuccagcggcuucauauacagauagcucugaugaugagacaucgcccagggacaagcagcaaaagaacucuaagggaagcagugacuucuguguuaagaacaucaaacaggcagaguuuggacgaagagaaauugaaauugcugaacaagguaaagaaaacaagcaccuuuuccuucuuaaccuaccugugucuuuuuguccauauuaaucccuuuuuaugucuggggucugguagcuugugaaauuucuaugugauaagaauacuuauaacaaaagaaaugugaguucaagaaacacuggggaaaucuggcaagucuagaaggaacccuguauuaaaaaaaaaaaaaaaaaagggagagagacuggauaaggacuggaauauagagaaucagaacccuggagcauuugccuccaaaagcccuuuauaaaggaaaauacagguuuaaugucuugaucccuggagaaaccuaaucuaaccugaucaggggaaggaucuuaacuuaagaaaacaaguuuuucuguuuguucuuuuaucucuuauuccuucuucuuuaauauugcuguauuuauugggccuuuucagaaaugccugcauugauggcuuugaggaagagagcucaaggagaaaagccuuuggcuggagccaaaaucguggguugcacacacaucacugcucagacugcugugaguucuuuucuuuucuccuuuuaauuacaauaguuaauaauagccacgagcuacugaaagcuuacaacaugccaagcaccgaguuaagagcuuaacaaguauuagcuuauuaauccuuauaauggccauauaaagcagguauucuuguuuccauuuuauaaacgaagaagcugaggcucagagggcuuaagauauuuguuuaagguuauacagcuagaaaucacagagucaagauuuuaacuucaauauacaguagucccccugccuugucugugggggauaaguuucaagaccccuaguggacaccugaaacuucagacaguacugaacccuauauauacuauguuuuuuccuauacauauauaccuauaaucaaguuuaauuuaugcaauuggcccugcauguccaccaguucugcuuccugaggauuugaccaacugcagaucaaaaauauucagaaaauaaaauaauacaacaauacaaaauaacaagaaauauaacaacuauuuacauagcauuuacacuguauuggguacuauaaauaaccuagagaugcuuuaaaauauacagaaggaugugcacagauuauaugcaaacacugcaucauuuuauauaagggacaugagcauccucagauuuugguauccaugggagugcuggaauaaauccccugaggauacugagagacagcuauaaauucagcacaguaagaaaugaacaacaguaacucaaaauaaaagagagcaauuacaacaacagacuguaauaaaaguuaugucacauaaaggaauuuaucacaguacauagcagaaaguccaaagggaaggcagacuucagaugcaggaucucagggcuccagcuucaccucucugauucucuuggagcugccuccucaguaugcuuacuucacccuaaagcugauagcaagaugcuuacaacuauucuagucaucacaaacugacaugaaaaggaagagggaccauuucuuccucacucaagagaagucccuccaggauacuccaucgugucucauugggcagaacuggaucauguaucugugcuccaccaguccuaccgaggggcguggaauuaccaugauuugcuuacaccagugauuccuaccuuacucucaucaguuuuaauguccccuuuuuauuaaaaaacuuuuuuuuugcagugucccugaacuauccugaaaugaaauucagauauaacauguccagguacauauaaucuuuaaaaauaaaucaauauaaaaucuuaacugaaauaugaaggaggaauaaaaaaaguacaauacuuaaaauaauguguauuucaauauguaaauacuugaggacaacuauaguagaacaaucagauauuuguacuauuucacaguauuauuugaaauaguauuauuugaagacagaaauaaauguguuauugauuccagagcaucagagcagcauugccaugauuuucugaaauaguaaacaacuuuuuguaaucuucuaaacaauaagaacaacaaaaaguaugaguuuucucuucauuuacauagcuguuacauuccuggaaaaacuauuguuuuguauuaaaacuacaaaacuacuuuuugcuaauuuguaaaguggaauuagguucuaaacucagauaauuguagauagguuuuucacccaugggaacuuuuauugggacauuugaaaauuguaccagcugcaacacaguuuuuuguugagacacuuucaaaauguccagauuccugguccugcccacuaaaugccaauagcacuccccuuccaauuauuguggcaaccaaaaaugcccccacaauuuucuagaucuccucuuuuaucaccagagaugcaauauauauggaguugcuaaccauaaugagaccacuaucgggaaauuguuauauugagcaguggucuggaaucuuuuauggggauucauaagaucugggucaucuguguggcuagaucagcuuuccaaagauugucucucccaaagcacaacacuuauguggucacauuccugauuaagaacauuagagauuccucaagguacagacagcuucuauuagcaucuucacuaugaaacuuuucuggguuauguguucucugaggacaagaguacccugacugcucaaaauuaauauaauaaauugaaaagcuaucuguuuuggagcuacaaacuaaugaaucaagacagaaacacucuugaaucuuuuuuggccugcucagucagcgacaugagacuucagugugguagcuuaaaauaguaagugcuucucuacugucucauguugcugaauuacaucuaguuuguuuuuuacccuuaggcucagugagcauuaccaccuuucaugguucccuuucuauuuuuuuccugaauggauugaucacaauuagcuuaccaauuuuaauauuaauuuauuguuuccaccccacauuuuuuuccuuuaaaaaaauaacgacaaagaaauuaugcuuuguuugccaaccuaauacucuuucacucuugucuuaguucauuugggcugcuauaacaaaauaccuuagacuggguaauuaauaaacaauagauauuuauuguucacaguucuggaggcuaggaaguccaagaucaaggcgccagcagauucaguaucuggugagggccuguuccuuauagauggcgcuuucuaugugcccucacauggccaaaggggcaagcaagcuuccucaggcuuguuuuauaaguacacuaaucccauuugugagggcagaaaucucaugucuaaucaccuuccaaucacuuccauaaucaccuuuuaauaccaucgccuaggggguuaguuuuuaacauaugacucugggggaggagaacauacauucagaccauagcaauccccaaauacuuuaguguguauuuucuacaaagaaggacauuuuccuguacuagcaguauaaccaucagaaguagaaaauuaacauugauucauuauuaccauccaauccuuagaucccacuggaguuucgcuuguuguucugauaauauuuuucuaacaaaagaauccaguccaugguuauaugucacauuuaguugucaugucuuuuuaaucuucauuaguacagaacaguuucucagucuuucuuugauuuucaugaccuugacacuuuugaagauuacagaugaauuauuuuguagaauuuccucaauuuggauuuuucugaugcuuccucauuaugagauucaggcuauacaucuauggugggaauucagggaagugauauauccuaucaggugacacaugauuucaguuugucccagaacugaugauauucacuuuaaucccuugauugagguggugucucccaggauuuuccucuguaaaaguuuuuuucccaguuuauaauuaauauguuuuuugggcugggugugauggcucacgccuguaaucccagcacuuugggacgucaagguuggcagaucacuugaacccaggaguugaagacuagccuaggcaacaugguaaaaccccaucucuacaaaaaaauacaaaaguuagccaggugugguggcaugugccuguaguuccagcuacuugggaggcugaggugggaggauugauugagcccgaaaggucgagauugcagugagcagugagcugagauugcacugcacuccagccugggugacagagugagacccugucucaaaaauaaauaaaaauagaauuaauauguuuaugugagauaguacuaugaaacuguaaauaucucauucuuuaucuuacuuugauuuauucauuauuuuuauuuguauggaaucauuguuuccuauuuuauuuaauagguuauaauccauuacuaucauuacuuauuuacaugaucaucuuguucccaguuugaccagggagagccucuucaguguggcuucugugacuucuuuugucuuuugauauaucccuuucauucuuugaacauuuccuugcuuuugguacaagaucaccuaagcucaucuugaacauuccaugcccuacucuuggaaccagccauuucucccagaaugccuagcuccuuuuaguggaucugggcacuaaugugcucuuugcuuuugaaaugucauuguucccagauccucuuuuuucccucuccauacauguaacuggaguuccagaaggcaaagagggaaagaauccauagacucccauagaccccauagauuuugagcacuccguugugauuuuuuucugccagucuucuucuuuuuguauuucaguucaguaauuucuuuuuuuguuguuguuuuguuuuguugaguagggucucacugugucacccaggcuggagugcagugguacaaucauugcaggcucauugcagccucaaacuccugggcucaagcgauccuccugccccagccucccaaguaacugggacuacaggcauauaccacuaugccuggcuaauuuuuuuuaauuuuuuguagagaagagaucuugcugugaugcccaggcuggucucaaacuccuggccucaagcgaucuccugccucagccuuucaaagcgcuaggguuacaggcaugagucacugugccuggcucaguucaguaauuuuuauuggucuaucuucagguucacugauucuguccuuggaugugcccggucugaugauaaaccuguugaaggaacuuuuaaucugacuuuuuuuuuuuccuggcauuuguauuugacuuuuuuuuuuuuuuuuuuuuuuuugagacagaguuuugcucuuguugcccaggcuggagugcaacggugcaaucuuggcucaccacaaccuccaccuccugggaucaagcgauucuccugccucagccucccgaauaacugggauuaaaggcauguggcaccaagcagcuaauuuuguauuuuuaguagagaugggguuucuccauguuggucaggcuggucucaaacucccgaccccaggugaucugcccaccuuggccucccagagugcuggccuuuacaggccugagccacugcacccagccuguauuugacuuuuuauuguuuccaucucugcugaaauuuucuaucuauucauagauguugucuaucuuucucaacuagauccuuuaacauaaacauauuaguccagccugggcaauauagcaagauccuguguauaaaaaaauauaaauaaauaacauaaacauauuaaucauaguuauuuuauaucuccugucugaucaaacaucuggcucaucugagagccugccucuguuguuuacuuauuuccugacaguggguuuuuuuuuuuacuuuuuguauguccugacauuuuuaauugagugguaguauauuaguuuucguuauagucaugaauugggcugaauuuagaguucauuguauaucaacaaaggcuucaaauuccuccagcaguggacugcuauaaccuugugauuugagguuaccaaaggacauuccucagugcuucugcuuuacccucagccuucagcuacuucugcacaugugugccacagaaguguccucuuuucaaguaccugccucaucugccgcacuagacugcugcucuuuguuuccuggggcuaagcacacggugagggcaagugggguucuuggaucucuggugcagucucagucuuaggcagaccucugugaggggcaggguuuucucaauauuccugccucuccuaucuguagcagccaaacuuugccuugaaucuguggugggucuugggcaagacauauuuuccugcccuuccuggagagcuggagagguagcagauccuuacuuuguaucagugaacuguccugggcccaagagguuuuccugugccucucccagaggcagaguuuuugcuucugccuuccuccagacacaguggaucuuugccuagucccuaauggcaggcccaauuccugcucuuccuacagcuugaggcuuugguuccuaugagagaagaguguagggaagugcccagguuucaugucuguuucugagcacagccaaucagcucccugccccagucuuuguuuugagcacuggguggaagccucuggaaaacagccugcaugugaaugggaaaucuacuugugucuggagcuucaaaaaauuccacauugacacacuuucccacacccagccuuucguaauuguucaaaaguuuagcugauauuuucuuauucuuaucuguggcagccauuucuuccccccaugcacugccaaaggugaaacagucuucccucucucuuuaaaaggauuugucacucuuuggagggcaguucacuucugugcuuuaugaccucaaaucuuugaugggcucaagaaaaguuuggcuuuguagauuacccaguuuuugggguuuguguguguuuguguguuuauuuguucauuuauuuguuuguuuguuuuguucuguuuugagacggagucuugcucuguugcccaggcuggacugcaguggcacaaucucggcucacugcaagcucugccucccagguucacaccauucuccuggcucagccucccgaguagcugggacuacaggcgcccgcuaccacacccggcuaauuuuuuuuuguauuuuuaguagagaugggguuucaccguguuagccaggauggucucgaucuccugaccuugugaucugcccgccucggccucccaaagugcugggauuacaggcgugagccaccgcgccccgccauuuguuuguuuuugagacagagcuuugcucuuguugcccaggcuggagugcaauggugcaaucucagcucacugcaaucuucgccucaccguuucaagccauuguccugccucagccucccgaguagcugggauuacaggcaugcgccaccaugccuggguaauuuuucuguauuuuuaguagagauaggguuucaccauguuggccaggcuggucucaaacuccugaccucaggugauccgcccaccucagccucccaaagugggauuacagucgugagccaccguuccuggccguguguuugguuuuuuggagacagggucucacucuguuguccaggcuggagugcaguggcacagucaugacucacuacaaccuccaucucccaggcucaagcaguccucccaccucagccuuccuaguagcuacccagcuuuuuccugucguuaaggugggagcuucucuuguagcuuuguauguucuaagcagaagcagaacuguaaaucuguuuuuucagaaaaguuuuggcucugaaguccuugguuuauuaaaucuuauggggaagcuuaauuuaaauugguaaaaacauagagucagcuggagccucccucuucccauggcuucccccaauacuugccuucuuagaauacugaagagguucuguagagcccaauuugaaaaucacuggcuuaagucauucccguuguauuuucugauuguaaaauauauaaacuuuaucuccuugacuaguuguuuggcccaggcuugcucauacccugcuuugucuuuaauacaggugcuuauggaaacucugggugcucugggggcccagugccgaugggcugccugcaacaucuauuccacucucaaugaaguggcugcugcucuagcagaaagugguaagagcuuauucucugugccuuuggcuaaaguaagucuauuuggagacuuacuuuauguuucagcauaaaucuuuaaagaagguugacaauaaaagaacuaucuuggaagaaauggaucucgauucuucaugaauuugcucuuuuucuggccuucgcuugucaaauaugaucuaguuaacuuugcuauuuuacaguugacaaauaucuaccuaugucuaauauucuauuguuagguaaugcuuuguuuuaacucacuaauucacuaauagcagagcacuagugaacacuacucacugagguaacauggauuaaaggagaaaaugcuucagccauaguuuugugacucuguugguuuuccagcaaguaauuugcccugacuuaauguuugguguuucugcuucaggaguaaagaagacuugaccuggcagauuaauauuugaucacaacauccacugguacuugauggacaaaagaaauagagaaauuuggacuuugccagccucuugccuuuacucuuuggcaguacagcuagcacucucagcauuucauuuguucuuucauuuuaauuuacuuauuuauaagauuuuauggcuguauauaugauagaaaaauauuuaauacuuuauuaauacaaauauuaaauguguaccccagugaauuguacauacgcauucauuucuuuuccuuuuuuuaaaaguagaaacggagucuugcugggucacccaggcuggggugcaguagugcagucguguuucacugcauccuucaauuccuaggaacaggugauccucccacuucagucuucugaguagcugggacuucaggcaugugccaccaugcccagcuaauuuaaaaaaaauguuugaagacacagggucuugcuguguugcucaggcuggucucaaacagccagccucaagugauccuccugccucauccucccaaagugcugggauuacaggugugagccaccaugcccagcccauuucuuuuuucuguuuuuuuuuuuaaauuuaauuuaauuuuuauuuuuuauuuuuauuuuuauuuuuauuuauuuauuuuuuuugagaugaagucucacucugucgcccaggcuggagugcaguggcaugaucucggcucacugaaaccucugccucccagguucaagcgauucuccugccucagccuccugaguagcugggauuacaggugcccuccacuauacccggcuaauuuuuguauuuuuaguagagacgggguuucaccauguuagucaggcuggucucgaacuccugaccucagaugaucugccugccucggccucccaaagugcugggauuacaggugugagccaccgcacccggcugccccauuuuuuuuuuuaaacaaaugcuuacugaccuacgcuaagagcuguaagggcaaaugagacaauguccuuacccucagaaucuuauauuuuggugagauaauacacauauauaaauaaugaugauacaaggacauauauaauaaaugccaugacagauuauaaauccauauucacuacacaaacaagaggcuuaggaaaguucagauucccacuuugggaagcugaggcagguggaucaccugaggucaggaauucaagaccagcguggccaacauggugaaacccugucuuuacuaagaguacaaaaauuagcugagugugguggugcaggccuguaauccuagcuacucaugaggcugaggcaggagaaucgcuugaacccaggaggcggaggcugcagugagccgagaucgcgccacugcacucuagccugggugacagagugagacuccaucucaaaaaaaaaaaaaaaaaaaaaaagaggccaggcgcgguggcucacaccuguaaucccagcacuuugggagccugaggugggcggaucaugaggucagaaguucgagaccagccuggccaauauggugaaaccccgucuuuacuaaaaguacaaaaauuagcugggcguggugccacgcaccuguagucccagcuacucaggaggcuaaggcaggagaaucgcuugaacccaggaggcagagguugcagugagccgagauuaugccacugcacuccagccugggugacagagcaagacuccgucucaaaaaaaaaaaagaaaagaaaaguuaagauuccuugagagcucauuuccagcuggguuaaucagacuucauuaggaacaugacacuuaacugggcuaugaauucuaguaacguuuuagcaaguggagaaacacguaaggguuuuuuucuuaauaauaggguggaaugauuaaaguauagaagcaagaaaaauuaaaguguaauugggaaauggugagaaugccaguuugaguggaucaagaaguaccuguuucugguuuuuguuuucccuuuagucacuuuuuuuuuuuuuuuuuuuugagacagagucacgcccugucgcccaggcuggagugcaguggcacgaucuuggcucacugcaaccuccaccucccagguucaagcaauucuccugccucaggcucccaaguagcugagauuacaggcaugcaccaccacgcccaacuaauuuuuguauuuuuaguagaaacagguuucaucauguuggccaggcuggccuugaacuccuaaccucaggugauccacccaccucagccucccaaggugcugggauuucaggagugagccaccgcaccuggcccccuuucauuacauuuuaaacaacugucauacuuuuguccauucugcuuguccuccuugggcuaauaagagcagaaugaccaacaaagacaaaggaauggauaaaggggcugaaggcaacgccaaucagugaagaaugucaauccaaggaguauagcagaaugagagaguuggaaauuaggaaaaaccagaaucuucucacuaaaauuagggggucagccuuuuuuggucuuuaaugguuucccuuuguuccuuuuuuucccaggauuuccuguuuuugccuggaagggagagucagaagaugacuuuuggugguguaucgauagaugugugaauguggagggcuggcagccaaacauggugggucagauuucugcuaacacaauucuguaggggucaggaauggggauggguggagguuauggccuaggagaggguuucccaacaagaaggaaggaaaauggcuucauuucuaucugauauaccuggguuuccagcagaacuagauucuuaugcuacggguaccccaagaguauugaagcucuuauaaccucagagugccuuaauuauugguucuaauguuggaagcauuuauauucauuagaaacauuaaagcacugcccaggauucacauguggcugguuaaaaaacaauaguaaugaguuuccauccccugcuacugccuacuucccaccccuuacaacaaccaaaaaacccaaacaaaccaccccagaacucuggagauacuuagccuucucucuagaauccauauacuuguaauguuagucaggacuagaaaaaaaauaaaaauaauauucauauaaugaauuuauaguaaaccugaagagcuuacaaguucaaauuucuucucuuuauauucuuuccccacauuaaaaaagacgagaugaaguuuuaggguuuuaauuuuugcuucauuuuuauuuuuguuuuauuuuuuagaagaucaagucuugaagccucauagcacauuagauuugcaaagaggcaaaaagcuacacaaagggccaggugugguggccuguaaucccagcacuuugggagcccaaggcagguggauuacuucagcccaggaguucgagaccagccugggcaacauaggcuuucuacaaaaaauacaaaaauuagcaggauguguuggcaugcaccuguaguaguagucccagcuacuuaggaggcugggacuccuaagugggaggaucacuugagcccaggagguggagguugcagugagccgagaucacaccacugcaguccagccugggugagagagugaaaccaugcccccaucccagugcccccccccaaaaaagcuacacaaaguauaaggugcuccuauuuugcaaauaauucugcccucuccccuagggggagggggcagaaauuagggaauguacugagaaaagaaucccugaagcucuaguccaaccauugcuugcugcugaaggcugcagagcaggccucacuuggugcauggcagagaaguagcuucuuucugaauucugugauccaggucacacugcaccaggcuuguuugaggaagcuggguuagagcuucauauccuaaaggggugggggagcagaguugacaguggcuguaagaugagucagcucauuccaacaguuuuaauagugacacaagggagugugacugacagaugcugaagcagauaugccaggggguuucuccugggaauaaaacauugauuuuuaaagucaggaacccagggaggacauuaggauuauaccuggagaacuuuuacaaacuguagaaccagcacaaacugcuaggaagguuaauaaagagaguaagacaaggacaaaaacaguugucaccccagaaaacaggacccauaccuguuuggauucugucaagauuuaguacuucuccuugcuucccaaccucuggaagauuuccugaugacaauaauuuucugcaguagauuuauauggugagaauuaugggcagcauucauuaaguaaaucuuagagacagcaacuacugucucuaguggauaagaauagugaaacuuacaacacagaguuuccaguuguucaaucucucuugucucuuaucuuuucuguggaagggaaaacuucaucagggauuccauacauggagaaugggagagagaaacucagaagagcuuuuugcuuucuuggggcaucuguucuggggguuucuacuuguaguauggagcaaguacaagagcuuugaugagaguccuaacuuggauccugguucucaagcaagguuugagugagagaaaauaggucaacagcaagagcaaaagcaaaaaagagaucaggugguagacaugagguuggggauuuuguguacucugggguccagaauggcaguuuuggcacuuauaguagaguugauaauugaugagacugcaagaugggugcaugucagcagagggcaacccaguucugugggacuuuccaggaggauggguauaacaauuugcagaguccugcuaaacacuucugacagccuagggaaggacugaagugucacagccucgugccuaacaauguucuaagcugguuuuucuuuaguuuuauaauucaaaagcuuuucucugcugaugaaagcuccagugggcacagcguuguguuuaucuuuaaucccaaccugaaauagugauagaugagcuguucagaggcaugcuugcacaccuacaugcugcacgguucccugguuauuuuuaauuugguuuguacagagugugagguugugcuaggcaaaacccuacagugcugccugauauuuugggugggagagugccuauacuuugggagaagaaaaggauuaaggaauacaguuuuauaaaccauuguucugacagggagacuuaauuaucugaccauuuauugauuuauuuuucuuuuuuuucucaagaggcuguguaaacugaggcuguuuauuuaaacuaagucuugacugaauauauuuaaagucccuuuaggcuuucugaauaccuauaguagauucaagaucuaguggccuaguaacuacaaguuaccaauccauaagaaaauccucgguuaguugcuguauauuuugauacaguagauaugucacggggagggucguuuggcugcgcgaauuacaauuggccuuucuccucucauugucuuuuacuucaauauaaugacuauuuggcagauuauuguauuuacucuggcuuuaaguuacuuugcauaaccauaugggaaauuuuaaauaucuguaaauugcuaauuagauugggaugcaagacccagagaagcacugaagccuugagacuucagcaaagugaaugauguuauugaugcuuacuauugcagaucuuggaugauggaggggaucuuacccacuggauuuauaaaaaguaucccaacauguuuaagaaaaucaagggcauaguagaggagaguguuacuggaguucacagguaagauuugacaugggcauaccugguuuuaugcagucuagacauaaaaucuuauaaacacauaccuauaaaacacauguuaaaaauuggagccugggccaggcgcgguggcucacgccuguaaucccagcacuuugggaggcugaggugggcggaucacgaggucaggagaucaagaccauccuggcuaacacggugaaaccccgucucuacuaaaaauacaaaaaaauuagccugguguggugggcgccuguggucccagcuacucgggaggcugagggaggagaauggcaugaacccaggaggcggagcuugcagugagcagagaucaugccacugcacuccagccugggugacagagcgagacuccaucucaaaaaaaaaaaaaaaaaaaaaaaaaaaaaaauuggagccugcuaugagguaaccacaucucagcuugcuaugaggugaccagaucucagcuugcuaugaggugagcagaucucucuuguuuuuuuuuuuuaauuaacaacacaaauaaugaaccuaaaauagugagaagggggcaggugggagaacaagugaaguccucauguuuucuagugauuguaaacaauuaacuuguccuuuuuggacacauauauucauucauucauucaacaaauauuuauugaacuucuacaaugaaugaggaacugcucuagaugcuaggaaucuagcaguagacaaaacagacagaaaaaaacucugccaucuuagagcuuacauucuuacauggagagcaaggauguaggguucugcuucucaaaugaguaauaauucucugaguaaaauuggaauuauuucaguucaauuucugugaucauuucuaugauuuauuucacccauaaagaacuaaaaguaugaaaaaaaaaaguuguagggaaguaaauucugaaccagccaccaucacugcuucaauacauuaucaucuuuuugaauguacaaaacugaggucaggaguucaagaccagccuggccaacguggugaaaccccgucucuacuaaaaauacaaaaauuagcugagugugguggcgggcgccuauaaucccagcuacucaggagucugaagcacaaaaaucgcuugaacccuggaggcagagguugcaguaagcugagaucacaccauugcucuccagcggggacaacaagagugagacuccaucucaaaacaaacaaacaaacaauaaaagcacaaacagccaggcguagucucaugcacuuguaguucuggcaggcagggagaccagugcagauuuagugaacauuguaccuaguagguaauuuuucaaccuucaacccgcucccacucucccacuuuuuauagucuccagugaaggccuuaaaauuuagaggugggucaaggauuucccccacaugacuuuugaauaaaaucuuuauugugaagcuauauaugcaggcucuagaaagauauucuuuauuucucaguggccaccuaacaggaugaaacuagucaugucucauggucucaugccuacccaaucaacguauuucuggggccuccuaugaaagcaaugguagauuguaauguccugguguuuuuuguucuuggcuucccucauccucaggcuguaccaacuguccaaagcugggaagcuguguguuccagccaugaaugucaaugacucagucaccaaacagaaauuugacaaccucuacuguugccgugaaucaauucuugauggguaauguuuauuaucuuugagaugaaguugugauguccaguugagauucuaaguuuuuuggcuuugguuauuucuggaaaggauucauguagcaccucuggauaaugucuccauaaagccagagcuuugucaccucauaaauuaaaauuacauuauuuuuauuuucuccuuuguaucuuuucuauuucuaaauauuauauuuucaaaauauuaucuaauaaauguauguugcuuuuauguuuaaaaguuacuguguuaucuacaucuucuuccuuucugcaccacuugcaagaaaggggaaaaaaaaaggaaaaaaacccuuacauauaggauugguuagauggcagggagugagaaaauauguauuuuauuuaaccuuccugucuggucauuaguuucucuaggauagaaaccagacuuucaguguuacaggucuuuuagaauuugucuagcagguuuucuggucuuuaccagaaaaccccuuuaaaaaaauaaagaaaccagacuuucuuucaaaaugaaaaaccaaccaaaaaaccccaugaaaacaaagagauucaaucuaaccucaagggagaaacaagagaagauuuuucugauuuaauguuuuuuuuuccccuagacuuaaaaggacaacagacaugauguuugguggaaagcaagugguagucuguggcuauggagaggugaaguuuaaccuuuuguuuauuagguguuuuaaauggauuuuguugaaauauucuggaauuuuuuauuuguauggacauaugaguacacccuuuaccacuuuagaugagaaaaagaauuucagaggccuucugguugaaguagacuuucuuuuucccuuugcguugccgccauuuucccuuaaguugauuuucugacuugcuccaguaccaccguuugugauguucuuuuuagcuuguguuuuaauuaugaaucgugaguguggguguucuugugcacaugaaugcgauaagcaggagccagggguuuguuuaugagcugcauucaauuauuuguucuucucguuuuccccaaguaugaaucuauucagugaaauuccucucggggguggaaagagggggugcacuuuaccagaagcuuugagaaaugguuuucucagugacuuuccuuaauaugugugcucucuccccucuucagguggggaaagggugcugugcugcccugaaagccaugggcuccauuguguauguaacugaaauugaccccaucugugcccugcaagccugguaagccucuacgcuaccaucucacuugcaaucucggagcugucuccaaagaauggccugguugaugccacacuuuauuuuagaggagcccagauccucagagaugcugccacuaacucuaagcaucugucuuuuaaaaaggucaaggagcucugcuuggagagagcagagacuaucagaaaagcgaaaauuuagaaauccuguggagauaguaacagggauucugucagccagagaacagguagccccuuaccuucuccauguaugauacuugccuuucaaauaaugaucagaaaagaaauuggcaggcaucagaugccuucugauguguuacacugaaaauagcccuucugugguauuccucccaaaaauguauaaccugaaucuaauugugaggaaacauuagaccaaucccaguuaaggguaaaaucuacuaacucugagugaagcauauaugagaauuauuuacacuaguauuauaauucuuaaguuugaaaugauucuaaaauuaaaaguuaaaacuuuucuuaucuauaaaauguguguaaucauaccuaccucauaggauugugagaguucaguaaaauaauaauuagcauaggcuggguguaauggguucaugccuguaaucccagcacuuugggaggcugaggcaggaggauugcuugcgcccaggaguucgagaccagccuuggcaacauagggagaccccaucucuacaaauaauuuuuuuaaauuagcugggugugguggugcaugccuguggucccagcuacuugggaggcugaaguaugaguaucaccuaagccugggagguggaggcugcagugaguugugauuaugccacuacgcuccagccugggugacccagcaagaccaugucucaaaauaauuauuauucuauauuauacauuauauaacaaauacauaauuauauaagguacagagcugcugccacauaauauaugcucauuaaauaauagcuguuauuaaaauugucucuugccauccucagcagggugggaaauaccacuguucuuaaaaacuauugcagaguccaagugucuguagccuaggggaaccaucauccuucugguacacuaagaguuuaggaaccugaacauauuuuaauacaaauugauacuguucagauacugaacaguucagauuauccuguucagauuauccuguagacacgaauugaucacuuacuaugcauuagauacugugcuaugugcugagaaugaauaagaugaauauauaaaugagauaagguccugcuuuuagaagcacacagacagauaaccacugugcagcaaaguaagugcugucauggaguuaaacggcacaugcuucuguaggagcauaaaggagaaauugcuuacugaagagcaagggagcaggguagaaagagaugucagcagagcugagucuugacauuuguauagguguuuucuuaguuuggaaguauauuccagguacugggaacauguguguugucuccaaggaaggagauagcauggcagauuuaagaagcuagaaauauuuuaauguaguuggcagaugaaauacauuugggggagugguacuaucuaagguaggagucaugggagucauaugucaauauaaucacauaucacuguaaguauuugggucuuacucuuauccugucuuauccuuaagaacaggcagucucacugaaguauuuuaaggaaaggaagcgacaugauccaaauugcauuuaggaaaaucacucugccaaaugauuuagaaagauguaaaccuagaggcaaugagauugggccagggguuacuauaguaaucuaggcaagaaguaauaagaccuaaacuuaagcaaggccaguauguauuagagaagaguagagagaugaaagagacguuuauggaauuaaagaaaaagagucacccagauuuggugacaacuucaauucaggagaggcagcaaggacauucuuguuuauauggcucauucaguuggaugaacagugaugcuauugaucaagauagaaaauauagaagaagaaauagaugagauuaugggugcagagaaaauaauaaguuuauuuucaaacacaguaaguuugagauccuucugggacauugaugaggugcuauccaguggcuaauuugauccuuggcuaugaagcuucagagagaucuaagcuaaaguuacaaauguaaaaaucagccaucuaucagcagucauuugcagccaaaggaagaguaugguucucuauacugaaagaauagagaaaagaauaaaggcauaacccugcagagcaccaauauccaaagguuggcugaaguugaggagaggcaauuaagagaaguaagaggaaaaccaggagagauguaucauggaguccaagggguauagaguuuuaagaaggcaaauaauguuuaauguaguagaagaaaucaaauaauauaagagucuaagaaguugggcauggugguguaugccaauaguccuggcuacucaggaggcugaggcaggaggauugcuugaggccaagaguuagaggcuguagugcacuaugauuaugccugugacuagcuacugcacuccagccugggcagcauagugagaucccaucucuaaaaaaaaaaaaacacacacaguuaagagucuaagaaaucuuggguuuggccuucgggggaucacugaugaucuuggagagagcaguuucaaugggguaguugguuaaauggcuaaguggcacuuucuacaguuucuagaaauuuggucagggaaucucaugguagccccuggcucccuauuaucaggaagaaauaaguuccgugaugcaaacgaaccuuuuauuucugucuuguaugaacuaaggaaauuguuuggauuuuucacuucuaagaauaguucagcuaucucaagaaaugacagcaacuugauauuagcuuuugaaguccuguguuaaaaggcuccccagcugccuguuuagguuaaugggucaugcuuuauuucaacaguauggauggauuucgacuggugaaauuaaaugaggucauccgacaaguggacauuguuauuaccuguacagguaugauaaugacauuuuaaaugggguggcacuugggaauguuuuuauggagcaggugcaagaugauuggaaauauucugaaaaaccaaacucuaaaagcuagagagagauaguagcccacaaagccagccagucuuucacauucuuccuaauucuuuagagcuccgaccaaagguauacgauuagguuauuccuauguaaaaauguuucucuucacccuugaagacaacuguuauaucuccauucauccuaggagauagcuagagaugagauucacuuauaaaguuuuauuugggaagccagauauuuuuuuuuuccaaaaauauauuuauuuuuaaaaacagaaaaucagaucaguuuuauagagucaaauuuucaagagacaaaccagaguuuggauuccagcuuagagugcaagugaagcaucaguaaucucaugcagaagauuugucucugcaggagguacauucugcuugacugcaagcacucaauucucuaaaucugguuuguacuucugccaucauuuuauuccauuccagcgcucuggcaugcaagauaauccaucucuaaaauucaagacuuccaaauugagaugaacgauuauugggcuuggguugggguuuauaaccaauccgaucauugaucauuuguucccggcucuugggaucacugcuaagcccaauggcuccuucuccaucacugccuccuacaacuuccacaucuuccuucuguuucuuacgggucuccagguccuuucgaauguucucaaacucuucaaugucaucaagcuuuagcucuaggcguguugguuuccgucucagcauacugaagucaacacuaagggccaaacccagugaacuauuagcaauucacaggauuauccucagcguccaaacagaucuuaaauguguacgucauucauuaaacaaacacuucuuguguuccagcuacagaguuaaaagguacagucauaaucucuuuucaagccgaccuagccccuuccccgggaagccagaucuuaaauguacacuugauuuuuuauuuuaccuccaaaagugauguauguuucucucuaguauguaauuaaggcaaggcuagagagaaauucuucauaguuagagaaaguagacgagguuauucuguuaauucccaaagagguagauuuugaguuuuaaagaauaugcagaaauggcuaguuuccucuaggguaagauacuuauuuuuauguggaaccauaaacuacaggaacacugguuuucuaauucuauuuuagagggggaaaucagacagaauaaaaaaaaauuguaguuguagccucaggaagaaauaggggcagagaagagggaccauaagaagcuguucuugguucauaucaauccccuggaucucuuuuguuguuuuaaauagagaugaggucucagucuccaggcuggucucaaacuccuggccucagcgugguucucccaccucugcuucccaaagugaugggauuauaggugugagccacccugcccagccuggaccuuuuuuuuuuuuuaauugcuuuuuugugaucuguaauucauucacugcacauuucacacauuuaaauuguucacuguuuuuuaguaauucacagaguuuguacaaccaucaccacaaucuaauguuuuuacugaguuguaauucacauuguaauguucacgcuuuuaaaguaugcaguucaauggcuuuuaguaaaguuguagaacaucccaauuaucgaauuuuuaucaccccaaaaagaaaccccauaucauuagcagucacuccuuauuccauccuccaucauccgccaggccuaggcaaccaccauuucccuauucuggacauuucauauaaauggaaucauagcaacaccugugaaaagaaggggaaaaaauaauaauuuuuuuuaaaaaggaaucauuuauggcugggcacgguggcucacgccuguaaucccagcacuucaagaggccaagauggguggaccaccugaggucaggaguucgagaccagccuggccaacauggugaaaccccgucucuacuaaaaauacaaaaaauuagccagaugugauggcaggugccuguagucucagcuacaggagugugaggcaggagaauugcuugaaccuggaagguggagguugcagugagccaagauugugccauugcacuccagccugggcaacaagagugaaacuccuucucaaaaaaaaaaaaaaaaggaaucauucaauaugauguuuucagggccuccccaugugauggcauauaucaguaccuuauuccuuuuuauugcugaguaauguaucauuguaugguuauacuguauuuuauuuacccauucauuaacugguagacauuuggguuguuuucacuuuuuggcuauuaggaauaaugcugcuaugaacauugaauacaaguuuuuauguggacauauuuuuucaguucccuuggguguauaguaagaguagaauugcuggaucauauaguaacuuuguuuuuaacauuuucaggcugggugugguggcucacaccuguaaucccagcacuuuggaaggccgaaguaggcagagcacuugagcccaggaguucagaccagccugggcaacauggcaaaacucugucucuaccaaaaaaaauacaaaacuuagcuggguguggucccagauacucgaggagcugaaguggagaaucacuugagugauuuaaaacaaaaaaacaacauuuuuaggaauugccaaacuuuuuuuuuuuuuuuucgagacacccaagcuggagugcaguggcgcgauacuggcucacugcaacuuccaccucccgugugcaagggauucuccugccucagccugccaaguagcugggacuacaggcgcacaccaccacacccggcuaauuuuuuguauuuuaguagagacaggguuucaccauguugcccaggcuggucucaaacuccugagcucaggcaauccaccccccucagccucccgaaguguuaggauuacagucaugagccacugcgccuggcuggaauugccaaacuuuuuaaaagugacugcaccauuuuacaauccaucaacaauacaugugccuucuaauuucuccauaucuucaccaacacuuguuauugucagucuuuuugauauugccauccuagugagcguagagugguaccucauugugguuuugauuuccauuuucccugaugacuaaugaugaugagcaucuuuucauguguuuauuggccauuuguacaucuucucugaagaaaugucgauucagauccuuuucuuuuuuuucuuuuggagacagggucucacucugucacccaggcuacaguguagugaugcagucacagcucacugcagccccgaccuauggggcucaaucaauccucccaccuuagccucccuaguagcugggacuacaggcacaugccaccacacccagcuuauuuuuguauuuuuuuuguagaaaugggacuuugccauguugcccaggcuggucucaaacuccagggcucaaguuauugauucugccucagccucccaaagugcugggauaacaggcaugagugagcaugccuggccugcuuuuuuuuuuuuuuugagaaagagucuugcucugucacccaggcuggagugugguggcacgaucucggcucacugcaagcuccaccucccggguucaugccauucuccugccucagccuccuaaguagcugggacuaaaggcacccgccaccacacccagcuaauuuuuuguauuuuuaguagagaugggguuucaccguguuagccaggaugguuucgaucuccugaccuugugauccgcccgucucagccuccgaaagugcuggaauuacaggcaugagccaccgcgccuggccuggccugcuuauuuuuaaguugucuucuucuuauuggguuguaagaauuccuuauaacaagucccucaucaguuauaugauuugcacauuuauuuucucauucuguggauuaucuuucuccacugcugcucagaccucucuucuguuuuuaagguaacaagaaugugguaaccagagagcacuuggaccguaugaagaauagcugcaucguuuguaacaugggacauuccaacacagagauugacgugguaagaucaaguagcucauuauugggggcuuuuuucucuccuucacaagaagcaaacuggaaaaugagagagcagggucacaagccauccuaaacaugacuauccuggcagaguuguccacaucuuuucacuuacuagcccuauagccuguguuuuuggagacuauaaaguuucuucaucucaauuuaauaauucuaaaugauugucaucuucuauucaagcucgaugccuguuuacaccauaagccuuaucuguauguuuaggauugagagcaagauaaacucaaaacuacaaugaaugauagaaacucagagcuaagugauacaaugaaugugaaucaguaugguagucaguauuuuggggguguuugguuuuaccauaaagaugagauaaguagguugguccaaggaaauaagggagagaaaucuaugggcugggaugauuauguugcuuaggauugacuguguguaucaaauacugcgguuucuucuuuuaucccucucuuuuauugggcgaggucaccccucacauguuuuccaaacuguaguaauugugucugcaggugucauaaucaauucagcaccauuguguaguagcauguguucuucaaaccuggaaaauauaucacuuugauucucuaauuugguuauauucacccuaaaauuuuccaauccaaaauagcacuugguacuaauaaguugcccaaguaauaguuaauagaaauguuguuucuuuuuuuuuuuuuuuuuugagacggagucucacucugucgcccaggcuggagugcaguggcgcggucucggcuuacugcaaccucugccuccuggguucaagcgauucuccuuucucagccuccagaguagcugggacuacaggugcucgcuaccaugccuggcuaauuuuuauguuuuuaguagaggcagaguuucaccauauuggcuaggcuggucucaaacuccugaccuugugaucugcccaccucugccucccaaagugcugggauuacaggcaugagccaccacacccagccaaguguuguuuauuucuuuucagacuuaccaaaguaucucucagugugacuuuuacucugguuuuaaauuuuucuggcauuuuuauggcacgcuuguauuucucucuggguaacuggcuuaagcaaaguaugcuuucaucuccacugagggcugcucugauugagcuucagcauugccagguaaggaccagcugauguacugagagcuuauuggauaauauuuauuauauaugguuucccuuuuaaauucugugcucuauucuuccauuauuaaaaauagcuggcagaacaaccuaccaaagccccuuucuacccuggggugucugagugguauggccuuauuacucucucuuaccaugauauuuugcuuacaaugaacaauuuaguugguaguugguucuuuaguuuucuuuugcuuaaguuucauuuaugugcuauacugccucuuugcugaaugaucaaggauauuaguauuucuaaaaugauccagcaaaugauucucauuuccuggaugacuuugcuucuagagcccccaaaggggaaaggccuaaagggaaguauucaugucaugcccugggcccuaaugggaaaucuucagaggaagggaaggggaaggaauuuuccuuccuaaacccucaagaagcucugaaauaaaaauaauuccaaaugcagugauguaccuuuuguauuuuuacuuuaucucauuucaucuuuuugacgacuccaugaggcauuauucuuauucuuaauuuucaguugggaaacuaagaaguuaacuaccuugucaggcauauaauugauucaagaugaaacuggugcacaggccaggcacgguggcucacaccuguaaucccagcacuuugggaggcugaggcagguggaucaccugaggucgggaguucaaaacuccaucucaaaaaaaaaaaaaagaaaaagaauaugauguuugagaccaugugugguggcucacaccuguaaucccagcacuuugggaggccaaggcgggaugauuacuugagcccaggaguucgagaccagucuaggcaacauagugagaccucaucucuauaaaaaauaaaaaaaaacaaaauuaguugggugugguggcuugcaccuguaguaccagccuggccaacaugaugaaacccugucucuacuaaaaauacagagauuaguugggcuugguggcacacaacuguaaucccagcuacuccagaggcugaggcaggagaauugcuggaacccgggaggcugagguuacagugagccgcgaucacgccauugcacuccagccugggcgacaagagcgaaacuccaucucaaaaagaaaaaagaaaccagugcacaaaauccaggguuuuuuuuuuacuccuagucuaguuuucuuuguuuuguuuuccuguguguuguauuuauuaucuccucaugacuuguggauuaacuucaaaucaugaugguaaucucuccuucagaggcagcccagacauaaguaaccuccuaggauaaagaccagaagacucuucaccuucaauuacaaauauuuuuuguaugauugcuauaugccagcuguuguucuaaaugcuuggagacagugaacaaaacaagcaaauauuucuacccucauggagcuuauaucauagugagaagaaaauaaacauaauaaauauguaaaauuuauacuauguuagaaggcaaaagcaccacagaaaaaagaaaaaguagagcauggugggagaauugagcacuggauuauaauuugaaauagaucaggcugugacccuuauuaagaauaugaugagccgggcccaguggcucacgccuguaaucccagcacuuugagaggccgagacggguggaucaccugaggucaggaguucaagaccagccuggcuaacauggugaaacccugucucuacuaaaaauccaaaaaaaauagcugggcgugguggugggcgccuguaaucccagcuacucaggaggcugaggcagaagaauugcuugaacccgagaggcggagauugcagugagccaagaucgcaccauugcacuccagccugggugacaagagcgaaauuccaucucaaaaauaaaaaaaagaaaaagaauaugauguuugagacgaugugugguggugggcgccuguaaucccagcacuuugggagaccaaggcaggaugauuacuugagcccaggaguucgaggccagccuaggcaacauagugagaccucaucucuacaaaaaauaaaaaaacaaaacaaaauuaguugggugugguggcuugcaccuguaguaccagcuauuugggaggcugaggcagaaucacuggagccugggaggcagagguuguagugagccaaaaucgugccagugcgcaccagccugggugacagagugagacccugacuccggcaaaaaaaauuuuuuaaaaaaagaugauauuugaggcagacuggaaggaauuugccauguggauuuuuauguaaacagcauuucaagaagagagaaaggccaguacacaugcccucaggcaggagugugcuuagucuguuugaggaacaacaaggaggccagugugcuuggaggagaaugagcguaggacaaggaagaguggaagaugaggucagagggguaacaggccagaucuuagagggccucauagcccauuguaagaacuccugauuauauccugagagaacuagggagcuguugaggguuuauaaucugacuuacguuuuuaaaggauggcuuuuauuuuaaaagaauugcccugguugcuguguugagacuagaccaaguuuugcaaguauugccagguggcccccauaucuaccagucacaugagccaagggccaucucucacuucucuuuguguucuucuuggcggaagauauauagcuaagcuaaaugguccagaaaaggagaugcucagaggaacuuuugaaaaguuaaauuauucaaccuuuggugauagugucacagggcauguaaaaugaaauucaaggaaauaucaaacucaacuaguaauugaaaccgaauuuuuauucaguguuuagcaaauuuauauugaauaccugcucugugccagauaccaauuuacuaaacaaaugacagugaacaauaucccgucucucagggagcauauauucuaaugugggagacaaauaauaaagaaauagauuguuauuguuaguguugaagacaaauagcaagauaaggguauuggggauuccauuuuaguuaggguagucaaggaagucucuuugaggagauaacacuuuaaaaaaccugaaugaaauaaaggagcaagccauccgagcauucuguucagagagaauggcagguaaaagacccugagggagacaccugcuugauguguuugaggaaaagaaaagaagucacuguagcaggaacauugggcaagggggugaggagaagaguuaacucaaggagguauaggcuauguagagcuuuacaggucauguuaaggacuuuagauuuuauucugaaagaagccauugggagguuuugaauagaugagugacaaaaucugacuuagguuuuuauuuauuuauuuauuuauuuuuauuuuuuauuuuuuugagacagagucucgcucuguugcccaggcuggagugcaguggugcaaucucggcucacugcaaccuccgccucuuugguuuaagcaauucucuugccucagccuccugaguagcugggacuacaggcgcccgccaccacgccuggcagauuuuuuguguuuuuaguagagucgggguuucaccauuuuggccaggcuggucucgaucuccugacuucgugacccaccagccucggccucccgaaaugcugggauuacaggcaugagccaccgcgcccagccgacuuagguuuuuaaaaauuacucuggaggccaggugugguggcucaugccuguaguccccagcuauugaggaggcugaggugggaggauugcuugagccuggaaguuagaagucagccugggcaacauagugagauccugucucuaaaaauaaaauuacucuggcuuuuguauaaagaaaacccucuggagcuugacuaaugauagggauaacagcagguucuuucaguauuucugacuguagaaagugguggcuuggauuagauggacaagugguagaggugauaagaagugauacauugugaccaauggaauuugcuaaauggauuggaugcacacuaugagaaaaagagggaaaucaguaccagucaacucagugaaacugugggagaaugauuugguaaguaucgagauauuuuuaguaaucaaaauuuuuaaagaguuuuuuuuccuuuuuugguaggaauucauaguuuaaccuugagauguugccuguugcauauuuaagaaggaguagcucaucaaaagaguuggucauuuagaaagcugcauuuuuuuucugagaaauaugaaugcugugaauacugaaggaucugggauagggauuaugcucuccacugucuuuuggccguaucuuucuuuuauauguuugcuuugucuuaaaagcagaccugcagccaggugugguggcucacgccuguaaucccagcacuuugggaggcugaggcaggcggaucaugaggucaggaguucaagaccagccugaccaacauggugaaacgccauaucuacuaaaaauacaaaaauuagcugggcaugguggcgugugccuguaaucccagcuacucaggaggcugaggcaggagaaucgccugaacccgggaggcggagguugcagugagccaagaucacgccacugcacucuagccuggaugacagagugagacuccgucucagaaaaaagcagaccugcuuacccauguguaucacauagaaggccuguguaauuguaagcuucacaauucagguggucaaaccaguaaguacauaggcuuuaaacauuuuuuccagccgaagaacgauuuaaccugagacuuugugcuuuacaggacuagaacuacaguuguucucccugaaaaaaaaaaaacaaaaaaaaaccggauaugcacuguucagaauuauauaagaccaauuugugcaagcauaaugaguggccaguuuauggugggauguacaccugguuugggaagguagucugcacaggaaucccuuuucccgguagguuguuuagugauuauagguccacagcaaagacaacuggauguuuuuaagagagauucuugucaaguugugccagccguaagguaggaaacccuucugcucuugaggaaugugacugcugacuaggccuuaauaggcagguuauuggagcuuccuggacagugguagagauaaguuaaccaaguuucucuucaaaccccuuuuuaaacuuacugucaggcuuucaccuacagcauagccauuccagugcuuuaguaaacugccucuacuaagcacugguuauuuucuuauguuuauaagaaguguccuuuccuugauucugccauaccuuucuucccaaggaauacuuccaaagauggguuuuagcucuuagcucccaaucaccaagauugcuuggccucuggaaaauuaggggugugaaacacuaagaaccugaaauacuuuaaacuccugucaucucaauaaaaacugccauugucaccaagaguaucucuugacucuuugugguuauuaaccuccauggcacuaagcucuaaaggcuaauggauucuacuuuguauauccuuaacuucucaaaauggucuguuugcuuaaauucuuuuuuuuuuuuuuuuuuugagacaagaucucacuguuaccacccagacuggagugcaguggcacaaucucagcucacugcagacucgacuuccugggcucaagcauuccucccaccucagccuccugaguagcugaaacuacaggcgcacgccaacaugcccagcuaauucuguucuuuuuuuuuuuuguagagacaaggucucacuauguugcccaagcugguguugaacuccugggcucaagggaucuucccaccuuggccucccaaaguguugggauuacaggcaugaaccacugugccuuucucuuaaguucuuuuuaacccuuaaauuuacaguauuuauuuauaacauuuauuuuuuaaaauuccaauuuuaaaguaauacuugcuuaguuuaaaaaugcaaacacuacaaauaugcuuaaaauaagcaaaaaacuuccauaauugagauuacacuauauuguucugcaacuugauagugagugggcugggugcgguggcucacgccuguaauccuagcccuuugggaagcugaggcaggcagaucaccugaagucagggguucgagaccagccuggucaacauggugaaaccccaucucuacuaaaaaauauaaaaauuagcugggcaugauggcaggugccuauaaucccagcuauucgggaggcugaggcaggagaaucgcuugaacccaggaggcagagguugcagugagcuaagaucaugccauugcacugcagccugggugacagagugagacuccaucucaaaaaaaaaaaaaagaauagugaaugguuuucacguuaacacauauaugucugucuuuuuuuuggagcuccuugcuguaguaccuuuuuaaaaaagaguuguauaauauuccauuauauggaacugcccugauuuacuuaaccauucccuuauuuauuuacauuuuucacuauuacaaauaagccuggauugaacauucuugggcacuuauauuucugaacuugagcaaguguuuuuauuggauagagcccuaaaaaagugaaacugauuggucaaagauuagguacauauaaaauuuugcuagcugcugccaaauuguccuccagaaagguugaaccaauuuaugaaacuugacauuucaagaaauuguauguguuucccaucuaccuaauaaagaaacgguccacaccauuaauauaguucugaaugcacugaaauauaauuguauaugucuuucccacuagauugguacuuccuuggggauaggaaucaugaauuucuaaacuuuagcaucccauuguuugcuuaaauaaaccuugaaauacaaaaaugaaaagaaaguacugucuuuguccauaaguggcucacagcccaguaaaggaauccacagucuuaucuauauucaugcucuuuacuacaaugacuagaauaugguauguacccuguaaaucauuauuguauaacuaaaagcguuucuuuuuauuugucuaaaaacuauuuggcagaacuucuuaauuuuaucaaaugagccaauggguaguuuuggaauaugaacucacuuucuauuuuaggcauugccuguuggaagaaagaagguguugucuuaagucuacaccccguggcuguuauuugauugcugcuguuaaaaaaacauaaccuuuuuucucauuuucucugaauauacaauauacagaaauggaaggagggugagccauugggagcuuuacucuaccauuaagcauuucuuuaaaggcuaccucacauuugcacuuaggucacaaagcuucuguaacuagggugaaccaccaucauugaaaagguggaaccugggaccuucggauaugagggcagaaccuugggccccagcaugcuauguuuaggacauuuggccucuuacuaaacccacucagcuauguuccuccuuuuuuucuuuguuucuucagcacuuauauauucaguuugcacuguauuaauuugcacuuguuugcauguugcuuuguaaguauuuuaagggcauuuuuuuccucucacauauauauuguuuugugucccuggcuaaaguacaagcuuuuugaaggcagaaaccaugucuuugguuucuuuuguauuucccauagcaccuuuuacugugagagugggcacacaguauauguuguggaaugacauccugagugaucccucccuggcugggccucagauuaaauucccugaaauggaacaguccuaaccaacacaggacagguauucuccaucuggcauguugguugcuccuuucaaccugcuauuugaaauggcucccuucaacaucuuucuguucccacaguggggcuugcuauggcuaaugcuguacuugcuguauguguuccaggcgagucugcggacaccagaacugaccugggagcgagugagaucucaaguugaccaugugauauggccugauggcaagaggauaguacugcuggcagagguaaggcugagacuggcaaaaauacucccccacaacaggagagacugcaauacccagguccccuccuccucauguucucgaauacuuucaacuccucuguuaagcacaaguuugacuacuuucccaauggauuuuacuucuaauugugaaagaucuuuucauucagcaauuaagaaacuauuuugguuccccacuuuucaccaauuauccugucucuccacgucaauccacagguugaguuagauaauuauuacuauagaaggaauucacagauagaaccagugccacuuugagugaugcauacaaagagauaaugucacuugugggauguuuuaaucacuaagcacaaaguagauaugcccgacuguaaccaggacuaucuuaggcaaguucugggaauguauguuuuuacugauagauucccuguuuuugaagguccauucccuugaauugagccagaugaguaguagguaccuaccuagauaucaauugcucaauugauauuuccccauccuagcuccuagcucacauugacacuauugacuuucauuuuauuggcuuccaugucaguguuugaccacuuuuccuuucuuaaaagcuccucuucccuaguccuggauuccugacagcuauaauauuagaugccuucuauucuuaccuugaagcuuucucuucuucagagaaagauaccaaaauaucaaggaggauaauaauacuuuucucaauuuugauuuucaguugguuuuuuuucuuuuuuuauauuaaagaaccugaauaugaaaauguaaaauauacauugucuuuaucuaggggcccauaaguuaggaguuuuuaguguccuuacuguuuucuucacauuuuccucacuuuaucucaucuucucagauacuucagggcauuuguaaagggacugaacuauuucuucacaaggaaggaguauauaugaggaggagaugggcagauugccaaauaugcauuaauagcuuugaugucagucugcugacugaugacuuguuucuagcugcccuaggaggucccaccugguaauuuuggugacaaaagcaaguaccauggguguuuuuggcuagaugguugagcaaaaagguggucaggcuucauaggaaacaaaauaggaaaggguggcauugggggcaauuucuaguucuucuacugucugaaucaccaacucaaaauacaaggcugacaaugcugucuuugaauucaggagaagcaaacugaaggagaagcacaaaaaucaucacagcuauggugaaacccugucucuacaaaaaaaaaaaaaaaaauacaaaaguuagccgggcaugguggcgcacaccugugaucccaguuacucuggaggcugaggcaggagaaucacuugaacccagggggcagagguuacagugagucaagaucaugccauggaacuccagccugggcaacagagggagacuccaucuaaucaaucaaucaaucaaucaaucaaucaaucaucacagcuuccuaaguccaaauauaccuccccucacaaccuggagagauugucccuggauuugacugaucauuguuuauuucaagacagucuuuaaaagaaaugccgauccucagaaggaggauauuuugcuauagagaguggaaaauucaagagaaguacacugauauuuggcauaagccucagugucauaugaccaucuguauuccuuuuuaaauaauuccagaaaucuuuuagcuauuaguuucaucagauuuuccagaauuuuagugguuucauuuaaaugucagucaguuaguucuuauauauugaauagcugcuuuuuuuccagcaguguuagucaggaaguguuuggaaaaugguggucaugcuucucuucccucacuucucaaaggccagcgacuuuguccuaauccauuugugucuucaccuuugaucacuagggccgccugcugaaccuuagcugcuccacagugccuacauuugugcucucaaucacugcuacuacucagguaaggcuuccagagugggauagcaguagucuggagaagguccucagacccaccagguuucacuugcuuggguagauugccaugaauggcacaucagcauccaucucucugcuuuucuaggcucuugccuugauagagcuuuacaaugcuccugagggucgcuauaagcaggaugucuaccuguugcccaagaagauggguaaguauuuacucuuccaucuccauccuuaccaaaguaguucagagucugagguuaaaggaaguuugggggcauuaacuuacuuaaggaugggggaaaaaagguaccuucaucuuguaaaguaggaauuaggauuccuaggugccauucccauuuauuuaucccauuuucuacauguguugcccuagcgaaguugugauauuaugcugugauuuauuuuaccugccugugaauuuuaaggauuuuuuuuuucuuaaaguaucuuuaugugggaaucucaaaggagaaaaaaaaaaucuucccuuaaaagagaagaaucaucuccuaccuugugacaucugacuuacuccaauucuaggcugccaaauagccccuaccaaacuuuucucagacgacacaagacuuucuuacuacaccuuccaacaccaaucccagugcuucaggccaaaggagagauguggaauaggagcuauuuaguuauguggguguuuuguauaagagaaacauuaaccugucuuaaauuuuuaaagagccugccucaagcaccugaacugauacaguguguuuauaaacuccucaggcaaagaucagguaauaaauaagcuucugguuuuguuuugccuuagcacuagguauauaacaacuguuaaaaguugauacauuuucccuuuaguagacacuuuagaaggauauaaaagcaacagcacaguccauauucugacagaauguauaaugaaguugggagaccaaacaaauacauaggaaaugacauaagauuaugaauaaguacuauguagucagauaauagaaugugaacagaaacccauaagaauuaagaguacuaaaagcaaagcaaacaguucauuuaucccauuuaguauccuucuuaguuuuuccauucaaguuuccccaggcauuaguuguuuuaaaugacccaaaguauggaguccaaggcaaaacucaaguuggagcuucccauuauuuaguucccacauuauccuauuccuucuuuuaaaucuuaaugccuguuguuucuuucaucucuccugcacuuuucuggaaggcaggguucaaagcugaguuaguaaggaugaauuauuaaggcuuuggaaagcacugggcuugaagcugaaggcagcuauuccuuagaauugaggaccagugagcgaagguugaacauuuuucauucagcuccaggaauuagaaggugucuuugaacuuuuuaaggccuagcuuggggacaauagccaucagauaaaaggcaugaaugcuuauaccagggcuucuguggucuguuccagaugaguauguggccagccuacaccugccuaccuuugaugcccacuugacagagcugacagaugaacaggccaaguaucugggacucaacaagaaugggcccuucaagccuaauuacuacaggugccuugggcuccccagaaaucagggacaccugggcagugaugagcuuccugcacuggaauuggucuuugcauccccaaccacauaugcuuacaugaacucagaaaaaugaacccacuuccccucacugccaccuucaaaagacucuucaaggccuuaaauaguauuccccuuccugaauuugccuuuuggagauagagagguggaguuuggguaaguggcuauuugccucauuaaauaaaguuccccuuccucaauuccuuuccccauuucaucuuguugcuaugauuuuuaucucuuuauggagaaauauuggccuuuuucaaugaugugaaaaggaaacacaguuauuuccugucacuguacacuccagaaaagucucugccucccuguuacaccuuuaggcaggcucuucaugucccagcauccccauuagcugauaacaucacagucucaucuuucuuuuucccuccagguauuaaguuccuguaacucaaaccagaauuuuuaaggaauagaacuccaagccuuuucuccacuacuauacaagaaagaauucagcaagcugcuucuccaaucaaagcugccugccgugcucacccuguguguuagguuauuuauuuauuaaaaucaagaauccugugccuguaguguuggcccagagugugguuacugcccugagggccaugaaagccacagaggaugggcugaggaaggaaagaaaugggguuacugcucccagugcaucauuugcaucauuccccauugacugaauccucagcaguggccguuuuuccucuuguccaggcucacgaguuaguccagggauuccauacucccuauucccuggaguuuucuggaauaaauuuucagcaccugcuuuucucagcuuggcccuuccccgggugaggccguuuggaauuaacauggccaguguuucacacaagauuggguucccaaucuugaccaucacuaucacugccuucuuuauauaaaggcuaauaaggaaggaguguuauuuauggcuuugccaagcuacaucaagaacucagcugugcugugccuaccaggggucuccuuucuuacccaggacuccuuucuucuccuugaauauuuauguccauuuuaacacuuccugguugcaagagggaugugccuccauuauuuccuccacaguuuugguauuugucagacauuuguucugcugucuuucuaauccagccaacgucugcucaggaaguggggccagcuccacugggacccauaguuuuacuuccuugucauuugauuggauaguuuccaaggaagccccuccagauuggcacuaucucagaaaaggagagcuuguugugaaacacugcuuccugaaacuuccugcuauugccuaaagcuacgucugaaacugaguagggaaaggcauacuuuuccagggacuuagggggauaggcuuuggaaaugggacaggucuuucagacucacagcuugauacccuaacaaagcagaguauauuuauuuguuucccaggaaggccauugcaguuugacuggcugagggauacagagaugaaauuguaaacuguauccagauuaucaaagcuaauuugacuaguuugaaccucgucagacauucauuccuuuggccauugccauggaugaaaccgagaucugcagucugaucuguggacuucucugcuggcauaucuuuuaugauuuaaccucuuccauuugaugauucuguauuucagagucaguuucuugaguaacuccagugcuacaaaaagaauuaguaauguggugugggcagcgugacauuuuaugucccacccaaaaauuggauuccuuuuggagacugaucuguuggucucaggcauuucauuaggaccagauugguucuaagaguuagucuggacuggcccuaggaaacuugaauuaaauaagccucuuccccuuaccgauccuuuuuaacacucucagguuuguuuguuucccacuuuuuuccuaugcuggucugccucaaagucucaagaccaaggugacucaagauaacaccagaccacgcaugaucaccaaaaccuucccauccugauucucuucuucuaccucuacccucuccaacuucuccuggucuucacauauacucucaaagcuagucugaaagugaccuuacuuucggaaguagggaaguggaacuuugguaaaugacuguuugccucauuuaauaguauacaggcucagcccauagacuacaguucuucagaggccauaugucucagcaaguacugguuauauucuuuuuuuguaaggaagaucauaaaugcuaaaaauuccacuaagccauucaguucuuccuuuugccuaccuaguccugauuuuuguauuaauugguucccuuuagcaagggauucagaucuuuguaccuuaucuuauauccagagcagauuccauuuggcagauagauggucucuagccuauuguauucuuagaccaaaaaucauaaccugcuguuucucagcaaagccuugcucucuggagcuuacuaugugcugguacuuaaagaguacauucugccuugcuguagugaagagacccacuccaaauaaaaaaggggccacacggggcuucuaaguuagguugccaguguugcugcccaugaugaguuauuugccucugaguuucagaugaccucucuguagggacacuguguuaucaaccauuaagaagaaagaaccacaagccucccaaguauuuggguucuaucuuaggguugaaaucuggucauuauucccucuacccuuggaaucagagcaaugugucuucuuuccuccaaccucuuaccuuagaugcauccugguuaucuggaagcaugggaaagaaggcuacuuaucucuuuguauguggcuccagucugugaggauacauaacauuuucucuacaaugaaucugugcuaauauuuugccuucuuucuuucuuuucuuuucacccuuagagacaggguuucacuauguugcccaggcuggucucaaacuccugggcucaagcaauccuccugccucagcuuccugaguagcuggaaccacaggugugugcuaccgugccuggcacuuuuuugccuucuuaauggagauauucaguuuucuuuuuuucauuuaaacaaagaaaaaaaauguaucuacucuaccuucccucugcucuccucccucccuauccuacuugcccauaugagcacggcuccccauggccacauacuccugcaaagcuuuuaugcugcuucgcuuuucucuaaacagaucugauauugcugcuccugugguuuucucaaaauuaacuuugccgugguuuuuaaaaaggaaucaaaaugcauuguugcauuaagcuuuuucaauaaaggaaaauuacggaaggaaaauaggcaacaccagcaaauuauauguggacagguucuaaacucuauauauacauauauauauauauaucuauauaucuauauacguaaucaucuaguucugucaucuuacugaaaggaauaacacuucuaaagaucaccauuucugagaaguucuuggaaaucuuuaugucuaagugauuguauuagaucagcaauaaugacuauguaaucucaaaaaacaaauaaaauauucuuaacauggacucuuaaggguauuucuuguuucugugaacuagaaauucagagaugagagagaucucugggcaacaaacuagagauccugcuguagggcaaggaugugaaaauguuaccaaugggcauguuugaccuuaggaugugaaaauguuaccaauaggcauguuugaccuuaguuaauaaauaucauguuccccuccuaccagccagcauacacgcgcauccuggcuguguguguaaagaaccugucuucucagaaccaccacccuggggagucgaggacuguaggcuuaacucagagaaacuaaaccauaguucuaggucccugacucccuuuuaguugaaaaaugcaggaaaucagcaucccccaguuugggaccaaaggaccuugauaacuaggaccugauuauauccagccaaagggaagaaagaagugcaucaggcagagauuugucucuaaaucaaguugccugauuuaaccaaaggauaauccaauugccuauucuuucucaacugccaguaggguaaccaucuuuggguagcuuucugauagccaccuucuuuaguugacuaccuaaacuaguucugcauccuguaugcaagauguuuucuuuucauagcagaaucuucugccacuuuggcuucugauuauuuagauuaagggacacagggcuagaaucgucugggcagucaguaauccucaaaauuagugccauuccaguuaagaggaggagaaugcagcagcuagcaaugaagccggucagcucaaaggauuugcuccccugcaguagggcuugacuccucauuugugaaggauggaaccuugggugccugggucuuuauuucagaaucauaggguaagcccaagcuauccacugcugcacaaguuucuccaccucacaauauugugcaaaaaaacuugaacuuuaaagcaggcuagcuuggguuugaaucccagcucugccauuuacaaguuauguaacuuagucaaauuacauaaccacucacagccucaauuuucuugccugugaaauggauacugcuuaucuccuaggauaaggauuuaaugaagcgauauauaaaaagugcugcuuauuuacagagccuggcacgcacugcugacugcauacacaucauuccuugucucaaucuagagcccuacaaccucuguugcaucauuacacccacaccugcccuuuauggagagaggaggguguucuauccuuuuuuuacuaaauuauccuaacugccugauagccucaaaaagcagguacuuuaaaacuuacugcgucuuauuaagcuuucucagugccaggugcuauccauuuagucaaguaucugaccucuguggauuaaaguggagugcuuauauggggaaaaggguauaugugauucuuguaacuacaccuauuuauaccuccaacccucugcuggcagccugaguuuugggacaagggaaauugguaauguagguuuuuuaauaacgucaaauauaacagcauuggagccaucucugcaagauggagagacuugaccagccuugacuagcucccagguaugggugccucuguggugaaugguauugaugacuaugaugccuuuguugacaaauaagcuaaaauaaauugaaugugugccaauuccauggccuguaguuucaaaguuuucaguuacucugugguuucuuguuacaucuuccaguuguuuccagauaucuuccuccuuauuagaaauuuugaacgucugggccuauagugagcacauaggugucugaucuuaguaaagguauucuauuucgcugagauguggaaaagaucauggauugaggucucuccucguguugacucuaugcaaucuucauagcaccaguuuuacacauuccuucucugaaauuaaagccagauggagccucuaggcuuagcaaguggcuuuagauagccaccagaggggacuugcaagcuguccucuauccuacucccaagaucagucugcccuuuccccuaggaauaggcaggaaaagaauaaagcaucaaaacuggccacuccugucugcuaccacuguugggauccugccgauugauuaggcucacaaaagaauaugaaguucugggccuguuaaccuuagggcucugacuacuuaggaggagaaguacugggaagaagagagauagaauaaugaauucuuucuauuaagaaaucccaaugggcugugcuguggcagguuuaccacacugaagcagugaugagcaaggcguggguugugaacuuuaaagcaggguguaaauuuuuaagaguuuaacaaauuauacccugaaaaaaauccaaagucaaguaguucaggccuugagccagggacuuucuuggaaauucauaucaauucaguucuguaaacgccacacuccccaccccccacacccagccccccgccccgagacauuuuugguugucgcacuagcgggaggauacuacuggcaucuagugaagagaggccagguauucugcuaagcauccuacgaugcacaggacagcccccuacaauaaauauucagccccaauugucaauaguacagagacugugaaacgcugcguuaaacguacauaaauuaggggcauacaaaaaugagcuaaauuuggucuuacucgcuaggagccuauauguggguggggagaggagugggacuggaagaggaaaaggaagaugugaagguacaguaaggagauauuggaccagggugagaaaacccaaaaagcuccaaagagugcucucaaacuugccuuguucugucgccuaugaacuggcaaagggaaaagugagagagagagagagauguuaagaaagggacaggguugucccuaagguaugggaagguggaguaauuccucuaggcccuuugcuuuggguauaucguggaaaauguuaggauuuuggaucuaggcagaacugguuugacaccaacacaaccugaaugaguugagggcuaaaaggaaagcuuuguggaggaggaggaggugacaacuaacuagaaucuuuaugagagaaaaggaaucaaccaggagaacagaagacagucuccuccagagaacagcauaggcaagacccugagacaagauagaauaugauaccuuggaaaccgcagggaggaaucugcaagugccgguuucuucaucaguaacauuggauucgu

SEQ ID NO: 14567 - RNA, 1737 nt, Homo sapiens
uuugucuugcuaacaggugcaucuucagcgcacucagaacaauaucuggcacagcacgagacaccuagaaauguucgccgaacgaucgaauggcugaauacauucauauguugcuuuguacaaaaacuugcuuucaaauaucugggaagaguuagagauaggaaagcagaggucauuucaaagagagagagugaggauaccaccgggaaggcagcgccgaaaaaaccagaggggaaccacuugccgaucccccaggcacagucuggaggucccaauucccgcgguaggggggcgagagaugccacucgucugaucagcaaccauuuugggcccgcuugcgccgcuucuccggggcguccgcguugugcucauccaguugcuuuugagguuccggcccccuccaaaccucugaagcgcuccgugcacgcgacgcggcggcgggguaagcuggagcccucgccgcgagcccucuccgcugccugcccgcagcacagccgcgccgaccuccucaucauggcggcggccgggcggggaagccgggccgugcgucgcgugcgugcccucucccuccccucccccuccucggcggcggcggcggcggcagaagcggcagcgcucgccauugccgcugguggcaggaggcugcgaggagccggcgcggucgcagucuccacggcgcaggcccacgguagcgcagccgcucugaggugagugcccuaccgcgcaaucuccagcuauuucagccccggcgcagccgcaacacgccgcccgcccgccggccggccggcccgccccgcagccggcacccugccgcccccggcucugggccugggcccccgccggauucggcccgccucgggcggggggccccggcccggcccagccaaaccgccaccccgaggaugcgcaggccgcacuaggccccaggcguccuggcgggcucgggagggaggcgcugcccucccgagagccccaggguuccggccuccuccgccgccuggggcucucggggccgcggccuucuccccgccguggaacccggggcccggccuucccgcagcucgggagcgggaggcgcgggagagugcgccgggcccgggagcgggaggugggcgggcugcgcgggaccggagccgcggcucucggcucgcccccucggcccuucccggcucucguacgcgggcgggcgggcgggcggcgcgguggggccgggcuggggcgcgggagccgcugucuccugcgggagaggaggcuggcucuuugggcgaccuccgaagcuucccuccugccgggguggcgugggcuuguuacccagguagacugggggacgcuggaauauggcgcguugcccaccuucuugcaaguuaggagguggccggggcggcaguucgaggaggagggcgcaaaguccuuuuguacgcagaaauaaggagcgacauuguguuuucuuccccagcugagaugugcccgcggaggggccgcgguucuuccugugccugggguggugguccccugggugagggagagggggaguggcacgccccuccgaaggaacagaaccuuuugccacuggaaagacaggggcucugagauggccgugugcaugguauuuucccauauccccagaccuuuucggguuugucauugaauguugugcacuccaucgugcaaugaugucugcugccucucucaccuguugugucguggcugcuggucccaaaguuucugcaguguauu

SEQ ID NO: 14568 - RNA, 3787 nt, Homo sapiens
uaaucugauaauccuuuuuaugaaauuaccucugaaaugcuaacuuuucaucuuuugaaacucacugcguaaauuacucugaagauuacauuguaccagcuuucagcucuguaaaucuuaauggcaguuuuucgccaaaagcaauaaaagcuguccugaauuuaucaggugaaucaggaaagaggcaggcgggcaggaaauugaaggugacucccuuugcaaguggggguuucaauggauggacuuugaaaccuguuguugcugguuacacacagcgaggaacaggaagcagacaggagcauggagcccccggugcaggugucagggcugccugucugagagaagggcuagugugguucuaagagggucuucuccccucuuuccucucccccaaccccucccagugcgcugccaggcugagcccaucgguagugguggaggccuccagcacaucccacuugggcugaacccacagagagcugccucauugccacugccccugcacaauccccaaaagucuuuggugugggguaggggcagggagcacaccugggcuauugcccuccacccugcuuuuccuagcgggcagagucuuggccucaggaugaauuuaauuucuccaauugugcuagcaguugucauguagaaggacucuuuuuuuuuuuuucuauuugucacccacucugucacccagucugaagugcaguggcccgaucucagcucacugcaaccuccacaucccggguucaagugauucuccugccuuagccucccaaguagcuggaauuacaggcaagugccaccacgccuggcuauuuuuuuuuuuguaguuuugauagagauaggguuuugucauguuggccaggcuggucuugaacuccugaccuccagugauccgcccaccuuggccucccaaagugcugggauuacaggcaugagccaccucaccuggucgauguggaaggacucuuaaagccuggcuggggcuacgggccugguggcaguaacagcauccaccuucguuaucuuuuuaaggccagucuguuuuucuuuuuaguuguaaccucugugccucacaucgugugcuucaccaggaguguguuaugccacucugccagccucuucuaaggccgcagcacacuucccacuuguuggaaggggaacuggggaaggacacagccuacugaccccauggccccauuuauccccccauccaccccuccaucugacagcguacacugagcaucuacuaugugcuaggcucuaaagaauacagacagaacaagaacaaggcagagacguuuccaguccucauggcacuuccauuccaauggagaaagucuggcaauaaacaagguguguacuaaacaagaugguguuccauucuuugggaagaggacagggaguggagaguccugagcagaggggaagacuauacaguuuuaaccagagagggcaggaaagcccuugcugccucacucgccucacccuagcccuggcucugccucauugagaagaccacauuaaaaaacugaaggaggccaggcacacagccauguggauacuggaggaggagaccuccagaaagagggagcacgcuugaccgcucaaggagcagcaaggaagccaccguggcuggucgagagugagcaaaggcacagugguaggaguugaggccagagaaguuuggacugugcgggcccuggagagagcuggguaaaugggacauuucaggguguucugcaggcaaaagcaggcccucccacccucaguucuguucugucuccgggcaguccacaagcaccugagggcccacgugaggagaagaggccuggguuuuccgggccuggaagcuccacugccagaagcauucgcccccuggcccagacaaaccaaggucagaaggcaccuccacccagguuuccacaggcgucccugcugcugcuucacugggcugaagcuacccacguucacucagcuuugccagggcaggaugcuuacucccuacaaccucccucugugccguuuuucuccuaucccugggcacgcaggugaaagcuaaaugaggagagacccgccccacaccugaguggccaggcugacuccugugguggaacgaguuuuuaauaaaaccagaagagcuucccaauuccacgccucgcugcagucucuucaccuugcuccagaggaaagacccagaguauggcagggcugcgguuagcgagggcuuuggucagcagcuggagagugccguagugacauggugacaguccucggcccccaggaggggcggaggccaccccucugggacccccagcccuagaaucccaugcaggagugacucugcugucccaucacacucacagcugcagcaaggaugccuuuccagcagucacacucccacgcaggggucagccuuccucccagggggagcaggguggagcgggagcugguccucccagcauacugcaggcggacaacaguggccuguuucaggugacaccugucuuugggcccaggucccacuucugugguuguccccaggcugagcugcccccuggaaggguuuucuggaaaggaccagagagguguggauuucggaaucucugagagcucuggcaccucuguuuucugcucccuggguugaguggccagaagagccugugugcuugcauuuucgguaugaccccuggcccuuaugugucucuguguccccaggccccugcucaauucuccacuucaccgagggugccugaccccucuccuuuucccuccauccccccacuucugaacgcaccccaccgugugcaugggaggguccuuccucccuguggcuuuuccggggagccuuuucuucucccugaagucacccccgcauaucccggagagccacagcgccuauccccuggguugccauggaaacagccuucuuuccucuucccuccuguuuaccuuggucagggacugcggcaaaaaccagcccgucgcuggaggagagggagagcagugggcgggggagcagggagggagccaacccgcuccaaaccagaucauuccgguucagagcggcuuccccuccgguccuaggagccucuccgacaaggcgcgcugggcugcgcagggaggcccugggccgagcuggccuuaguggggagggccugagcccacccuggccagcacccccuccccaguuccguccggccuccaugcgucccuccugccagugcuggcgcagcggggccuggggcgcugucccugauugcuggcuguuccccgcacaggggcgcccugcuggggcgggggugaugggagcagaagugucucggccccaaaggugcuuucgcccuccugggacccccgggcacucuccugcgacagggaugcucuguguggcucuggcuuaaagcuucccgcugcguuuagagaagccaaacccuucgucccagccccgggauaggugcggggccgccucuucgcggggauuccccuggcucccaccgcaaggcuucuuccccuugcagaagacaccagaagcuggguuuugucccugccccgaacacucuggucacacuuucuagcuccccgugcacaccgggcgggaggcuuuccuuguuucuacgccacacagcuccuauucccccuccaugggccacuguggucaucuugcucguuugcuguggucugaucgaucgccuccuccccaauggaaacuucccgaaggcagggcccgcucacgcagcaccccagcaccaauggcacgugccagauguucggugagcgacggugg

SEQ ID NO: 14569 - RNA, 43681 nt, Homo sapiens
uggggcagaaaaggacuuacauacaaaucucauccacaguagugccugggacugucugcaugcaaguuugcuaagaaauauccucagggucgcugcuguccccugcgggguggcagggcuguggugcuguucuccacacccauccugcuguuagacucuccuuccuaacucccacugaggugccgccucuguagaauccauaaccugucccaucccaggucaaugcaguucaguguggaaacguuauuauugaugaacauccagggaucaaauuauaauguggcucagagcuaacgccuaacaauccugcacacccagcagaaagcuacuggcauacccagugagauauggcagugucacugggguccaagaggcauacgugcugauuguacaaagcccucucauucuaacugggcagacaaagccucacauggguccuucccugaagccuuccugccagagagcccagccgugugcugcuuauccuugaagacuuuugaccucauccacggucuagggacagcugugacuaaagccacccagaaggacagguaggccagccagccccucccggcccccgccacuggucccugcagcauuuggggcaauguugugcuguuguacauaagugcagugcccucacccccagguuacuaaggaagacccccagaagcacuggaaugaguuucaucauuuuccuaacaccuuuacuuuucaagcagucccccugcugcggcuguccaggcccaggagugcuuccuccuucuuaggucuagccacaaaaggaaagccagugugcuuggagggaucaaaagguguccuuuggaggagaacgugaggcuuucccaaaagguaguuuuagccauugacaaguauacuugaacagcagcacagcucagacuaguaagaaacucaguucuugugcaaggauaagacaagacaugaggaccuacuguucgacuaaaagucacuucugaauccauucauguagcuguugagugccaaaggaggggcacagaucuaaucacucaaggggagaaaugacugccaucuggaguggucaggacuagcuccaaauagaagguuuaauuagaggaagucucaaugcagaggaagacaguagauugggagggggcaucuccagagagugaucaggaugagcaggagguagcauagagagaacccagcaagcagugagcagucugcacuggcuggagccaaggguuuaggugcaugaggccagguuggggccagauuguguggagcuuuaaaugucaggcuaaggaauuuaucagggggaugaaaugaucaaacagguguucuaggaagaugaauuugaagagaaugugcaggaugaauuggaaaauauggaagcauggcaacaauucgaaggcugugagauuaauuaggcuguugcaguaguccuguguggguugauaaggguguaaaugagcauagugguggcagaaauggaagaagugcagcugcaagagacauuguuaagaaagaauggaugagguuuguugccugauuggauuggggacccagggagcuccaggaaucaaaagaugacaccagaauuuugagcaucgguaacugguaguacaaugaacagaaaaagggauguaaguagagggagcugauuugagcagaugugaacgcaguuccagacacggaguucacagaauauccaagcggaaaugucugacagguagauggaaaucaacacuacagcucaggagaaacauuaugcuugaagaugaauucgggagucaaaggcagagaggugauaaaugaaguggaaugaaugagaucucuaaggaaaagcauauacagugaaucagaggaccaaagacugaccuuugaggaaugugugcauuucaaugugcgcauuucuauuacaaagcugucuagaaagggcugggugugguggcucaugccuguaaucccagcacuuugggaggccgagaugggcggaucaugaggucaggaguucaagaccagccuggccaacguggugaaaccccaucucuacuaaaaauacaaaaauuugccgggcgugguggcgggugccugaaucccagcuacucgggaggcugaagcaggagaaucgcuugaaaccggaaggcagagguugcagugagcugaguguagugagcugagaucaugccacugcacuccagccugggcaauaacagugaaacuccaucucaaaaaaaaaaaaaaaaaaaaaaaaaaaaaaaaagugccaccccacaugcugcgugucuuuacuguuaaaauauaaaauaucagugucaaguauauuuuaguuugagaaagaaagccacacaacguaacauuuguaugucucaguagaaacuaaauuauaaacaccuaauaugccucuaaaagaaaucuggcuuaaggaugauauuuauagacaaagaaaaggauaaaugaugaagugaauguaaucuagaagauuaguggaucugaucccacaagaagucaagcaaucaaagaaaaacuugugacauauauccuguaaauaacauuugaucagagauauuaguaggcauuuauccauuuuaacacaaggacuaaaaaaauugccuuauuugcagugcacugucuuccugaggggugaauucaaaugaaucuaccaaaguauuuuuaauaaaagcuauauuuaaguacaaacuggcucaaauauuugggaagaaaagcuaauauaggaaagcuacccagaguacaguaauccacacuagacuuauuaauaguaugcaaacaaaacaucuuuuuaaguguguaucccuauguauauauuuacuguagacuguauuuuuuugauagucacuuuaaaaauauaauauuaaagcuuugaauuuuuagacuaaaagcuaucuaaguccuauaaagaaaaaaagacauuucaucuuaugcauuguuaaaauguuucuccauggugcuuuuaaugaaguauaugcaacuaguuuaacagcaugacaauuguuauuccaagacaucuucaguaacuuuugaaauagcaaauuuaaauuuuaacauguucuuauauuuaacauguuugauauuuucuucuagaauaucauagcaaauaaauauucaacauacaccaaaaguacuuaaaagaagcuccuuuccuuuggacaucaacuuuuaaaaacacgaacaacuuuuugaaagacagaauuuacaaauacagaacuguacugacuuaaauuuggaauuuacuaauuacuggggauacuuuagugagucugcauauguguauuauuaauacauguuaaaccauacugcagauaacaaaaaauauacuuacauuucucuuccagagaguaaugacuguauucaaagucugagggaaugacaaaacgggaugcacaucuaacacugauacacgguucuucagaaaagacuaguuucagcuguuuccagguuuacauaagaugauggaagcagucucuaauauguuaaucaagaaaauauaugcaauugccagcuacuacauauacagaaaauaaagauggugagucaaacaaaacauacaaacuugguaacuucucacccuccagauauuuugaacauauuuaaaaaauuugaagauaggauaucacugugaucuuaaaaagagaacuuuaaaaauaacacauuauggaauaguaaaacugagcugcuaaaaccaaaguaguaaacaguuuuccugauguccucacacucuuaacuaaaacccaaauuaaaacuaccagcuaaauuuaaucuaaguguugacuuuuuaaaugucaauacuuucaaaccuccuuuaauaauauuuuaaaauauacauaaacuuaauacauuacuuaagaguuaaucucauuucuuugaaugugggcuuuggccuaacuugcagaaugcuggggaaacauuaaaaaaaaaaaaaaaaaaacuaaaucagcaauuuucuuacuuucuaaguacuuacacuguuaaauaaaauaacugaggcugggcgcaguggcucgcaccuauaaucccagcacuuugggaggccgagguggguggaucaccugaggucaggaguucgggaccagccuggccaacauggugaaacccugucucuacuaaaaauacaaaaauuagcugggcgugguggugcaugccuguaaucccagcuacucaggaggcugaggcaggagaauugcuugagccugggaggcagaaguuguagugagcuaagaucgugccacugcacuccagucugcguugacagagacccucucuaaaaaaaaaaaagacugaaaaaaauuuuuuuuugguacaagaaucagguagaugauucucauuuggggguuacaaugaaaaaaagacucaaaaucuauuucauuaaggggaauggcacuauuuugagucaauaaaaauccgaaggguugcaguuuuguagucaacugaaauuucugaaaagcgauauaaaauuaaaggcaaugucucgauauagaagauacgggacauauuuuuacaauuacauuucauaacagcuacauuuucuguuaaaucuaaagagucuguaacauacacccauguguauuuuauuucagaagagucaguggcucagagauguuuaguuucgacuucugguucagugaaauagucuaaaugucagaauuaaauauaugacuugcuacucgccaaagauccacaauauauucacaccagauagaccaagauuaacucuccuauaaagagaaaaaaaauuuuuauuagaauugguugccaagcauuuaaggucuuuuucuaauaacaaaaaacuuuaugaauaauacauguuuaacugauauuuaaugugauucugcaaugaauuauguuauacaugguuuaucaggugaauuccaguaacaguaauuacuuucuuaacuaugccuaaaacccaaauuuagaauaaauagauuuauggaguguugacaguuuuucaguaaacaagaacuauuacaccagguaauagcuaacagaauaauuuuaacaagcaagauuaaaguaaaaguaucaauuguauuuaaaagauggaagauauggagaugcuagccucucagagaacuguauuacuugauuugaauuaggaauuuacuaacuacuggggauacuuuagugaguuuucauauguguauuaguaauacauuaaauccuacuacauauaacaacaacaacaaaauacauauacuucucuuccagagaguaguaugacuguauucaaagucugagggaauaagagggcuauaagagaaagaaauuacucaccuaacaaaauaaaaaaaucaacagauaauaucugaaacugaagaaucaagagagcuguauaccucuauuauuuggaacuaugagaguaauaacugaagaaaaagccacuuggggaauacaguccacuucgagaagcagacuuggggaauacagggaauugcucauuucugucaugaacuuuuagcccucuaugacuuuuaaaauuauaagaauguauuaacuuugauaaaaagcugccaaaaaugccuuucgaaacagguaauuuuuaucaacuguauuuuccauuucuucauacccucacugacacuacaaauaauaucaaauuugacagaaaaaaaaguuaauuuugacuuguuuguacaugagucuaagcaucuuuuuguguuuaggagcuguuugcacacuuuaugaagaaaucuuucauaccuuuguccauuuuucuaauaaaaucauauauguucuuuauauauaacaaauauaagcuuggauuugcuauauuugcaaacccaauuacuacugcucauauuauagcagaauaaugcuuucaguuugucauuaacuuuaaacuuuacagugucuuuucccaaacagaacauguaagucacugugcagucaagucugucuagauuuuuuuuccuuuugcaaguagaacauucaucugauuccuguuacugcacaaauaccugacauuaaauugauaauguauuuggaucaaucuguggguuuauggucauaaauccaaauggacuauauuugagccacucacuuauuucuuuuaaguuauaggaaaguuuuuaacuauuuguuuuaggauguauuugaaaaaauauucauguucgaaagguuaauaauuuccaagcuuuuccccgaguuuaaaaacacuaguuuuagucuaaaaugcuuaauuucccauauauaaguugcucauuaagagaauauagcgcuuuaaaaauuguaucaauuucuuuuggccuuucaguaaauuucauuacauuucaguaaaugaaaaagugcugcuccacuaagcacuuuuucauuuuaaagcauaugacagaccguauauggcacucaaaccucaugcuaucaugacaaaccauuuaugcaucaaaauaucaauuuggauccacagaggaaaagauacauuuucaauuagaaccaaaaauuaauugcuuauuuauauuauacagguuaagcaccuauaaucugaaaauccgaaaugcuccaaaacccaaaacuuuuugagugacaucaugaugcucaaaggaaaugcucacuguagcauuugggggauuuuuagauuagggaugcucaguaauuauugcaaauauuccaaaaucggagaaaaucaaauccgaaacacuccugguuccaagcauuucagauaaagaauacuugaccuguauuaacaacauggaauaauaacaauauggaauuuauaucaaauuccauauuccaucuaauauauauguguaaguauauuuauaaccaaacauuccuagacauuuuagggaaaauuugacaugggagaauguccaagauaugccauaagccuaaaaauuagaucauaaaguacuauguuuggauacaauacauuuuuaagcaaaagaaacaaaaauaaagccagguggaguggcuuaugccuguaaucccagcacguuagaaggccaaggcagguagaucacagccugggcaauauagugagauacugucucuacacauaauuagaaauuaguucuaguuuauacacugcuguguuauuuaaauacuuaucuacugaguaugcauuauuuucauaauuuaaaaauaaaaaacccuguuaguuuagaugccucaauaaaguuaguuuccuaaucuuucuuacauuaaaaaauauaugauaaaagaagcuaauagcugggugugguggcucacaccuguaauuacagcacuuugggaggccgggcaggcggaucaccugagaucaggaguuugagaccagccuggccaacauggagaaaccccgucucuaccaaaaauacccggcaugguggcgggcaucuguaguuccagcuacuugggaggcagagguugcagugagcugagauggugccacuguacuccggccuaggugacagagcgagacuccaucucaaaaaaaaaaaaaaaaaaagcuaauaaauguucauauuuguuuacacauuuuuguucaugucuguuuuaaucuuuacauccgauauauuuaaggagcuuugcuuucucuagagcagugcuguccaauaaaaauacaauaugauaugaacugcaaaugcaagccacauaauuuuaaauuuucuaguagauaccuaauaaacaggugaaauuaauuuuaagaacauauuucacuuaacuaaaucuauccaaacuagcauuucaauauguaacaaauauauacaauuuuuaaggaguuaucuuacuuuuugggggcugugucuuugaaaucuguuacacguuuuacacuuuagcgcaccucaauuuggucuaguccugcuucaaguguucagugccacauggggcugguggcuacugugcuggauggcacaguucuaggacacguauaaacucuaaauuacaaacaggaugcuaucuaaaacuuaaagacgcaugcauaucggaaguggaaaugaccacaaucccuucugcuccaagcccauccccccuuuuuuuuuugcuagccuuagguuacuuaguauggcagagcuggacccagaacccagguuuuccgacucccagaucaggcacuacaaauaucccuagcuuuagcuggggucuacuuauuucaugugucauuugauacacuaaaauuucuaaucaucaaaaugacaauacuacaauuuugaauuucuugcaguaugugagcuuuguuaccaaguauguaaacgauuucaacugacuacuuuuccauuccaguuaaugauauuauggaacagguaccgacucugucucucuggaaguguaaacacuucgcagaaugcuuugugucugaaaugaaauggcuuggaaaaaaacagucuccagauuuuaaaaaaaaaauguuuuuaaacggcaagagucuaauuuuuaucuaucucugaauuauuccuccagggaacacaacuauaaugcuaacgauguaguccacuugccuuuuaccaauggguuccgaggaguuagcuaauggauugcccaaaauagcagagguagucugugacagggcugaagccauuaucuauuguucaauccauaaaccuucaguuacaugcugcugccuucugcagaaucuuaacauaggaagaaaaucaguaaauaacuacuuacguuuuuaaagcauaaguaccuacccaagcauuccugacucuuuggucuuuaugauguagagaaacaucaacaauguaugaaacauauuauuucugcccuggaacaaagacaaaaaagacaagauuuaaaccaaaugaaaaagauucaaucugguagguaaauacauaucuuaucaauucauauccuacuaacucagaauuccauauaauucagacuuucauuuauuuauuaaacaaaguaccuacgcuuugugcuaggaagugggaauacugcagugaguaagacagaaaggauacaugucaaggacauaagggccaguaggaaaggcagacaguaaacuaagaaucacaacaaagugugaggaaugcuaugagaggaggugccauaggaacauaugaagaugcagugucugauuuagacugguuagcgacagaaugccucccugagggaaagauuuuuuuuuuuuuuuugagauggagucucgcugugucguccaggcuggagugcaguggugugaucucagcucaccgcaaccuccaucuccuggguucacgucauucuccugccucagccucccaaguagcugggaccacaggcgcccaccgccaugcccggcuaauuuuuuuuuuguauuuuaagcugcaaccugaaagaugagcagaaagguaacauacugggggguggggagcugggggacuguguuucacacauggggagaaacacuuacuaaggucuggaagagccuggagagcuauucugagguuggugccccuguacacuacacauauaaaaauggucuauaauggcauaaacaaguguugggauaaaaaaagcuuuuagucauacuuuaaaauauaucagaauauacuuuagcauacaaauaacauauuaaauauaaauuuauuuuaucugcaagggaauacuaggcagcauauugcuagcucuaaaaucaaacuauuauauguaauuuuuggucuguaaaaacagcuccuaauuuagauuuucaauuuacagauuaacuuuuccccacuuacucuaauuuaauguguuuuuaacucaagaaucugagagaauguaugauuuuuaaaagauaauguuuacacuguaagaacaaggaaaaaaaaacagauggugguuaaaaaacaaagauuggcauggauauucacaagaacuucaauggcccaaaguauuuacauacaaagcuaaaauauuaaacuugaagaaaugaaauuaacaucucuuccugagaaucugauagacagcacaauuuauuauuauagccaauguaaaauuucuuaguaaagaugcugguaacaaaaauaauuguaaagguuaucaacagaacugaugcuuguaauuaagaguaaaaaaccaguguggcagcucaugccuguuaucaucccagcacuuugggugggcaaggcaggcggaucacgaggucaggagaucaagaccauccuggcuaacacaguaaaacccccgucucuuacuaaaaauacaaaaaaaauuagccaagcgugguggcacgcgccuguagucccagcuacucaggaggcugaggcaggagaaucgcuugaaccugggaggcggagguugcagugagccgagaucacaccacugcacuccagccugggugacagagcaagacucugucucaaaaaaagaguaaaaaaucuguaugugcuuguaaucuuagcuacucaagaggcugagucaggauugcuugaacccaggaaugugauacuagccuaagcaacacagcaagacuaccucaaaaaaaaaguaaagcacauuaauggaaguauaaauugauacaauaaccuuuauuauaaaguaauuugguaacauguuauuuuuaaagucuuaaaaauauuuugaccuagaauuccacuuuuagaacucuggacuaaagaaaugcagauagcuguaugcaugaagauacauuuucagcaguauuuauuuauuuuauuuuauuuauuuuuuugagacggagucuugcucugccacccaggcuggagugcaguggcgugaucucggcucacugcaagcuccgccuccuggguucacgccauucuccugccucagccuccucagcagcugggacuacaggugcaugcugccaugcccggauaauuuuuuuuguauuuuuaguagagacaggguuucacuguguuagccaggauggucucgaucuccugacuucgugaucugccugccucuaccuuuucaguaguauuuauaauaaaaaauaagaaauacagaaaauguacaacaguagagaaaugguugaauaaauuauacuagugaaguuuuuuuuauagccauuaagaaguauuuuuaggccgggcaugguggcuuaugccuguaaucccagcacuuugggaggccgaggugggcagacugccugagcucaggaguuugagaccagccuggccaacauggugaaaccccaucucuacuaaaauacaaaaaaauagccgggugugguggcgggugccuguaaucccagcuacuugggaggcugaggcaggagaauugcuggaacccgggaggcagagguugcagugagccaagauugcaccacugcacuccagccuggguaacagagugagacucuaucucaaaaaaaaaaaaaaaaaaaaggaauuuuuaugaagauuuuuaauaguauggaaaauuauguuauaaagcuaauauuuaaaagcagauauaaaacuacauaaauaauuuuagcccauaaaaaauauaaagaaagggccaggugcacaggaccagccugaguaacauggagagacucugucucuacaaaaaauaaauuggccagguauacuaguacgugcuuguaguccuagcuacuugggaggcugagguggaaggacuucuugagcccaugaguucaaggcuacaaugagcuaugaucaugccacuacacuccagccugggugacagagcuagacucugccucuaaaaagagacauaagaccaaaaugaaauuuaccaaaaggcaauauaccaaucaaaaaaucaacaaugacugccucagguaauggaaugagugauuuuccuucuuuuucuuuauacuuuccccaaauuaagcacauauuacuuuuauaguaagaaauauauauguaggaaacacauuuccaauuuaaaaaauuuacuucuucuauuaacaugagauuauaauuuuaaaaacaucauccaagcaaaucacccaagacauucuguaacagcaucuucucuauauagaaauaccuuuggcagguuguauacaugacgcugguagaugagcucauaauggggaggguugauagcacucugauaaaugcaaaaaacauucucauuuguaacaucuguaaaggaaggcaauaugcugcauuaaaaaaccaaacccccagagauauuuugugugaaaaucucaacacauucuuuuaggagagguuuauaccugguuuauuuggugucugaacaaagugcugagaaguaaaaguuuuuccgucgggauacuucggauguggagguaaucuggaaucaagguaggugcaaaauacaugcaugaugaucugaggaugaagaaauaauuuuuuuuuaagucagcaugaaaaucuagcauggauguagaacccuuuagaaacaucuguauuuauaacgauuccaauuaaaaaauuuuuucucugaagagugaauuagaaaaaugcugucaaaugguuagauuuacaagauaaaaucuauagaauaaaaagauaaaaacacauaguucagguagcacaccuauucuuuuaacugaaaguauuauuuccuacaaagauaaggaauucacuaauuccucucuuaaaucauaaaggaauucaguguguuuaagacaugaagcuaggcuuaauucaaauaaucuacucaaaauuuaaaauagaaaaagauauuugccaucaaaucagucuauauuuugaugagaagguuuccuuuucaaauugaaaaaguuugaauacuccagccuacgaaguuaccauaaucuguugaggguagggguggaggguggggcuuaaacaccagacucccauucccuacauauuugaucuucauuuuuaguuuuccauagcaacccuagaaaagcagggcauucuuaguuuuuugcuaaguggaucauucauaccaacacaguuaauagcaaaaccaagauaaaauacauucaauucucaaucugaaucucaacauaaaacuuaauuuucacccguaacagucacuauaaaaaaaaagcgaacauaauuuugaaaaacuuguaagcacacaaaaacauuuauguucuuugaucuccuaaauguaauucuaggagucucucuuaaagugacaaucccaagaaagaaagcaaugcgcaucacacuauuugcaugcugcauuacucaagaucaaaaaacaaguaaaaauuccuucuccaccacaagugucucaaacuuuuagguccacuauaggagaauaguuaaaugacaguguguaauaaugaaaaaauaucuagguaggaggaggcugaaguaaaaaaaaacccuaaauauuacagaaguggaaaaaaagcagaauacauaauuuuacauaccggagaauuacaaauaugauaaaaacauuaaaaaauaguagccaccaaguaaagggaaaaaauacacaaaaauauuaacagugguugggugaacaugcugauacuauuauaaauaccuuauuuucuaaauuauuuuuaacacuuauucuuaugauaggcaaacaaaaacacauaaauccaguaauggaaacugaaaaaaacaaaauaaaucuaagggucaggcacaguagcucgugucuguaaacccagcacuuugggaagcugaggcagggggaucacuugaacccaggacuucaagaccagccugggcaaaaaagugagaccccaucucuacaaaaaauuaaaaaaauuagcuggguguggugguucaggccuagucccagcuacuugggaggcugagcugggaggagcacuugagcccugggagaucaaagcugcagugagacgugacugugccacugcacuacagccugggugacagaguaagacccugugucagucaaucaacaguaaauaaauaaaugaaugaaagaaucuaggggcuuacagcagaaucggugggcaggucuguaucccacuuucguccuuugaagucgccaccucuguuccaucgaaaugagcucauacaaccucccugagauaguucuguggcaacaaggugaaauuuuuaaaagcuaagaguaugcaaaaaagaaaagaaaaaaaaagcuaagggaauauaauaagggaagcaaaucauuuaaaaaacuugaucaaaacacccaaaccuaaagaaauaaaagauauaaaaagacaaaaguuaaacaugucccugaagacaucagauaaauccaaaaugugggauuuuagauuuaucugacuacuauuuuggcuucuuaaaaaaagaguugauggguagggaaaauuugaauauggacaauauauuaaauaucagaaaacuauuauuuuuuaaagguauaauuguauuaugguuaggagaauguucuuacuuuuaggagaaugcaugcuaaaaaguaaugucugcaauguacuuucaaauggcacaacaagaaaaaaaaguguguguguauauauauguggaaagaaagaaucaaauaugucaaaagguuucuaacuauccaaucuagaacaagacaguguucacuguauucuuuuuuuuuuuuuuugagacagagucucgcucugucacccaggcuggagcgcaguagugugaucucggcucacugcaagcuccgccucccggguucccaccauucuccugccucagccuccugaguagcugggacuacaggugccugccaccacgcccagcuaauuuuuuuuuuuuuuuguauuuuuagcagagaugggguuucaccguguuagccaggauggucucgaucuccugaccuugugauccaucugccugggccucccaaagugcugggauuacaggcgugagccaccgugcccagcccacuguauucuuuaaagcuuuuuuguauauuugauauaaaaccuuuauauacuuuguauauauguguacauacacagacacuuucucuuuuuggauguacaaauacccugcuaacuacaaggcaaucuugccaaaaaacucaaacaugaauuuaugggaaagagaagggguuauguaaaacuacaccauagggaugcauucagcaaaacccacacuaugggaaccacuaaagacaaacaauccaguucuucugacaaauaaauugcaaaggaaaaaaaaaggugaaugggaagcauauagcuuaaaauaaacugaaauaaccaauugcaauguauuacaauauuugaaucccaauucaaacaaacauugccaaaaaauuaugcauuuuuaugagauagcuggaaauuugaacacagacuuaauaucucauaacacaggaaauauuagggccagguagcaugguggcucacuccuauaaucccagcacuuugggaggcugaggagggaggauugccauagccaggaguucaagacugcaaggagcuauacacuccugcacuagugccauuacugcacuccagccugggugacagagcgagccgggucucaaaaaaaaaaaaaaaaaaaauuauauuaagaaugauaauuguggccaggugcagugacccacgccuguaaucccagcacuuuaggaggccaagguggguggaucacgaggucaggaauuugagaccagccugaccaacauggugaaaccccaucucuacuaaaaacacaaaaauuagcugggcaugguggugugugccuguaaucccagcuacucaggaggcugaggcagaagaaucgcuugaacccgggagguggagguugcagugagccaagauugcgccacugcacucuagccuggcgacagagagagacugucuccaaaaaaaaaaaaaaaagaaugauaauuguauucugguuauguauguuuguauuaguuuucuaaaggcucagcugggcacgguggcucaugucuauaaucacggcacuuggggaggcugaggugggaggacugcuugagccuaggaguuggagaccagccuaggcaacauagcaagacccuuucucaaaagcagggggucgcgggaggcuuaucuuuuagugauauacaaagaaauauuuacagaugaacugauaaugacaugagggcuugcuucaaacaauacaggaagaaaguggacgggguauggauagggcagggucuggccagggacuagugauuguugaggcugggugauguguacaagaggaguguguauacuauuuuuucuaguuuuguguauguuuaaaauucuccuuauauaaaauguuuuaaaaagucaugaaaaauguuuauuccugaauccugcucuaaccuuaggggaaagggagaacacuauaauauuuucaaauuaagauuuaugaucaauuugaauacuauuucuaaaacuugucuuagugaugagaaucuuuuaaaaaguuuauccaaauuuuaaaaaauucuaacguuaugaauugcucuguaaguagagaggcacagaggguguaugggggugucagggagccuacauuuccugauucucaagucagucuccucaggagagcacaucuuccaccaaauaauaagaauaucacagaaauauaaggaagaaacuuauuaaauaggaauuauaaaaauuaagagaaauaaggcucagcacaccggaacuauaaagaaugucauaauggcacccauucuuaugagucuaaaaguaggaaaugagugaaauagucacuggagcccauuuagcucauauuuaaguuuccuacacaaaauaaaguuauuaagcuauaauuaauacguauuuauaagacauguuauacuuuuaauuaaaaguuuuuccuuguuaaucuucacugauaaaauuccagcauaguaaaaaagcucuuauuuuuuucucuucaaaucaauaauuaccuuugauccuuucaaacaaguauuccugauuuggaguaaggucuagauacugaacgauuguguucaaagucggaaugagaggcgcuuuaaccagggcagcuuguuucaagcuaguaauacuagccucuguuaacauaaaacacagagaacacugauuauucuaaaagugaguuuccaaaagaacuuaaaaugcucuucucauguguucauacagcugguuccucacuaccuucaggucuucauacaagucaaugacgucuccccugacgacccuaccucaaauuucaccccuccucucuaaacauuaauaacauuacccuccugugcuuuuuuccuccuuagcacuaaccacuguccaauguacuuuuuuucuucuucucuuuuuguuuuuugagacagugucuugcucugucacccacgcuggaguauagcggcacaaucaccacucacugcagccucaaucgaaugggcucaagcaauccuccucccaccucagccuccuaagcagcugggacuacaggcacaugccaccacaccugguucacuuuuuuucuuuuuuucuauuuaguagagacaaggucucacuauauugccuaggcuggucucaaacuccuggguucaagcaauccaccaacgcuggacuccccaaguguugagaucacagguguuagccaucgugccuggcccaaaguacuuuaucuuuuuuauugucuaucucauuuacuagaaugaaagcuuaaugaaggcagggacuuuggccauuuugcucacugcuguaucccccagugcccagaauaguauuaacaccuggaacagacuaggcacucaaugucgaaggaauaaaugaaagaaagcauuuuaauuugcacgaucuacauuaccuagaaccauucccagcaagauagccagauuuacacaugcaacacccccuccuccccuuccccagagaagcagccaaaucgauuuuggcaaaucuauaaacaacuaauauacagaaaauuuguauaagacauguauaaaaagacacacaauuguuuucaaaauaaguugaauuagaaguugcccauuaugccaggacaagcagaagcuuuuuaugguagugauuucuuuuaucauauccugcaagauaacuaugcauagaaauguaaaaagcaauuaaaaauuucaaaauauccaacuguacuagcaauauccaauguuaggaaaaacauuccuauaugugucaugguugcuagaguacaaacugguaaaagcuuuuuggagagauguguaucuucuaagccuugaaauauauccagaugcauuggcucaugucuguaauccuagcacuuugggaggccaaaguggagggagugcuugagcucaggaguacaagaccaaccuggacaccccaucucuacaaaaauacaaaaaucagccaggugugguggugugugccuguagucccagcuacuuggaugcggcugaggugagaggaucucuugagcccaggaggcugaggcuguagugagccauaauagcaccacugcauucccucuugggcaaaagagcgagacucugucuagaaaacaauaacaaaaaucuuaaaauauucacaccuacugacacacaagucuacuucuaagaaauuauccuaaagaaauaauuacaaauguauacaaagauuuagguaagaggauaugcaccguagcauuauugguaaagguaauuacuuaauaacuaaguuauaguauauauauuuuaggcaauuuauauggcacccuaaaauuuuaccuuuagcagauaagagaguugaaaauaggugauggaaaauuacuauuauuacauagucuuuaugcuuuauacaacuuugugauuaauaucugcuaagagucuugggcuuauaucuagaauauauaaagaaaacaucuaccacucaacaaaaagacaaauaaccaaauuuaaaaauggguaaaggaaucaaaaagacauuucuuuuuuuuuugagacaaagucucaaagucucgaagucucgcucuugccccccagacgaucucggcucacugcaaccuccgccuccaggguucaagcgauucuccugccucagccucccgaguagcugggauuauaggcgccugccaccaugcucgguuaauuuuguauuuuuaguacagacgggguuuucaccauguuggccaggcugguauugaacuccugaccucaggugauccgcccaccuccgccucccaaagugcugggauuauaggcgugagccaccgcgcccggccaaaaaagacauuucuaagaagauauacaaaugacugauaaacacaugagauguucaacaucaguagucaucauggaaaugcaaaucaaaaccaaaaugagacaucauuucacgccuacugcaggaugacuauaaaacauaugacaaguguugcaaggauguggagaaagcagaaccccauacacgcuggugggaauguaaaauggugcagcuaggugcuuuagaagagucuggcagugccucaaaagguuagucagaguuaccauacagcucaacaauuccaccccuagguauauacccaggagaaaugaaaacauagguccaauauaaacacuuguacgugacuguucacagcagcauuauucauaagagccaaaaagugaaaaccaccuaaaugucaaucaacugaugaaugaauaagcaaaguguaguagaucuauuuugaauauuaugcagcaauaaagaaaaugauguaaugauaaauucuacaacauggacaaacuuugaaagcauuaugcucagugaaagaagccagucacaaagucauguucauauucugugauuccauucauaugaaauauccacaacaggccuaucuauagagacagaaaauagacuggcacuugcaaaggacugggagaaauguauagaacagggggugacugguaaaagguggagaguuucuuuuucaggugaugaaaugcuuuaaaacugacuauggugaugguugcauaacccaagacuuuggacuguacauuuuaaauggguaaauuauaugguagcuaaauuacaucuugauaaagcugucacguuaaaaaaaaaucaaacuagauuauagacauuugggguuuuucaccccaagguaacaaaauaaguuaagccguccauuacaagaaguuuuccacuugguagauuuacuaauagaaauccaacacugggcucuguuuucacauaccuccuaucuguagcucuggacaacccauucgucucaucugugugcugacagacucaaucucuugaacaaguggcacuaauauugucucauugauccacuagaagaaauaagguacagauuuuggauacauaauucccaaguagcugucaaauaauuacuuucuuuuuuacaagcaacucuaagaauuuuuuuuacuaucuuauaguugaauauuaaaagaaucauaaaguauagugaaagagaaugaaaguaauagcuacccgaaaucaagagaugguuaaauaaauaugccacuggaguguaaauuaacuaacuuacauuccuuuuuuuuuuucgagauggaguuucgcucuuguugcccaggcuggagugcaauggcgcaaucucagcucacugcaaccuccacuucccaaguucaaaggauucuccugccucagccuccugaguagcugggauuacaggcaccugccaccacgcccaguuaauuuuuuguauuuuuaguagagacgggguuucaccauguuggccaggcuggucuugaacuccugaccucaggugauccgccugccucagccucccaaagugcugagauuacaggcgugagccacugcgccuggcaacuaaauuacauucuuaaauaacauguuuuuauuuuuuuuccugaaaaaaaaauauaaaacuuuuagcuauauguuaaauuuuucuuaaaauuuucugauuauuauguuuagcuaaaaggauaaucuucaguuuacauuuguaggguaacuauucacacauuuauuaauguaguguuuauauugguuugcaaucaguaagauaguuuuucaaacuaacauaacugccuaacucucagcaggcucacccaauucccuaaccauguggaaaaacagagacuuauuacauuugaaacuggcuuuugaauauuacaauauuacuuuaggacugggacuuucaaaugccuuuuccauggcuaauauaaaacuaaugcugggaugugaaaagacuaaggauacaucccaucugguuuguguguuauuauuuuguguauguguuuguagcaacuucaauuaccacuucuguuuccaugcuuuuguuuauccauaaaauaaaaggaugaaaaaauguuuccaaugaaauacaauauuauaaacaacugaaacaaaaaccuucugggaacuuaaaagauuucuuguaauccauguaaggaagcaaauuuugauauacuggcaagacuugaacugaauucacaugaagcuauuuauaggcuuuaucccacugagugugacuauucauauguuuuucugcagaaguauuaaugugguugauuacugaguguuaacuagacucugguguuauaaauuauacgguacagguauacauguauugcuuaaaaaaauccaaaaacucuaaauuuuauagcacauggucaccuagggacuucagaugaggaaauguauuuguauuucuucuaaguagcuaauacucugucugacuaagacuucauauuuuaaacauguuagcauuuuuagacuagccuauaacagaaacuacaacaaacuccaguuucaggagaugauuugacucauucauccuuccaacauuuacuacaugcaucuuaauuugccagcugugacaaaugguacaaaagaguacagcuguacucuuuggcuguaacaaaauuaccuaacgugucccagagagaggucuaggccccacccuuauaaauucuaauugaguaagucuaggauuggguucaggaauuauccauaaaaugccauccagguuucuguuucaauaaaguaggcuaccauuuuuugccccucuauuuugaugcccuauuuaaauaagaguaaaaggauaaaaaaugagcacaagugauuucaaaauaguucuagaagaugcagaguggauggaugaauguugaaggaugaaacaacagaaguaguagccccuucagagcuaaguggagcuccguauaguggaaggggaaguccauaugccuaacagaacccagaacacacagguacuagagaaggugggaggaagacguggaguuggaaauagggaacucacucacucuguauauggaaaaguuggcccaagauuagaggguucuucucuagaaaaacagaaaucauaaucuacuuugaaauagcuucaagcauauguugucuuaucucucuaacucuuuaaguuuucugagggcaaggaccucauuuuuguuuccccucacaauucuagguaaauaaaaggcuccaauagaaaagcucuuuggaaaauaaaacugagaacugaaaagggaggaucucaauaacuaaacauauuauuccuuuaucuucucaaaacauaacaauucacuaaauauggaggaagaaaaaaaucucaugaaaauaaauaccauauaguaacagucauguuuauccuuauauauguaccauucauacuguaccuuuauaacuaauauucuaauuuauaaugaacucuaaaugauauucuaauaacaugcuuugcauauuaagaggcacuaauauuguccaaagaguaaugucagaacuuacauuucuaaauuuagcuguccaugaauccauaugaucaagaaguugucuauucauagccacucuugcccagaccuauaaaaauucauguuuaaaaugaacaaucagugaggaaaaaucuugauagaaaucaucauucuuucucccauccuaaaaaauauuuaaugaacuuugaaaaaaaauuucccaaacaucaauauucaucuaauuaauauucaguaauuuucuuauuacucacuuauaaaugcuguucacacacagauuuaucuuuaaaaguuccuuacauugguauguguaaagaacauuuuucuugcuuuuuuuuuuuuuuuugagauggagucucucucuguuguccaggcuggaacacagugacgcaaucuuagcucacugcaaccucugccucccagguucaagcaauccucccgccucagccuccugaguagcugggaccacaggcacacgccaccaugcugggcuaauuuuuguaacuuuaguagagacaggguuucaccauguuggccagauggucucaaucuccugaccucgugauccacccgccucugccucccaaagugcugggauuacaggcgugagccacugugcccagcccauuuuucuugcuuuuaagaacaaaauaaaaauuccauauuugguauuaaagugacgaaauuacugacaaauauucuaauccaaauauauuuuaaaagcaagacuucuguauguguuaaguacaauuauauaccugagagccuuuuuauaaucaauguaaaaauauguuucaggcagggcgcuaaggugaacugugugucacagaguaaaauguaugauauaauuuaguuuuuaguuuuaggcacacaaaguaagacaggagcuuucccacugccuaaugugugccagauuuacauuucuguccaacagaauggaagauuacagaaaaaauguuccagaaguagaagacuuucuaacaaugcauaaaucauaaauauuaagucacuuuuauuuuccacuuaccucuucugcggcuuguuuagagcugagaucggcuucaucuuuguuagcacauggggccugagaccuacaggcaagcugauacugaaacuucuuuaaaguuugugcauaaucccccauagaacgacuauaguuccagaaaguaggacugcuggaaggagagguagaaucugggcucccuacaauuguuaagauaaacaguaucaguguguuguagcaauucugacaucuacaguuaacacuuauaucuaggcaauggcaauccaggaaucagaagaccaacccucaaggagauucucuucuccccaacauaauuuucucuuuagagaucacagucugcuugugauuaaaaauuuuaaauaguauuuucugagccauaucaauuuaacagucauaaaaacaauaagcagucaaaggcaucugucuaguucuguugaaaaguuaagcucguuucauucucuaagacuuuuaaaucauuuaguaagaaacaaacaaaagacaaauuucuuuaggaaauaaauaggccaagcaaguucuuuauuugaaauuucuagaagcucuuucuaaaagggauaacuauagccuccuacuaaaagauuacucuccugguaacaagcuaaacuuauuugucccuguacuucacuguguuuuacuuaacagccugugguaauuccugaguuguacuaaaagacuaucugaugguuauccuucuaaauuuauaaauuuacuuuuaagaaauguaaaaaaaaguucuauuuaggaauguacuccuacagaggccucugaaccaggauauuaaucacacuuccggguuauaguuuuugucuguuuucccaaauagaauuugagcuccuugaaagcagggagcauuuuuuuucccuagcaucuagcauagcgccugaauaaauaagcaaguuuuugacaacaauuauaugguauuuaugaagggcuuauauuuucggaguuuaacugauauaaaaaauaucaauugguacuuuauacccucaaacaaaacuuauaaauagaaacaauuuuuuuuaaucuuagcagaauucuaaaaggaaugacuagaaaauaauaaaacucauuuuccuuaugcuuacggguacaaagaauuaggaaucaucaaacggguauguagcaauauaauucaucaaaauuuugaugguuagcuaguuuuguuagcguuggugaauguuucaugcuggcauaaaaaguuauauacaguaaagaaacaucacacuguaugaaauucuggcaaaacugacuuuaggaaugaauuaaugucaagaaaagcaguugucaaccaacauaaaugauuuaauaaauagagaacagaaauggaaaguaaaaacauggucauaacagagcauaaaguuauccuauuugauuaaucauugcgauuauuaacuuuaagaaacguaaguuuucuaugaaaaaacuuguauuugaguaaaauuucauugaggacuggcuuuagacaaugaauagaaauaggaaguucuaguaccucugggcauuagucaaagcaaagaaaaaauguacauagcaaguaaugacaaaauagggccuuuccaugaugaacaccaccaucaccaccaccaccaccaccacaacaacagcacacaaucuauagcuggagaaccucaaagaccuaagagucaaagcacauggagauuuggaaaucugggcaacacaggaaaccagacaaccuaaaacaucucccacuauaaauaucuaaaaacauuuauuaaauaaaauacauucuuuaggccagugcgcgguggcucacgccuguaaucccagcacuuugggaggccgaggcgggcagaucacuugaggucaggagcucgagacaagccuggccaacauggugaaacccugucucuacuaaaaauacaaaaauuagccagguaugguggugcaugccuguaaucccagcuacucaggaggcuaaggcaggagaauugcuugaacccgggaagcggagguuucagugagccgagaucaccccacugcacuccagccugagcaacagagcuagacucuaucucaaaaacaaaaaaaaccucgaucucaaaaaaaaaaacaacauuauuaagaugaauaauggagcuugcaaaaaaguaaggcuaugaauagccagugguuaaaaaugaaaagagaauuaaaaaucuaaauagccuguaagaggcugcuguggcguggcugcucuagagaauuuuguaggccuugagaaaucuaucagcuuggauucauugcccaagugggaaacggagauaaggauuugggcccuuaagaggcagagaguugggcugacaccuuucuccuaccccuagucccugguccugguagaggaccaggaaucucaaagggccacauucagaguagauaagaaaaaaaucuguucaaugggaccaggagauaaugaaagcuugucugucauagguuguugggagacuuaaaaaaaaaaaaaaagaaaaacaacacccugagauuuaaaaauuauagauauaucuucacauggguuuagagugcccauuuauauuaccugugagguccaggaaucuccaagcuuagaaauuacuuaaguuagcucaaagucaauaauacuccuaaggcaccugacagaggcaaauacaaaacagcuaggaagagacaaggcuuccauccagccaagauaagcuuaccagaaacaaacagaaauuacaucaaucacaaggaaacaagacugcaguccuaacaaccaacaagacaaaaauggucaguauuuaaccuccaagaacuuuagauaauugaacuauuggacaaauaacauuuaaaaaguguguuuaagcaacugagauagaaaaaggaacugaaaacauaagaauaaaaaauauucuacaaaaaccuggcauaauugaaaaggaccaaauaaaacuauaaaaugagaacaaguggcugaaauuaaaaaacucaaugaauuaguuaaauaacaguuuagacauuacuaaagaaagagcugaugaguccacagugacuaaaccaaaaaagcugggguggggguaaaacagaaugcuccucuuuagagaagaaugccaaacuaugaaguguagaaauaaauaauuagaaaaucuccacuuuggccaggcgcagugacucacacuuguaaucccagcacuuugggaggccaaggcgggcggaucacaaggucaggagaucgagaccauccuggcuaacauggugaaaccccgucucuacuaaaaauacaaaaaauuagccaggcgugguggcaggcaccuguagucccagcuacucgggaggcugaagcaggagaauggcaugaacccgggaggcggagcuugcagcgagccgagaucacaccacugcacuccagccggggugacagagugagacuccguaucaaaaaaaaaaaaaaaaaaaaaaaaagaaaaucucuacuuuauaaucaccacuuuaucaaggacaaggaucaucaacagaugcuaaaaucacuggguaaaaggcuguuaaggaaacaggacauaaagggaaaaucaugaagaaauccaguugcuaucaacuuaaccaagugauccuauuuuauuauauauuaccgacaaagagacaaagcagcaucacguaucuccugaugugauacacugaaaaggacaugccaccacccauguuguauucuugccagaaaauaauauuuaaacggaaucuaacaguaacaaaaugaucaaacaaaucugaauuuucaaaacaacagccucaucucuucaaaauguaaaugucauaaaagaaaacaaaacaaaaaaucccacaaaacccacacuauccaaaugguuucgauuuaaggagacaacagaagcacaaguaaaugcaauaugugauaccugauuggauccugcaucaauaaaagaaaaaaaaagcacuacaagggucaguauugggucaacuggggaaaugugaauaugaacacccauaguaucuuaagcaugacaaucauauugucauuauucauuuauuuauuuuuucuuugagacagagucucacucugucacccaggcuggagugcaguggugugaucucgguucacugcaaccuccgccucccggauucaagcgauucuccugccccagccuccagaguggcugggauacaggcucgcgucaccaagccucgcuaauuuuuuaguagaggugggguuucaccauguuggucagaaaauccugaccuggucucaaaauccugaccucaugauccaccugccucagccucccaaagugcugggauuacaagcgugagccacugagcccagcccauauuguaguuauaaaggaagaugucuuggucuuaggagaugcaugugaaauauucaggaaugaaguggaaugaugcccgcaacuuccuuucaaaugauucagcaaaaaagugugcaugagagagagaauaugagggccugguuuuucacuacuggagaaaguuacaaauacgaaaaguggggaggacagaauaaacuguauagcuggacuggaacuagaaguaacauuauaaacucaugguuuuuuaaaaacauagaauaacacauauagauguguguguguacauauaucuguguauauguccauacaaauauuuccuagaggaccuggaguaaugauaccucaauaauaacagugugcccagugcccagauaauaauuucuaaguaucauucuccauuaaaaggaaucagggcucuuagagaaacagacugacucuggagcuagccagggaaaacacaaaaugagccugaccuauuuuguggugcuagaaagguggcgcgggcagggggauuagcucaaagaaugauagugucaugucaaaagaacagagaagucagcuuacagaggaucccacuagcccaaucugagacaaucaaaucgucaacauaagugaaugauuagggagaagaaaccuuuaucuuacagaauaccaacaaauaaauguaaaaggcagcugcacaauaauguaaauguacuuaccaccacuuaauuaaacacuucaaauggcuaauauugggccaggcgcgguggcucacggcuguaauucccagcacuuuggaggccgaggcgggcagaucaccugaggucaggaguuugagaccagccuggccaacaaggggaaacccugucucuacuaaaaauacaaaaauuagccaggcaugguggcagaugccuguaauccuagcuacuuggaaagcugaggcaggagaaucgcuugaaccugggaggcagaaguugcaguaagccgagaucgcaccacugcacuccagccugggcgacagagccaagacuccaucucaaaaaaagaaaaaaaaaaggcuaauauuguaaauuuuauguauacuguauuacaguaaaaaaaaaaaaggaaaaauguuaaaggaauaaacauagaagaaaugaugaaauuggaaagcuccaugacaaccaacauaguaauaauuuugaaaauaaucuuaaaaggauguuagaacuaguaagucaaaguuugauggggucaggcacaauggcuuacgccuauaaucccagcacuuuuggaggccaaaguggguggauugugugagcucaggaguucgagaccagccugggcaacauggcaaaacccggucucuacuaaaaacacaaaaauuagcauggcaugguggcaugcaucuguagucccagcuacucaggaggcugaggugggagaggcaccugagcgcugaauucaaggcugcagcgagccaagacugcaccacugcaacagugagaccuagucucaaaaaaaaaaaaaaaguuugauggggaccaaauaacuauauaguuuuagaucaguagcuucccacaaaauacuuauuaaucauuuauuaauuugcacaaaauacuuaauuuucgaaaacccauggguauagaagggcuaaaaguauagggauagagauagauauaccagccagauacuaaccaaaaggaaauuaauauagaugugucaaugucagacaaaauagacuuuaaggcaaaaagccuaagagauaaagauaaguggcauaauucaccagaaugauauucacaauucugaauuuacaugcauuuaacguaaucucguauguauacuuagcaaaucugacagaauugcaagaaaacauuuaauggaagacaaucaacgggagcuuuuggcacacuuucuuaauaaccaauagauaaagcagauaaaaauuaguaagauaaaguauuuaagaauaccaucaagaagugugacagugaacaaauauagagccccaaauuuagagacucugcauucuguucaauauaccaaagccauuuacagaaaagugaucacauaguagaccuaaaagcaagucucaaacaaacaaacacaaaauugauagguacagaucagauucucuaaccacaguaaaauuaacuuaggagaaaaaaaagguaaccaagccuuuucaggcuugaaaauuaaaagcaacaccaauaacacuuccaaacaauaauaauauuacuucuaaauagcuccuacugggauaaagaauaaaagugaagucagaaaauaucuggguauuacaaagaugugccaaggauacauagguucuuuguauuauacucuguauuaaaguuucaguagacucaaaauauuucaaauuuuuuucaaaaagcauguaucaaaaauaagaagauaguauugacugguuucuguaacaucuguggcacuuucaggcaaaaugaaauuagaaaucacuggugagacuccaagcgacacaaagagucaugguccaauaaccggcuuccucgccacagcugaguauuagcgccuaauaugcuuucgugaaaguuccugacgggggaaaaaucauuacucaguucaauaaccuaauuugguuucaaauaauugacucuguaauaaucaaauucaccccaaacagauuaagauuugcuaacacucuuucccaagguaaacuauaggcuuucaggaaauacuaaaacgcaaguuuuaaaauguuaugaaaaacagcagcgcuucucgaguaaauacauguucucucuuucagccugcucugccacaccaaccuuccaaaagacuacuugaaaagagacagcuauaauuugaguaaguucacuacgcacugcuucaaaacauuauuuuguagccucaacuuuaaauagaaauuguaacuuacauuauacgaaaaagcuuucaaucuuauuguagguuugagauuucuuaguuuagcuauauuucacuuccuaaauuuagugaacuuaauucuaacugcauaaaauaauguuacauauaaaguaaaacaaaacaugcuaagcuaauaaaguauguuaguauggauauuaaaauaaugaaaauaguagguuaaggauugacaccaaaaauauguauaguagauauacagaaauauauauguacccagcuuaacccuaugcuguuucuccucuucacuucugagaaaaguauccaaaguucguaggucggucauguagucuucuuugucaguaggugaguuguagacgguaggugaagaacgguagcgagaucucaauccacugcucuccacugguccaacagugguaggguacggagaaggaggagaggggcuaaagcucgccaacuauacaaaauaaaagaucuuuacuuuauuuuucuuuaauugaaauucauuuuguuuugguuuuugacuuaaguaaaacaccuaguagaauggcgaaaauccacaauacugacaacaucaaacgcugaugagguuguggaacaacagaaucucucauucuuugcuggugggaaugcaaaaugauacagccacuuugaaacagucuggcuguuucuuacaaaaguaaauauuaucuuaccauacgaacuaguaauugugcuccuuaguauuacccaaggaguugaaaacuuacggccacacacaaaccuguauguuuauggcagcuuuauuccuaauggccaaaacuugaaagcaaccaagaugcccuucaguaggugaacgaguaaauaaacuggcaaaauuagguaauggaguauuagcacuaaaaagaagugagcuauugcugggcacgguggcucacaccuauaaucccagcacuuuuggaggcugaggugggcggaucaccugaggucggugaccagccugaccaacauggagaaacccugugucuacuuaaaauacaaaauuagcugggcgugguggugcaugccuauaaucccagcuacucgggaggcugaggcaggagaaucgcuuaaaccccgggaggcggagguuguggcgagccaagaucgcgcgacugcacuccagccuggacaauaaaagcgaaacuccaucucaaaagaaaaaaaaaaaagugagcuaucaagcuacgaaaagacauaaagcaaucuuaaaugcauauuguuaagugaaagaagccaauccgaaaagcuacacggguaugauucuaaguacaugacguucuagaaaaggcaaaacuauggcggcaauuaaaaaaaaacacugguuaacaggaauuuggaggaaaagaugaaugaauaaauggugcaguuucauucuguaugauacuauaauugugaacaugucauuacacauuuguccaaacccauagaacguacaacaccaagagugaacccuaauguaaacuaugcacuuugggugauaaugacgugucaaugcagguucaucagcuguaagaaauaaaccacugugaggccgggugcggugacucacgcuuguagucccagcacuuugggaggucuaggugggcgaaucacggggucaggagaucgagaccauccuggcuaacauggugaaaccccgucucuacuaaaaguacaaaaaaauuagcugggugugguggcgggcaccuguagucccagcuacucgggaggcugaggcaggagaauggcaggaauccgggaggcggagcuugcagugagccgagauugcaccaccgcacuccagccugggugacagagcgagacuccgucucaaaaaaaaaaaaaagaaauauaccacugugaggggguauacugaucaugggggaggcuaugcauguuaggacaggggauguacaugagaucucuugauuuugcugugaacucaaaacugcucuaaaaaauaaaguccaucaaaaaaaaaaaagguaacucauggagcccaggaguuagaggcuauggugagccacgacugugccacugcauuccagccugggugauaaagagcaagacccuaucucuuaaaaaaacaaguaacacaugcauauuuuuaaaaauagaaaguauaaacaucuguaacuuugccacccagagauaauauaauccuuuuucauauuuuauguauuuuaaaaucucuaaaauauacauagcuuugucaauguuacaaugaagauagcuguacauaaaucuuugacugaauuucugauggcuucuuuaacagaugccuaaaacugaaauuauuuggugaaagcauauuaacauuuacuugauauacaagaauuuuaaaaauuggacauuuaauuugcauuucccuauauuuaugacauugaacacuuaaaaaauacaauuacuggucacuuggauuacuuauuuuauuuaaauguuuacucaaguacauuuauaauauuuuucuauuggggucuuauuaucacuucguauuaguuugcaauaaguuaaagauuaaccagucuuguaauuguuaaaugcuguuugaaaauaaaaagguuaauccucuuccacacagauuucucuuuuauuuuuaaaauuaacauauuacauaauuauauacacuauaucugggcuauuauugcauuaauuggccuauuuuugcuuacgggccauaauauuuuacuuauuaaguuuuaaugucuauggggaaguauccuguuacucaaaauuuucuuggcucauuuguuuuucuuuauuaacuuuaaaaucaaugaguaacuugcauaaaucuauucuuuaaaaaugguagacugggacugauuagaauugcauacaccuuauacauuagcauguagggagaaaaucuuuauaacaguaucuuuuuauccaagaacauuucaucccucuucaucuagcaucucuuauuauuucuuggcaauauuuuggccccacuuuacuucuaaagcucaaucuuggaaucuuauguuuuuuaaucaauuaugaaaggaauuuugaaacuccuauuggaucuaauugaauaaugcuggcauauauaugacuguaagcuauugauuuuggauauuuacuguguauccagccacuuaaccaaaguuuuuaauauuaaaauggauguuuuuaggaaacagcuuuucgaacuuuagguuuuaaaugaacucuugaauauaauguauuaauagaauucuugcauuguuaggauaaauuuuaccuggucaucaauuauuccuuaaaaguuauuuggaaaaaaaaaaaaaguuguuaauuucugugaauucaaaccauuauuuaauuuacaacuuucacauuguccuauuuguuuuuauguuuuuucgguuuguuuuuuacagaucccagggagaacuauuuugugcuuuaaguuuuauuacauucuguaaagugaaauagguagugguguucucaucuuuucugcauuugguaauaauucauauugaauaccaaguauuuaggcagucauuauauauguuaggcaaugugcuaauuacacuuaauauauacauugucuuauuuuaucuuuucaauaacagguacauaugauuacuauauucgccuuaugaguuuagguaacuugcugaagaucacaccaggauuucaauccuguuuucuaacucaaguuuauguuaacauguuguuuuacuggauuagaauuagcuguucauaccccagcaaaauauuaauaacuuuuagaagauggguaaaagauacacaggaguuuacuauauuaaaacuggucucuucacuuuugugaguuugagauuuuccauaauaaaaagucuauaaaguaacuguuucuucaaaguuuaaaagaacucaauaauaaaacuuaagggcccuacagucuucuggggauguauucgauauauuguuuuuaaauuuucccucucauuuugguuuucuacuucuuagccaauuuuuggcuuuuuuuuuuuuuccaagaaaaguaauguauuucauuaacuuuucuaaguuauuaguuugguucaacagacacugauguagguagcaucuauauuccauauauugugcuaaggaaacaaagaugaauaaaaacauaauccugugcucaagaggguuacagucuagagggaaaaaagugaacauuauuauagacugaaugucugugucuuccccaaauucauauguugaagcccuaacccccaauguggcuguuuuugaaguaaagggguaauuaaccuaagugaggucauuggaguggggccuuguucugacaggcucagugccauaugaagagauaccagaaaggccauggcagggcaaaguggcuguccguaaacuacaaagagcccuuaccagaaaccaaacuagcagggaccuugaucuuagacuucuagcauucagaacuaugagaaaauaauuucugucaggccacaaagccuguggcauuuuuuaauggcagcccaagcagacuaauacaagcaauuauuuuaaaauacuaugcuucguuugguauaucauuaugcaaauauucuaaggugggaauguaagauggcauaguggcuacaaaccaugguauggggccaggugugguggcucaugccuguaaucccagcacuuugggaggcugaggcaggaagauugcuugagucuagaaguuugagaccaacccaggcaacauagcaagaccccaucucuaccaaaacaaacaaacaccacacaguguuuccucaaaaaauuaaaaauugauacauaaacucuacuucuugauauauacccagaacugaaagcagggacucaaacagauaagcuguacagccauguacacugcagcauucgcuauucccaaaagccaaaagguggaagccaucaacauaugaguggauaaacaaaaugugguguauacauacaauggaauauuauucagccuuaaaaaggaagggaauuauaacacaugcugcaacauggaugaacucugaggacauuacgcuagugaaauaggccaguuaaaggacaaauacuguaugauuccacuuacaugauguacuuacaguaucaaauucagagacagaacagugguugccagagacuuaggggguggaaaaagagaguuaauuguucaguaggcacauuguuucaguggggagaugauaaguucuagagacggaugauggugacagcugcacaauuugaaugcauuuaaugcuacugaacuaugcacuuaaaaaugguauguuuuaucaucauuaaacaaaggaugauauuaagaguguuuucagcagacagaauaacuuaaaaagaucaguaacaacacagacacaugaaacauuaugguaauagcuauucucugcucuuaccauaaaauguaaaaauauucauuuugguuuacacuucucuguauccuuuucuaaaucuuccauuucaauuucuccuuaagucuaugucuuauuugcucugcugauuugacagauuugucuauuuuaugggauuucccaugcacacagaaaaaagcucuuagauaacaguucauuaacauuugcuuuuaucauuuuaaaaauagcuuuauugagauauaaauucacauaccacacaauucacucauguaaagugcacaacucaauguuuuaguauauucacaggauuauacagccaucacaaucaauuucagaacauucuuguucuuccacuaaaaucaauccccuuuucuccuuccuucccaccccaacuuuagauaaccacuaaucuuccugucuuuauagauuugcccauucugaacauuucauguaacuagaaucauauaauauguggucuuuugugacugguuucuuucauuagcauaguguuuucaggacucauccauguuguaccauacaccuaucauuuuuucuguauccuccuuguuguacucuccuaacuuugaccugaauucuggguacaucuauuuuuauuuuuuaaaacaaaaauggguagggcgagguggcucaugccuguaaucccagcacuuugggaggcugaggugggcggaucacucgaggucaagaguuggagaccagccuggccaacauggugaaaccccgucucuacuaaaaauaaaaaaauuagcugggcaugcuggugggccccuauaaucauagcugcucaggaggcuaaggcaggagaaucccuucaacccgggaggcagacgcugcagugagccgagaucacaccacugcacuccagccugggugauaagagugaaacucugucucaaaaaaacccccccaaaaaacaaaaaugaaaccauuuaagguuaagaauuuaccacugcaaauagcuuuuacuauauucauaaauucugauacugaagcauucuuguuuuccuaauuuuaauuuaaccuaauauuuuggugaguauuuuuaaacauuuuagugguguuuuucaaaccuuuauuuuuaauuucuaguuuuauuuuuguuuuggucagaaaauacaauguguacaauuucaugaacaucucaaauagaaagguacaauauucaauaguauucuuauggagguugucuuauuaaauuuuacuguuccaaucuuuuguguccuuauuuguugccuacuuuaucagacauugauaaugcuaaagucuuccaauacaauuguguuuauugauuucauguuucuaaagguuuuuguuuuacauuuuaugaugcuguauuauucaauauacagggauugugaaucuaacuauuauuuuauuauuucuuccaucaacuuaaaaugaccuuuugucucauauaauucuuccuccucuaaaguuauucauuguuaauacuaccaccuuauuuuuaugcuuuccugauaugccuuugucaccuuuuuaauuuuuuuauuuuuuuuuugagacagagucuugcugugucgcccaggcuggagugcagcgagccaucucggcucacugaaagcuccgccuuccugguucacgccauucuccugccucagccucccgaguagcugcgacuacaggcgcccgccaccacaccuggcuaauuuuuuguauuuuguuuaguagagacaggguuucaacauguuagccaggauggucuugaucuccugaccuugugacccgccugccucggccucccaaagugcugggauuacaggcgugacccgcugcgcccagccgucaccuuuacuuucuuuugauaauuuccugacauaucuuuuaagauuuuaaaaaaagaaagauuacuaagguaaaaaaaacucaacucauuauuuuuucccucuaacuuauaaauacaaagauguacaaggcagaagaaaugacuggaaaagaguggguacaaagggagaguuaacauaagaaaaaaauuauuucuuuaaaaauaaaaauuauauuuugguggugucacuucuuuuguacaaauagaacauaagcuaugauuuaucuguuuuugaagcaaaaaugcaauaguauuuaacauuuuuuguuaacucuucuaacagucaguccacaaugaaacugcuacacacagcacuaaaaacacagcaagugaacagaaucaccccgaaaaagacaaaucacauguaauucaaaggaggcuccaagucaaucaagguaaaaauaauuuauaauauugggacaacuaguuaucaauuuuagcaaaaaacaaaaaugagaaaauuaucaucuuauauuaugguggggaggggaaucaauucugaaaguaagaaaauuucuaaauuuaaaaacagagcaaaccacaaggagauaaacagauaggacuauuaaacauuuaaaguuucucucucucuauauauauauauauuaaacucuauaauuaaacagcaacccaagaaaaaaaaucagaggauacagacccaaaagacaagcgaguaaagcacgagaacuuccugauuuagcuaugcggcuuugaaauaaauguauguuaaaaguuacgauagacuauugucauguuucuuauuagcagagauuuauuuuuuuaaaaaauuaacuugauggucaacagugugguaaaacaaacacucuucuacauuucugugacaauguaaauugguacaauucuuuuggaucgacacucccaucccaaauuuaucaauaauuuuauguacagggcuauuuaguauacauuaaaaaguuuuuuuauaaaugaaaaugacuuaaacauucaagaguaaauuaugguauauccauuagaugaguauuaaauagccauuaaacagauuauuuuuguguggcaggacuauaauaauuuuccuucuguuuuacuuuuccaauuuucuauaaggaucauauaguaucaucuugugaaaaauuauuuuuaaaagucacauuuaccuaugaguuauuaauuuucacuacauauauacuuucucauaaaaauuuaacuuguacaaaauuuucaaaauucuauuaccugccaaaauuaauuuuaauauuggauaaccaguaguauggaauuucauuacaaagaaauguguaaauguuugggaggucgaggagggcagaucgcaaggucaggagaucgagaccauccuggcuaacauggcgaaaccccgucucuacugaaaguacaaaaaauuagccgggcacggugguggacgccuguagucccagcuacucgggaggcugaggcaggagaauggcaugagcccgggaggcggaguuugcagugagcugagaucacgccacugcacuccagucuaggcaacagagcgagacucugucucaaaaaaaaaaaaaaaaaaaaaaaaaaaagaaauauguaaauggauaagggcagacaaugugucaguuucaucuccagagacuccucuuuuaacuagcagcuacagagauguuagucgaacacaguagcgacagcaucugaaaugaccacucuucuuucaacgcccccuuauauuaauaguuuuaugcuucaagaaggagucaaaauuucaauuugucaauccuguuucuauuaauccuaaaaauuagaacaaaauuucacauuacugugggaguggaaaugaagguuccuacuauuccauggaaagcguccauauucaagaaucauuuguacucauuggaaaaaaaaaagaaacuaugugacaaucucagcuuuuagcuuagaagacacuccaacaugauaaaccacacuaaaacucuaaaaagguauacaaaggccucacaugaagaaggaaagcaagagggaaaacaggaguaaaagcaacuaaaguaaaaaauuauccuuguuucaacuuguuuuaaagacagcugaaagaucguagauggugcacuaaguuuguuaucucuguaaaugcuaauuuuuucucuuucauuuuaagauguuguguuuaagauauuauguucuauucucgguuuuuaaauggguguucugggcaaaucaacucucaguuugcucacugauaaguuuugacucauuagaugauuuuuaguauaccucucaauucuaaaauaaugugacuagacaagagaagagagucauuaccuuauuauaaccacugacgggcgaguaggucacuccagggcuauaagaaccacugccaccugaggacagaccuugcagcugagggcuguaaccagucauacagcugguggugaacuugggacugguacugggcgaacgagaagggcuauaacucaacacacucugacccugaauugaaggggaagguggagcgggagggauuuggguugcugccagaucauguggaggcguagucuguacaacuagaaggaaaaaaaaagcaacauauguguauguaccuucaaauaaaauuauacgaaaauauauuuaagcaacuaagucuuucucuuaagggaaaaaaguuaacagaguuacuugguuguuaaaucacagaauguauuauuaccaaaggacacaaauuacguguuuaccauuuccagagugcaaaauuagaaacugguuucaacucagcaaguuagucauuuaauuuuaauugcaccugaacaauggaacaaacuuccaugaaauagcugaauguauacaaguaggaaugauaaucauuggucauaagacaauuuauuguauccugcuuaagauagcugaugucccuuccagcuuugagucuacgaaaugggaaaauuaaacugagaaagauuuauugccaaccuuuuccccaccuuugcaagagauauaaaacacucaccagcuguuuucaacccuaaaaguguuugcuguccaggacuaacaaccagacuuguuggugccacaguauauuugaaauaucuccaaaaaucaaauaaggcauuaaggcugaagagagaugcaagggcaagcucuggaagagaacaauuuuuuuuuaauaaggggggugaggagggcaucuauuggagaacacaaaaacccucuauacuuagcaaacuaaaauuaccuucuuauuccucauaaaaacuauaauuuaaugaauguuauguguaggguggcugggcaugguggcucacacccauaauugcagcacucugggaggcugaggcgaguggaucaccugaggucgggaguuugagaccagccuggccaacauagugaaaccccaucucuacuaaaaauauaaaaauuagccagguguggugacgcacaccuguagucucagcuacuugggaggcugaggcaggagaauugcuugaaccugggagguggagguugcagugagcugagauugugccacuguacuccagccugggugacagagugagacuccuucucaaaaaaaaaaaaaauuauguguagguaauuuacuagugaguuucaaaauagcacuaauccuagcaacccuguacaauaaauauuuucaccuucauuuuaaauauaaaccaacauuauucagaagccaagugacucuuacaagaguagagaguuaguuagugaagccaugauucuaacugaggucugcugauugcaaaucccuugcucucccaacuuggcacacuaucucccugugaaagacuuuaauguguauagacuaugaaauuuacuuuaacauccauaaagacucuuuauacccaaugacuauggaagagcagacaagaagagaggaaagaaugugaaaacugaggaaggcaucaauggagcagaaaucugggcuggucuugaaaaguaaaaagguagagacacagaaagcgcauuucaggagaguaauaaaaacaaaucucacuaaccucuaaacuuauuuuucuucacagaacucauaauuaccugaaguguuauuaaucugauugucuaacagaauguuccuuucauaauagcagggauuuaccuugcucccuuucugcuguauucccaguuuuuacaacccagcaggcagucaaauacuuguugaauaaggaaauguauacuaagcugaauuaaaccugaaggcaguuuuuuauugguaaauguaaguuacagugaaaauuacuuacuuaccaauauaccagaggggccaguaugucacauuguaguaugaacuaaucaauuuuccaguccugaaaaaaaauuagaaaggcuuuccagugaaccuaaaaacaccaaaaaucaaaaacaaacacaaaaaccuguggaaccagccacuggcuucuuaaaguuucacuuuuuuuggacugauucacuuacauuucaguauauaucauuccagccauagauacauuuaggaguccccaggcuaagaccacuuuccuagccucuguuucuuuucucaucuugaugguucugucaauaagggaagcacuagggugugccucccccugcaucuaugaaaaaacaaaaagcacaggaauuaaccagaagaaacuauugcuccauuuaaaaaccaaauuuugcaucccuuauaaagguaacugaaaccgcauauaccuucucucaucuuuaaaauguuuuaucaaaacuucuuccauuuuaauaucaguauaugaaaagggaacccaaaauuauauguaacuuaauuggcaucacaguguaaucaacagagaaguggcugguuauuuaucuauuuauuuguuuugagacggagucuugcugucucccaggcuagaaugcaguggcgcgaucucgacucacugcaaccuccgccucccggguucaagcgauucuccugccucagacucccgaguagcugggauuacagacgcccgccaccgcguccgacugauuuuuguauuuuuaguagagacgggauuucaacauuuuggccaggcuggucucgaacuccugaccuugugauccacccgccucggccucccaaaguguugggauuacaggcgugagccaccgcgcccagccguggcugguuauuuaagaacaauuuaauacuuccaauacauaaaaaugucuuauuuuguaauuuaaggguuaugucuagaaauacuuuguauuuugucuuugggguauguuacacggacuaggcaaaaggcuaacuucagaaacucaaaaugucaaguuuugggagacuauauuccauaucugcuguaagucauaaagacuguuguacauccucaugcagacgccauuacuaucucaacaacucugcacuuggacagcuguacuccagggcucucccuuuuguguguggauaaaggacaaggauccaaguuuuagaagggcacguacuuaugaugggguggugagcggaguaagagggagagaggggaaaacgugcauuguuuugguccacauuugggauuuauaauuccuccuuucuucagcuaggcucaacucuuacagaccgugcaaaacuuguuccagcgacaagcagucguaucccacagaggacagagcaauagcuuucgcgccacucagcccccgcgucccaauuucccaguccagagcuucccuccccggcuccugggcacgaacuucagcaacccuauugcuucuuucuucccuuccccuagagaggcggaacgccuagccacaucccccuuggcugaacccaggacagaucagcaggcgcggaacucccacaacccgcguagauuccaagacaggaagcacaaacacgaccccgaaaacgcaccauguccucuggccggaaaacgcaggcucgcgccacucucucugggcaugcgcaaagccaagcucaagcgggaggccaccggcaagcggcucuaaaguu

SEQ ID NO: 14570 - RNA, 1352 nt, Homo sapiens
ucauccuugaggguaagacugacagcaaugacuguccuacaggcagguggugaagcugggcgccgggccgggaccggagccggaggcggagcuuuccaccucgcuggugaguggcgggucgaugcggggaguucgacgacguccccgguacucgaucauaucuggaugauagguuggguggcggcgagcaugcuuggucagguggucgcuccgggagaacugcuuggggcagagggggcaggagaagcgcuucucgcccgugugcguccuguaguggcgggccagcucgucggaacgcguaaacuucuugucgcagucgagccagucgcaggagaaagggcgcucacccgugugggugcgcuggugggacuugaggugcgacgacuuguaauaggcuuuggugcagcccgggaaggggcauugguggcgcuuggcagcaggugugacagaccuccuccggggcgccugauccgcggcgggggcggggccugccccuagggccccuccagagaacccaccagaggcugcuggugcgcccggggcagcaggcgcgcuugggacggcgggcgcaucggaggagcucucgggagcgcagaccgccgcggcgccggaggcgggagccagcucggagcacggggucuggacggagcacgggaucgggucggagaagccggacgaggcgcguggagcuucccccgaguucucccaggagcccucgccagagcugccgcgcaaguccgcccagacgcuugcagccagcagguggggcgcggcgccgcccgcgccggggcugggggcggggaccugcgggagcugggggaccgacgcgggccccgauggccccggacccggcagagcggacuccggaugcgccgcacccaccuccgagccugcggcuccacccgcgcccucgggguccggcgggcggcggugaaccacggcgcccgcggacauggacaccaggcacucggcggcgaaguaguccaggcacgccacggcggccgacaugcugggaccgcccggccgccggcgagcgagaagcaggaggccgggugcucgccgccugccgccugcugccgccgccgccgccgcagccgccgcugccgccgccgcccgcgcggagcccgccccgccugacgcgccccugacgcaccggagcccgcgggggcggcagagacccgccccggcccgcaggacacccccucggaacgcgcggccccccggcuaagucauguuuaacagccucagaaauuaucuugucuccgcguucuuucuucugccggcgagccagguaaugguaacagagcgaaacuccccagucggaacuucuggguugcagcagccucgccccc

SEQ ID NO: 14571 - RNA, 1274 nt, Homo sapiens
acccauaacaauauauuuggagagcucaaaugugaaagucaugucuguaauuuuauuuagagcuuuuuuuuuuuuuuuuuuuuccaaauuugucaccaacuugcaacgagcuuucuuggaaacauagacguguuuauguuguugagucuugagaugaacaugugugggcuucugacgacacugaugcccaguuuguaugauuggaugauaccugaaaagugggucacuuccuagucagugaaggguacacagggcugaauaggcagggcuuuuuggcuuuuuccgugcuuuuguuuuuguuuuugguguguguguguacuaauuuuagauacucagcuagguacuugacuggcuauccuuuuuagcaugugauuuaauuugguuuuacccaucaguauuuauuucaaggggacuaaauaaacacauuaaaugaagcacuuaagaacuuucuaucuucuuuugacuauccacagcggugggaaaucucuguccuuugaggguaggagggagccaauaguuaggucucaugaauaugguaggugaucaaaccacugauucaagucauuguuucauguuauaaacauggacugagccagcuacuacauuucaguagaagguacuguagauucaaaagugaacaugggucuggcauuucagaaagacacagguuagugagauaaaugacuauaaaaagagguagcacuguagacugauguccuguaacagagguacacgugugcuguuagagccaagagggggucaaaauaaaaagacagggcacgguggcucauaccugugaucccagcacuuuaggaggcugaggugggaggaucacuugaggccaggaguucaagaccagccugggcaacauagauccccaucucuacaaaaaaauaaaauaaaauaaaaaaauaagccacacaugguggcaugcaucuauaguccuagcuacuugggaggcugaggcaggaggaucccuugagcccuggaguugaaggcuauagugagcuaugaucacaccacugcacucuagccugagcgacagaacaagaucccaucucugaaaaaauggaugagugaauuaaauuucaaaauagagauuuaauggaaaaaugagaauuguuguguacaugauuuaugaaguggcuuacauaauauaauuuuggacaugaaagcccugaaaaauagcuucuuauuuuaaggaugaacagacugggauuuauuucugaaauucuauaauucucagucaguuguaaggcuuucauuauauaaua

SEQ ID NO: 14572 - RNA, 84266 nt, Homo sapiens
aagcauuaggggagcccacggcuacaaaaacaagugagugagaagaggugggaggaagagaaacuacgccaccuccccugcagccgagugcacgcagcagccuggcgugacaagugggcgacgccggggggcagggagccgggguccuuggcccuggccggggaccccaccgcccaccgcgcggaggacaacuuuuagccggcagcccagaccagcgcggcaccugucuccggagucuccaccgcuccucccgauucaucccagggaaauucucaagaauacgcucuacaaaucuacgugcgcaucauuuucaccucgcgucgcgcccgggaggaaggaacgaggcaaggagcuaaagcagcgugcguucagcccugggguaaguucgucggguggggaagccggucccgcaggacuuugggaugggaauuuugcucuccuuugcgaucucagggcgugaagaaggcguccccuccgcugccggcggagcugaucggcuggcuagucaauuuccccuuagcacgccccgugcgcccacccucgcucagcccggggcccccucgccgucccccggaaggggucugcgguuccuggccaggacguucggaaggcgagcgggggaagguagggcugucgcgggaacccggcuugugagagcgauuucgccauguuuguguugcuaagagcacuuuuuccccuuugcuguggcuugaugccacauggcuccuccggagcugcugccgggcugagagaguguuuuuuuuuuuuuuucaauguccgcauuccagcuaauguugcgcagauaaaauucaaacuugagguaaacagaagaagaggaggaggaggaggaggaggggaggggggaggaaggggggacuguuuccauuucgagaucccaccucuucccuccgcgcagcccaacaucccgaaccuagagacaacucuugccuuucucccacgucccccaccuuugcugucaacaagaaauaaaggcggggcggggggggggguuggagguaggggguggcgugcuuauuaauuagaaaggacgcggugucucgguucuccacuggaaucagcaacucccuggaacucgggccucuggccccgucccucuuuucuccggcagggacgcaggaugccuuggugcacucuagagacggggaccggagggugcagcgcgccuggguggggcgaagggcgccggucuccucacgcccucugacuuuaggauaccagacagugucucuucaaccccaccccaggcgcagguuuccagaaggcgggguggguggggcccccgauuuccagaaggcgaguuaccuagcagguguguggggugggcauugcuauucgguaagucuguugcaugggguaggaugacguggggagcuuaaaagcuuuaaagccagcgcaaagguagagcugcgucugcuguuuuuguuuuuuuuuuuuuuucccugugucuguggcaaauuaaggagaaaaaucaagacguucccuucaguccucccucgguguuaacgucugcuccagcucgcagcccgcugcugggugaguggcgacaucagggcgagggugagcuucgucacggggaaagcuggaggcuccugacagcucguagccguccuccccucgccccgcccuaggcggaagguguggguugggugguccgaggagggugacguccaagguggggugggcacaggcucgggaucccucgcagcgcuaggggccgcagccccggucgccggggagugccauggcagggaggcggcagccacgugaggggucugcggaagcgccggagcugaaagcugggggcgaagugcguagcagagucgugacgggggugacacgcagcagccgggggcggcgggccgccggagccgggcgccucccacgcagggccggcguuccccgccgcgggugggugcgcacucgccggcccucucccgggagaccguuuccgggagcgggcgcuggcggggcggggccguggcgguaaacaggguggugcccucugcccucccgcccccggccugccggggcgcgcggccggcggugcccggggcgguggaggcgcggucgcggcgccgggcagcgggggcgcgcccgcucucugccgcccccgcgcgcgcccgccgccgcccggccggccuccucuguuuuuguuuugauggagcccgcgugcagcuggcgcgugucgagucacgugccgugggcgggagggggccggggcgcgggaggcgagggcgcggugacacgggccggaggggccugcgcccgcggagggcgcgcgagggggcguguggcccccgauggagcccugccgcgcgggugccccggcgcuggcugaggggcuuggcgcuucucggcgagcagugcuagguuugucgucgcagcgcuucggggagccuaguccaggagagaggaccugccugcgcugcucggcucagaacucggaccuuacaggugguguguacaucccgguggacggguagacacuucugugugcuccugaaggccggcugcguguaauaaccaacuggagugcuuuaagaaggauucuaacgccagcccaaucccagaccaauuggacccacauccacauagggccuggacaguguauuuuuaacccccucuuccccauaagugauuuuggugcagugagaauuuauagaaguaaccagcuugauggaauagcuacuugugaaaucacaucuauuuagggacaaaauaguaaaaauagcuaaaauagcuaacacguauucaucugucacucaguggggucucugugucagauacugcggcuccccaaacauggaucuacucguagaaguacuguuaccccuauuuuauaguuggaggaggaguggaagcucggaguuaaucagggaggacuacugugacuaggaccuagggaggucgaguucaaaaccccuacuuucaacagucacauaugccucguggaaaauguaccuuugccuaagggccccauguuugugugaauaguaguaauguuugccugagggccagcuuguuuauguggguacauuucuacuguuaagauuuuugucugaaaagcuuugcuuguauaggggaggaaaaucguggugauucuuuaaggccuguaggcgaccuuuuccagaaguuuauuguggaucaaggagagaggggaucuccguaauuugaagugaauagguucucuggaaguuucuuguuuuguuuuugagacuugagcauuucuauaaugugaaggggagaguccggaagaggcagauauuuuccaaguauuuacaugagcaaccacaagaguacuuuagguugcuggaugcgauacaguugugguguggucacagcuggauguacccagaggugcgguacaguacagaguagcagaaguucugccauuagcauuuuggagaaaaaaaaaaacaacuagucuggaguagagaaacuuugccguuacaucucuuuucuccccuuaauuuguuugauuugucuccuggucagauaaacuguuggugggacguuuagaugugggaguaguccauuucauuaguauuuucuguacagagauuccaaagaaaacucauaguaaacagagguuucucccugaaaacaaaugauacuagcuacaguguauuugugaccaguauguauuauuaagagguaccgugucacaaagaacuuuauauuccuguugauugcugucaaauauuguuaccucuauggcaggcauggguauauuauuuagcauacuuuagggauugguuuucauauuacuugcaguuuugaugaggaaggcuuauagaccuacucaggcaaaccugacuggaacgugaguaucuguggucugguguggaaauagcucucuagccccaucucccuccucccauuguccacccccauccuccuuaccacgaaacacauuuuucaccagcauugccaaaccacuugggauuccugcgcauggcuuugcuuaguuugcucuucugcuucuuggauaccuccuucaggaaauguucccugauuucuccucagaaaccauuuaaaaaauacccucccugcgucaucucugcauuauauauaugcuugucuuauugcauuauaucacagcauaucucauuguauuuguuacauauugggcaccucaaaggugagaauggugacuuguuuaucugcacaucacuggcacacaguaagcacuuaaguuuauugcauuggucgcaauuacauuuacuuccauuuaaguugcauuaucugugucgguguuuuccugaaucacucaucuucauucugaacuguccucaccuccuucucugcugcuugcuaccaggcuaaaaacacagcugaaagcaccccaagacaaaacuuacacagaaaauacacaauaauaguaacacauuaucaaagaaauaggaaggggcaaaauaucaguuuuucacuuguuugcgaauuucauccuucacuggccgauuggacggugugaacuuucuugguuacuaauauaugcuggaggagaugcccaagguuguuuuuguuuuucgauuuacuugggaaggaagaacuaguacuacauuaccaguggacaugcuuugaugugccauaacagagcacaggugcuucaucacauuucauugcuguaauuuucagauugaguauuacagagguauuuguagagcagcacugucccauagagcuuuuggagaggauggaaaugauuuauaaauuuguguuauccagugugguagccacuagccacuuguggcuauugagcacauuaagugugacugacgaacugaauuucuuuucuuuucuuucuuucuuuuuuuuuuuuuuuugagacgguguuguucugucaccaaggcuggagugcaguggugcaaucuuggcccacugcaaccucugcuucccaggcugaagcgauccucccaccuuagcccucccgaguagcugggauuacaggggccugccaccaugccuggcuauuuuuguguuuuuaguaggggugggauuucgccauguugcccaggcugguuuugaacuccugggcucaagcaaucugcccgccucggccucccaaagugcugggauuacaggugugagccacugcgccuagccagaauugaauuucuaauugauaaauguaaauagcugcuaauggcuacuguauuggauggcacaguuacagaagauaugucuguaauugacaggucaucauuuaggcuaagguauucugccuuuaaaagucugcagucacagaagauauguccuguaauugacaggucaucauuuaggcuaagguauucugccuuuaaaagucugcagucaucuucuagggcuuaacaccaugcuucccguucauagauuauaaggugcuuagugggugauauuuuuggccuauguggggccuucauauuauggagcauucguguguucuguggcuuuucauguagugcguguggucuuccuuuuucaggagcagaguagagugauuauuaguaauuaugauuaugaguaauuauuuacaaauggaugugagcccuugguguauacacuaaaugaaaguccuaugaguugaaucaguacuuuucugagaugcauugugaggggaaggaacugugcuugucuugcugaccauugaucuccaaggccuaauaugcuacuugacaccuaucagugcucauaaauauguuuugaaugaaugaaugaauguucaacuaacuuaagccuuccaguuuagcuucagaggcuguaacauggagcugagaagagaaguaacgaguaacuacaccaguggcuuuauaguucuuccaaggaacgcagucucuccagggguacuauuguuagcucugugacucugauuucuuucugguaagauauguagcaggaauuguuacacuuauuugaugacagauugaaaaauaaagucacaagaagauuuggugcucaggucauacagagagaguuggaaguauacaucaaauggaaguaguuguuucuauugcauugugcagucauccaugauaacuucuuuuuuuuuuuuuugaguuggagucucgcucuguugccuaggcuggagggcaguggcacgaucucagcucauugcagccucugccucccagguucaagagauucuccugcuucagccucccuaguagcugggauuacaggugugcgccaccacgcccggcuaauuuuuguauuuuuaguagagaugggauuucaccacguuggucaggcuggucucgaacuccuggccucaggugaucucccuaccucggccucccgaagugcugggauuacaggcgugagccauggcaccuggcccaugauaacuucuucagaggaaauaaaauaaaauaaaaucaugcgcugaacuauguuagaaaguuuggguuguaaaauccaaguuuguuugguaauuguguauguuaauggagucugaaaaaaggacugaagauauuaccucuaguguggcaggacauugacaaaacaacuuaaccaugagaaacaggaauggaaacauuucuuucuucagcuuccaaaucucauguauucugugauuuuuuuucuaugguaauccuagcacccaaguuacaagcuugucaaaugggauauuuaaaauguaaauagaaaauguuuaauuguguagauaaccccuacuaggcuuugaaaaaaaaaauauauauauaguaucagacacaucaaacaucuguuuagaauaagagcacuaagaccaaaaauuguagauuuuauuucauguaguagauccuauauuggggguugaugauguagccgaauauuugguuuaguaccuuuaagaggcgauaaacauacucugcuaucuauacuaugcaucagacuuaaccuacuuugugcugcuauguguguuuggauuuuaggccugucuucauccacaacagcuuguuccuaggauaaauguugucuuccuaucauucugccacuacauguuccacaaaugaaaaguaauuuuaucauagaguaagucaaacacaauuggaaauacaaaucuguugucuuaaaaaaaagucauagaauacauuccaagauaaaaugggaagacuucucuuuuaagcaauuccuaguccuuuaguccuuacuuuucaaauaccuuugguaugaaccuuuugggugaggcaaaaauauaaaagcccccgaaucgaaaacaaaguaucaaccacguguucgucaauuccugcuguugcccuugaaaccaaaccaaaacacgagcauaacaagacaaaacccaccacugcuaauagcaacaaaaguuaacccaaccaaccacacagaaagagccugugagauuugaguugucauuuuuguagcgaggucaaucaugugaagucuuuuuuauuuaaaacauuuuuuauuuaucuuuuucaagacggggucuggagugcaguggcauaaucacaacuuacugcagccuuaaccuccuggccucaagcaaucuucccaccucagccuccccaggagcugguacuacaggcacaugcuaccgugccuggcaaauuuguguuuuuuguuuguuuguuuguagagacaguguuuugcuauguugcccaggguugacuugaacuccuaggcuccagugacccacccccucggccucccaaaguguugguugacaggcaugagccacugcgcuuggccaagucuucuuuuuuagguauuaaauguaaauuacucaugacaaaaauacuugccuguaucugaguagauaguaaugauauuagaauuaaugcuacaaaagaucaggauguauuuuugccuagaagauccuaugggacuacuuggauucagguauauaguuuaagaaucauuuugaaggucaccaacuuguucgaguuugaggauguuacuggcuucacuucuuucucaucaguggagugguuggauugaacucugguucucaaacuuugguguguaucagaaucacugaagaacacacauuauugggcugcaccccagaguuucugacucagaaggucuagggugggcccacuaauguauauuucuuacaaguuuccagguaaugcugacguugcuggucagagggccaaacuuugagagccguugggauagacaguaucuucuaaaguucugugauuuuuuuuuuuuuugccuguuccccccacccccaucacuuuucaaguugagcacugaucacugcuugauuucuaaaggauuaugucauuuaaaaauugcuguauggcagacugaguuguaaaaguuuaaaauggauuagauuaauuuuauuuugagaauuucuugagaacuccauauauuuuccaaaaauaaugagucuguuaaaacucagauuggguauuccuacuuagcuaaauuagaaauccccaguuaaaauauauuaaaguauuuccgauguuacuaaaugacaaaacuauuugcuacuccuuaaaccuaaauguuguauuaaaucuaaccaagugccuuuuauuuauuuagaaauggucucacucugucacccaggcuggagugcaguggcacaaucauagcucauugcagucucaaccuccugggcucaagugauccucccuccucaaccuccugaguagcugggacugcagaugugugccaccacgcccagcuaaauaaaaaaaaauguuuuucuagagaugggaucuugccuuguugcacaggcuggucucgaacugcuggguucaagccauccucccgccccagccucccaaagugcugggauuacaggaaugagcuacugugccugaacuauuuaguuuuagaaauggagucucgcuggauugccuagacugcccuugaacuccugggcucaacuaauccccccaccucagccuucugaguagcugggacuacaggugcaugacauggcauguggucuucucuuaauaugcagcuacagaguacaaugcagcacauuauauaguuguggacucacuagauaaaaugauuuucaugagacacaguuuuuucuagacaaaacuccacggauuuggguccauaauagacugugacagcguuaacuuggacauccccuaaagauaacagccucacggaagaaucaugguugcgggaaggaaauguccaucggggcauggaugaguacgucagggcacagucauuccugauuuugaugaccuuggagaacagugguggcucuguaguuucuaaaugaggggacuguggggcuggaaucugguaggaaagggagugggguuacuaggagacuugucuucaagcagcccuuucauagcaagcacaccguucuuaggguguauguuuaugggagagggaagaucuuggggaggcguugguggagauuccaaggcauucuaagaggacagguggcgcucuggaagcauuccauguuaaaccagacucccaggugcugagaaucagauggacucaaguugaguccaagugagguuugacaguauauucuaauaugacuaaauguauuggagagaaaagaaaaguuaagacuuugaggaaaauauauauaacuuuaccugaaagcagagaaauaaaauagaagaaauuggugagcagggaaugggaagacaaaaauggaauguuguaaguuuuuaaauguccugaaacuuuuaaaagacauauuaacuaugucaagaugagucaauagcacaggguucuuuguuagaaaauaauaaaugaauaaguuuuccuuuuuguuucuggugaauacuucgcaauaucgccaggugcuauuauuugacucaugucaaaugccuuuccaaaguuaugcccagaauucaugcaaugcuuacauuuuuagauugcuuuaugaucguuaccuuguuuaaaucaaguuucuggaaggcacacaugaccguuauuacuaggcgugcuuuauggauuaggaaacaaaucauuuguauagcgcagaccacgaagcuggguugagaccaugagacuucucugcuuuucacacuaccaguuuuaguuuuaucuugaaauuguauauugucucaccgcuuuuauaagaggauugagccuuaaaaucuuaagaguugauuuggcauacgcguaauugauuugagcuauguuucauggacccagcuuuagauuuugaucaccucuuucucuuugaaaagagcuacgugugauuugcuacccagaucuguacucauuucuugacucaaauauguaucugugacauaaucuucguaguuaaaucugugaaacuuucaaauccuucagacuugacagugugaggcugggguuggcagucugcuuaacaagaugcugggaccaccucugaauuagugaaucagggagcugcugugugauccccuccuccaggcuuucuuggaguuugucucugccacuuccucaagcccuuuaaaaaggcuccugugcuuuagagaguuaggauguuaaugaccguucuuuuuucuuguacuuuauuaaguacuagucuuacuagacuagugcuuaaguggcagugucugccuuugccuucucccaucucuuuaugcuccuuucuuccaacuucucacguuucuguuucucgcacggccagguguccagcaucccaugcugacuugcgguuggccaauccccuccucguagauuuccuccacauuuuccucuuccuccuuuuccugugggaaguucuuuuucugggcuguggcuggucuuacguaguucgguggaaaaaguauugagguaguguuagauacugugcugcaccuccaggaguguccaaucuuuuggcuucccugggccacacuggaacaagaagaacugucuugggccacacguaaaauacacggacacuaacgauagcugaugagcuaaaaaaaaaaaaaauugcaaaaaaaaucucauagcguuuuaagaaaguuugugaauuuguguugagccacauucaaagcuguccuggaccacaucuuggacaagcuugcuuacaguauuucugcuggauuucugguuccaacuagcuauggaacccugugagagauuugagucuccgcucaucugaaaugagagguuggauggagaacggucuuuccagcccuaaaaugcugugauugagauuauucauacggugguaugguuguagacccucacaggaaacuucagcauuuugaaagguacccaguaaucaagacuggucucaguguaggggugaugccuuugaguccccagguaaaacgaucuuggacuccuuaaauuagauugccugccuuguggcccgcccucuucuucaggaguuagggaugggucaggagggcacccuugucuuuauugugauaucuacguuagaauacccgaauauugaaccuggauuacacuuuggaaaaauugcugacacaggugugaaauauucggcugcuuuucaucuccaugaaggaggcaguggccuucuaaaguuguucuuucggugaugguauuuaaaccacuaggagaguuucugggaaccugcuucaugccucuguuaauucuuauacaacucauaaaaaaugccacuucagaucuuucucuugcaaaauugugcauggccugugaccguaagugcuaguguccuauuucuagggacauuuuuguuaguacugaaucuuuuuguuauguucaccaagcuacuuaucuguccauugucaaggccacugacaguuguuuugcugucugcuuuuguauugaugugucaugcauucauugcacauauuguuuauuuuuuaaaaucuguguuuaucuuuuuuguuuguuuccagagagauuaguuauugcuaugcuaagaacauuuauuuaauccuuuguccuuagugucauucauauuccuuuagcuauuccuauuuuuuagcuuuuuagaacuuuauaauaccuacuuuuuaugggcucacuuccaaaauaauuuguggugacucuuccauuuuuagcguguauugccugaaaauucagguauuuaauagcaaaugaaaguuuuuuuuuuaaauguuguuuauuuuggauuuuaucuuugaaaucuguaguuuguuuuaugccucuuaguuagcuuacaaaaaguuacucugcuuacacgucucuuauuuuuauggaaaaagauauaacaucccccuuugcucccccuuuuaaaggguucuaaauugagauucuuucugcuacuaauuuaauucuucugaaaaagaaacauagggguuuguucuuugccauauaucuuuguuacugccuaacaagcaguuuggaacaaugacuuuauagacuuaaucaguacccuguuuagucauuucauaucaucugcaguauguuuuugagauacauauuuuuuuaaaaaauaaaagaucauuugggauucuaaacaacagaaauauccaaacaacagaauugcucuaaaguuuuaaaagugaucaucuguaugagaaaucaugccuugcaauaacugaagaacauuugcucuucugugggaaacaguggcggcacguccucggcucauucuuggucugagugguccagccacuuaccccagaaagcgguccugcauuguggagggaaaccacaguggcucccgagaauccauuggcaauggaugcauucugaccacauuuauuguuguuuuuggaggguaacaguuguuuuaaagcacugaacuguaauugcauaaauacucaucuuacuuccuaaaacguguuuguugaucaucgugcucuuuuggaguaagagcuguaagcucugguaagauuacuccucaggaacauguugggucuuggacauugcaggucagucaucuagggcagcagucuccaaucuuuuuggcaccagggacugguuuguggaagauaauuuuuccacggauggguggggugggggaugguuucagguugauucaagcgcauuccauuuauugugcacuuuauuucuauuauuauuacauugucauauauaaugaaguaauuauacaacucaccauaauguaguaucagugggagcccagagcuuguuuuccuguaacuagauggucccaucucggaaugaugggagacaaugacaggccgucaggcauuagacucucguaaggaacccgcagccuagaucccucgcaugugcaguucacaguaggguuggugcucuuaugagaauccaacgcugcuggugaucugacaggaggcggagcucaggcggugaugcgagugauggggugcggcuguaaauacagaugaagcuuugcuugcuaguccacugcacaccuccugcugcgugguccaguuccuaacaggccacagaccaguacccaucuguagcccgggacuugggggccccucaucuagaguauucuggacuguggacucuguguuccuuuucaugcauuggaaucuuccuaguccucaacagggagccuaggagcaggcacaaggaaacauguccccucuggguaaacuuucuguccaaaauuaaacaaaacaaacaaaaaaccugaauacgucuggaaucugucugaguguuuuguggaugcaggcccacccuggcccuggcauaucagcaagccaguugugggccauucuuuuccucccuguuuauugucguuuuuuccugcguucuuuacucacucaguuuccuuccuuuuuugucuuuuuugguucuuuuccguuucuucucuuuuuccuuuuaccuucuuccauuccuuauauggauagccuaggaaacauccuacacuuaccauaggcauuuuuuuuagccugauuaauggcaguccagaacuaaagacaaauuuuacucugauauuauggucuguaaaaucgcaugcuggugcaaauuauuuauuuguuuguuuguuuguuuguuuuuugagacagaguuucacucuuguggcccaggcuggaaugcaguaggaugaucuuggcucacugcaaccucugccuccuggguucaagcaguucuucugccucagccucccaaguagcugguauuacaggcauacaccaccacacccagcuaguuuuauauuuuuaguagagacgggguuucaccauguuggccaggcuggucucgaacuccugaccucaggugauccacccgccuuggccucccaaagugcuggcauuacaggcaugagccaccgugcucggccuggaguuucacucuuguugcccagacuggaaugcagugggauaacccugguuuacugcaaccuccaccuccuggguucaagcaauucuucugccucagccucccaaguagcugguauuacaggcaugcaccaccacaccuggcuaauuuuguauuuuuaguagagaugggguuuuaccauguuggccaggcuggucucuugaacuucuaaccucaggugauccacccaccucagccucccauagugcugggaugacaggugugagccacugugccuggcccggaguuucacucuuguugcccaggcuggaaugcagugggaugaucucgguucacugcagucuccaccuccuggguucaagcaauucuccugccucagccucccaaguagcugguauuacaggcaugcaccaccacacccggcuaauuuuauauuuuuaguaaagacgggguuucaccaaguuggccaggcuggucucucgaacuucuaaccucccggaugguccacccacgucggccucccaaauugcuggaaugacaggcgugagccaccacacccagccagugcaaauuauuucugaagaguuuaauauguuuauauagcauauuucagguugaauggaaaagauaugugaaauguaucacuucucaagcuguuuuugauauuuaaaugggcauucaaauagguuucagauugauguuuaaauuuucagauuuaaauaggcauucaaauagguuucagauagguguuuagacuuucagauuuaacuaggcauucaaauagguuucagauugaaguuuaaagaacaguuugccuaaauuuugguaauaaauaaccauauagaauuucaggguccuuucuacguauggaaauuuuugguaaacaaagauauuguuuggguuaaaguaguauuuuuaaauuucuuaaauuauaacagaguuugguauguaaaaaaugugguagagucaaauuuguguuaaauagcaacugugaccuaugccacucugaaggagcacaguauauucuagcuguaagggccuugggagcacauugaguucaaucuucucauuuuauaaaugagacaauuuacuuaaacuuacacaccugguucacagcauagcggaccacaguuaggucuuccaccucccuguccacugugcuuuuugggcagaagauaagguuaggaaauuuagaagugaaguggacagaauagcaugagaagaccauuauauuugaguucucaagcaagcuuugacuuuaacuucugaguuacgagauauuggauuagguguguuuaaccucuuuggaucuuaauuuucggaggguuguauuuuuagguccuucugaauuccaaucaggugaaaaaaaaugaaauagguuucaauucuucuuauuguagguucuugcaauuucacuuuaaguaguaccccuauuuuuuaguagcauuccuguuuuuuucuuguuagugaaucaacuuuucaacacguguuguuguuagacacaggcugucugagucaagaugcuaguugcuucuguauucagaugucucuagcauugucuugauuaacugaaguuaaaacacuuuaaaaggcaguucuucccuaguuucaaacugcaggaauaguccauggacacguuauucagagguacucuuuucaagugguuuacacuuucuuacagucuucaagaguaaucucaucauguaaguaaaauuuaagagaauuuugcugcuccaacuucuagaguugcuuuauuuaugguuguggaacagguuuuuccauucuuaguaggauaaucuggcauuguuugugucagagagaagacaguuguaacaauguggaaggauaggaaaggugaguuuaaaguauugaagaaaagcugaaagacuggagguuuuuuucagaagacucugccagugagcuuugagaccuuucccccauugccuagcaguaguucccaugcccuuaauuguuuuaaaaaagcccauucuaggccgggcgugguggcuuacgccuguaaucccagcacuuugggaggcugaggcaggaagauugcuugaguccaggaguuugagacuagccugggcgacauagugagaguuugccuuuacccagguguggugaccugugccugugaucccagauacucagggagguugaggcaggaggaucacuugggcuugggaggccagggcuacagugaccugugaucaugccacugcacucuagucugggugacagaguaagacccugucucaaaacaaaacaacaaaccauucuuucagugaacacuuuuuuaauaccuauuaugugcauagcacgaguuaggugcugugggaauuacaaaagaauuguucauauagggcuuuuugcuguaggugcuuccucucuagcuggguucccaguacuuaggccaugaaauggugaggugaaguaaaugaguacgcgcauagagugcucuaguugagaagggagaagggacaaagcaguaggggaagacucuagggagccauggaaucugagcaguuugaaggaccaguaguuaagaauagcuaaaaagaacucauuuuaauuuucuuuugggagaaugcaagggaagugguugggcuagguuaggacauaggcuugggaguugggaaagaaccacuguagguuuuaaaguguaaaccaaacagugacagaggcagaucucaaucaguuuagagguuuauuuugccaagguugaggaugcacccccgaaaaagaaacacaagucacaggaggaccugugucuugugcuuuuucugaagaggauuuugggaacuucaauauuuaaaguggaaagagaaagcaggaggggaagaaaaaaaagggagaguggguaggcaaugaggcaagugguuacauucuugggaggcucugauuaguacugcucagugaaucuacauuuuuacaugugaaaagaaaggagugggggaaaaagucaauuaugcauucgucuugugcucaguaaaucuacauuuuacguaagauaaaguaagcaugugaaauuacagcuguuugggaacaaaaguaaggcaguuuuuucgugauucaguuuccaggcuuaacuuucccucuggcauagugaguuugggguccugagauuuuauuuuucuuucacaguggcaaaugagggagaccccuggaaauaauacagccuuuuugcccuagcuuuuuauaauauuuugaaaauuucacgcuuaaaaaaauaguacugugagcaccuguauacccugcuucuguauucacuaguuaacauuuugcuguacuugcuggcuuguuccaaguguguguauauuuugaaccauaugugguaaguaugcauauuuguauuauuuugccucaucauuugaauguaaguugcagacaucaugacauuucaccucuaaauacaugcuaaggaggacuguuuucuguauauaccugcaaaacaguugucacacccacagagucuagcacugaugcaauaaccuggcuuaauauauaaaaaauauuuaaacaugaagguguguuuauugucuugggaccacgaguauugaauaaauugguguggcgaggcuagagccacagaaacugguuuacacauauuugaagagucauauguagccauaaaauagaaagaggaagcucauuguauucugaucugcuauacaauaaaauccugaguagaaacaaggcauagaagaauguaaaaaaagagaauuuauaaacauuugcauauauauagauauaauaacucuggaaggauagaaaaagaaccauaauauuccaugccuuugagauaaggcaucagguagcugggggacagguggacuuuucucugaauauuccuuguuaccuuuuauguucuauuuugcauuuugaacuaugugaauauauuacuuauucagaaauaaaugguaaagaagcacgcauaggcuuuuguuguuaccauuauuagcucuguaacguguaggagcauacuucucuuuacagccuaaagagauuuggagaaugagacgugaggcacagacaauggagaaaaaauuuuauuauuucaguuuugaaggguguuuuaguccauuagagcuguuguaacaaacuguuguagacugguuggguuauaaacaacagacauuuauuucucacagcucuggaggcugggaaauccaagaucaaggugcuggcagauucaguauuuggugagagucagcuuccugguucauagauggcgccuucucccuggguccucacgugguggagagaagaagcaagcucucuggacccuuaugaggacacuagucucauucaugaggucucuauccucaugaccucaucuaacccuaauuaccucccaaagacccuaccuccuaauccuaucaucagggaguaggguuucagcauaugaauucuggggagacacaagccuucaguccgugacaaagggaaauuugcuauuugugccacuuaauggacugagauacucaugguguaagaagguaguuuuucaggagcugcuaguggggagaguagggggggcuugaugggaaucugauauccaggaaguaugggaauuucacaagggagagcacaaaggaagguguaguagaaguacagaauguacuucuguacauuauguccaaaucccagaaguaugacugggauuuggacuuugccuuguugauguauuaauacuauuuuuuuuuuuuuuuuuugagacagggucuugcucuguugcccaggcuggagugcaguggcgcaaucuuggcucacugcagccuccgccuuccagauucaagugauucucgugccucagccuccagaguagcugggauuacaggcgugcaccaccucgcccagcuaauuuuuuuuauuuuuguaauaguagagacagggcuuugcaagguuggccaggcuggucucaaacucuugaccucaaauguuaucugccugccuuggccucccaaagugcugggauuauaggagugagccaacaugcuuggccuauucauacuauuuuugaggacaaaagaugguguguuaaaaaagcugcugagagaaaaugaacauuuagaaauaaugucugccuauuuguucaauuaaaaaaucauaauguuucuaaugccuaauaauuauuuuuuaaaagacagguucuuagauuuuacugaagauuaugugaagguuaaaguaaagccuuauugaguaaaugcuagaaaucuguuauuaguaaguuaugucuauuugauagcaguuugauuauuuugugugauaauuuuuauauaauuauaugaugaacuucugugauagcuacccuuuaaaauuacuuuuucucaguguuuugagauguuacaugaaagguuaaaauuaauuuuggaguuaacucagccacaguuuauuuucuauuuuguuaaugauuaacacgaaauuaucgauugguacuuagagccucuucucuugaaggccaguguuuguuaauuagugaguguugaauugcuccccggguuuaguaggcaucuugugguuaauggagacagauggucuucccuugauagaugcuucuggaaaguuaacauuccagcagugacgguuacauuccugucaggcaggacuucaggaagagaggaacuccgcaccguuugaucaggauucccaggugugacuuugcaggugaagaaauuugauuuuaucaauucauuuaggguggauggagauugugagacugaguaaagcuauccaagccaagcaagcuuacaugagauucaauucuccaguguauuaguuggcaguggaagaugugcuguagccagcuguagacuuauugaaaggauaaaacuuggaucagaauuuuguuggugagcauagaaauaagaugggaaagaacuggauauuuucaaguugucugucaagccauguggauuugacagagaacucucucccuuccggggcuauccugucuaaaaaaauggagcccaggcugggugcuuugguucaugccuguaaucccagcacuuugggaggcugaggcaggaggauuguuugagcccaagaguucaagacuagccugggcaacaugacgagacccuaucuuuacaaaauuaaaaaauuagucagacaugguggugaaugucugcaguccuagcuacuugggaggcugaagugggagaauugcuugaacccuguagguugaggcugcagugagcugucauugagccacugcacuccagucugggugacagaaugacccccugucucaaaaaaaaacaaauauauauauauauauaguuacacacccacacauuucugaacaauguuugguuucaccuguuuuuuaucuuuauguagcagaaucauacuggauguauuguucuguaccucucauuucacucaacguuaggauuuugauauuuuaacaguguugauacauguagcucuaggugauuaauuuucauugcuguuuagcuuuccguuguaugaauaugccauaguuucauaguaugaauaugccaauuucuccauucugcuguuggcugauguuuggguuucaugauuuuugcauugugaacagugcugugaacacuuguaaacuuguuucuuggagaaugugugcagucucuacagauuguauucucucuuuauuguauuacauaaagagaaauaauuucauauguuccuguauuuacucuaacagcugguguuaacaugagaauauuaguauggaauuaaggucauuuaugaauguuguuaagugaauucaguugauuccaagaucugucuugaauaaaagcaacauuuuucauaaaugacuauuuugcacuuaaaaaauauugaaaaauacuagaagauaguaacaucccauaauaucaccacccucauuugguaauuauaaaauuaggcuguaaaaauuuuguuuuacugucaguccuauuugccucugccaaaacacaccccaaccgcuuuacuuaggaauaguuuaucaccauuaccaauuaugcuuuucaccuuuacuuuguguuuagaaaagucaugucuauacauuugcauauauuauuaaagauauauaguauguaaauauauuuuuuagacaauagcuuguaaaugcaauuuaauuuuuuuuccucuucuugcugaauuuuuuuuuuuuuucaaaaucgggauauuggccagacgcgguggcucacgccugaaaucccagcacuuugagaggcugaggcaggcggaucaccugagguuaggagcucgagaccagccugggcaacauggcaaaaccccgucucuacuaaaauacaaaaauuagcuggauauguuggcgugcgccuguaaucccagcuacuugagaggcugagacaggagaaucacuugaacccaggaggcagagguugcagugaaccgagauugcgccacuucacuccagccugggcgacagagcaagacucugucucaaaaaauaaauaaauaggucgggcaugguggcuuaugccuguaaucccagcacuuugggaggucgaggcggguggaucaccugaggucaggaguucgugacuagccuggccaacauggugaaaccccgucuuuacuaaaaauauaaaaaucagcugggugugguggcacgcaccuguaaucccagcuacuagggaggcugaggcaggagaauugcuucagccugggaggcagagguugcagugggccgagaucgugccauugcacuccagccugggcaacaagagcaaaacucggucucaaaaaauaaauaaauaaauaaauaaauaaauaaauaaauaaauaaauaaaauugggauauuaacacugauaccauaauauuaucuaacuguagaccuuauucagauucugucaguuauccccaaaauaucuuuauaguaagaaauuuccagaucauauguuacauuuaguuaaccuggaacagcuucucagucuuucuauguuuugugaccuugacauuuucggagagaacuaggcaauauuacauagugucuuucaacagugguuuguuguuuccucaugccgguauugagguuuugugcuuuccguagaaaugcuacauuagggacacugcguucuucucagugcaucauauucagaggcaccugauaucuauuugucucaccauuggugauauuaacuuggaucccuugguuaaggucagguuucugucagauuuuccgguuucucugguuuuucucaggaaaguuacucucucccuuauuuccaauaauaauugucuuauggaaugauauuuuuagauuucguuaauguccuguuacuccucacaccuuuaacccuaggcuuuuaaaaucuauugaugcuugugugaaucauuuauucuuuccuaauggugauuuuuaaaaguccaucauuucuucuucauuuauuuauaguugacuuucuucccucaaaaagagcuuucucuucacucucauuuauuucagugcauauucauggauucuuauauuagucuuaauguguuaucauuauguauuuugaugcuuaaauuaucccagauuuggccaguaggaguuucuucaagcugccuccugugucuuuugacacaucuccauuguucuuugaacauauucuuucuugugcauguagaauguuucucauugcguaccuucucugccucagcccuagaaucagccgguucuccaagaaacucuguaugagagugucuguuucuccauagccuagccaagagugacuuuuuuuaaaaaaaauuuuugccaauucgauaguugagaaauagcaucucaauguaauuuaaauuuguauuucuuccacugugaguggaacugaacaucuuuaauauaucuaagagauauauaugugugugugugucuguguauaugaguauaugugaauauauauguguguguauguauuuucccauguccuuuacccauuuuucuguuguuucugucuuuaagaguucuuuauguauuaugguuauuacuccuuuaucugugauaugaugcaaauauuuucucccauuuuaucuauugccuuauguuuacaauggaguauuuuuggccauacagaaauuaaaaaaaaauuauguagucaaaucgaucaaucuuucagucuucccaauuuugaguuguaguuagcaaacccuuuccuacaucaagguuagagaauucaccuuuuuucccccuucuagugguaguauggcuucauugcuuuauuuagaucccugauucguuuggaguuuauuuugguuuaugguaugagguuuuccaaaugagguuuuccaguggcuagccaauuauuuuaacauuguauuaauccauuuucaugcugcuaugaagacauccccuugacuggguaauuuauaaagaaaaguuguuuaauugacucacaguucagcauggcuggggaggccucaggaaacuuaacagucauggcagaagaggaagcaaacauguccuuuuucccaugacagcaucauggagaugugccaaacaaaugggagaacagccccuuauaaaaccaucagaucucaugagaacucacuaucacaagaacaguaagaggguaaccaccugcaugauuaaauuaccuccuacuggguccuuuucaugacacgugaggauuaugggaacuacaauucaagaugagauuuggguggggacacagccaaaccauaucaaacaucauuuauuaaauaguuuuugccuuggugauuuuagaugccaccuuaauaauauacaauacuaaaacuucaucugcacuuggaucuguuuuugaacuuucuguauuauucuguugguuugucugucuauucaugugucaguaagacacuuuucaucauggaggcuuuagacugugauuuaaugucuggaagaacucggccuucccucuaguguguuaguguuuuccuggcuguuacugcacauuuauuuuucaauacaaggcucaguaucaauuguaugucuccauuaaaaaaacuugguuuauuuaugaggauuacauuaaauuucuaaauuuaugaugaacugacauuuuuauguuaacuuguucuaucugaauauaagagaugucugugguuaaacucuucauuugugucuuuuuaagaaugcuuuaaaguuuuccucagauguguuuuauacauuucuuuuaaaauuuauucuuaagcacucaauuuucuuugugcaacuugcuuuguuuccauuuaauguaucauauauagcugaacaggucaguacauguugaucuauuucauuuuaaaaaauggauccaugauaaguuaucucuguguaucuauuaguaugggggaaugugaggguagcauaagucauaauuucuaucuuaaauaacuaaaacauaguuuuggaaaucagacauguuuauuuauguacauuaaaaacuauaaaaaauuccuguguagguauuuaauucacuuccuugaauugagccuagaagaaaguguugaauuuaguuuaguggagaggaccaaaaaggacauucugugugacaauggcaugggcuaaaguagaggcagaguuucacaugucgugugaggucagugaaauaacuggcucagaugguguuucuguacccaaagauaaaguaagagcaguuauuggacaaccucgagugcccaaagaaagcauuuggauuugucacacuggcagcagaggccuucugaacuacuaaucuauugcaguguaacaaauuauccccaaauuuauuggcuuaaaacaucaaucaacauuuauuaucucuaacaauuuuuguacgucagagauuugggaucacauuaacaguguucaggcuuggggucucuugcagugaagucaagauguuagucagggcugggcauggaggcucaugccucuaguuccagcacuuugggaggcugaggcaggaggauugcucgagccuaggaguuugagaccagcuugggcaacauagcgagaccccaucucuauuaaaaaaauaaauaauaauuuuuaaauagauguuagccagucuucagucaucuuaaggcuuuacuggggcuggaggauccucuuccaagaugguguacucaaauggcuggcaaguugguguugguuguuggugggaggccucaauuccuccucuaugugggacucuucacaggguugaguguccuuaugacauggcagcugcacuccccagaucgagcgacgcaagaaaacaagacagaagcuucagugcccuuuuugaccacgccuuggaaaucaucccccaucacucucgccauguucuguuccuuagacacaagccaguaaauuccgcccacauucaagggaaggggagcuagguuucaccuuuuaaaaagaggugugucagagaaucugggaacagauuuuacaaccaccacacuguccuaaagaggagugaugguguaauuuugaaaaggaaaaaaagucugggauccagacaaagauuaaucugguaguaaugucaaagaugaauggaagaaagggagaaacagagguggaucguagugcugcgaucuagcagucaagugauggauuuaguugggggcagugagagggcagagguaggacacauggaagggaggcagcagaaucccuucccugugaugguugagguuucaaugacugaguauguagagaaaaucagagcagugacuuuggggaaagccaugguuugggauaugauuaggaaggggagcuggaucuguugcauuagagagaaagaagagccaguugaguuccugcaggagcaaaaaaagcagagugaucaagagcuucagauguugcagaauucgcagagaaugauguuugaaaugaaugcauuugcuugcaagguuauuauaggugacagcaguuuaaguggaguagagcaauuuuggaaauuggauuauaacauuuaauucgaugauuaacuuuuuacaaagugcuagaggugggaggaugaggggcugguauaccauucaccacucauauuuugagaucuuacaucuuucugccuccugauaguacccccaagccucccuggaauggcacuuccacucagcucuuggauugagggcaauggaggaggauuuuaccucacucauuuucagggauucuuuuaacugcauuggaaaucaacuuacuuuauuauuuuuuuacuuuacauauugcuuuuaacuaucaugugugcucuccccuagccccacucauuucccucccuuucccuucuuccuggucaguaagcauuuaagaucaugauccaguacaaagaccuauucuucucccuuaccucccaacuucaagcaugauucuauuauucauaugcuuuguuaacugaacuugcagggaugcaauugauauauaagaaauauaauuaaaauugcaaccagcaaauguaaauacuaaauugaaagauucuugguuuuuuaauuuuaauuuuaauuuuuuguagagauggggucuugcuguguugcccaggcuggucuugaaucccuggccucaaguuacccucucgccucagccucccaaagaucugggauuacaggcaugagccaccaugccuggccuuauuuaguauuauuuuauguucuguaucuguacauagauuuaaucuguuuucaaauuagugaaauaauuaucaauaagauggagccaaaacaugaaaauaauuuuaaaaugucuuuaugugacauaacacagauuuguguaaggauuugagguuaaguggaccaaagaauuguguaguaaaacacugacaaacccagaaauuaaaugcgaguuuucucuguaacaugaugugacgaugauuauauuauuauuauuauuccugauaggguuguuuuccuuuuaagaagaaauguuggguccauuuaagacuuaaacuaaauuacaauagcauuaauaacuaugguuccaaauuaagaguagucuuuaugcugugaaaaaagaacuauuguugauaaguucguuuuagaacaaaaagauaugauuguucucaguaacaucaucuuugaauaaauagggcagccucugaugauguagccucguuuugcagugugcgugggaggugagcacagaagagacaaaagggccaggggauggugagaaggaauagcagaagggagggacaccugggugccuucaccguggauggcacagaucguaagugacuggagggggcagaggcucugacugugucaguacugccauuagguauucauuacauagacauuaagcuuuuucugugugucugugggugugagagagggagacagaaaagaaagggagugauaauguauaugucuccagagaucacuguguuguuuacuuuuacuguuaaagaucuagggccaggugcggugacuuacaccuguaaucccagcacuuugggaggcugagagcagguggauugcuugagcccaggaguucgagaccagccugggcaacauggcgaaaugcugucucuacaaaaaauacaaaaauuagcuggguguggacccagcuacucaggaggcugaggugggaagaucgcuugggcccggggggucgaggcugcagugagcuaugauuuugccacugcacuacagucuaggugacagagacccuguaucaauuaaaaaaaaaaaaagaucuggauauauuuggagauucugucaugguucuuacucuuguacuugagcaguugacaaaaaguuaaucugguuaauugauacauuuuccauuuccuguuucccacucguccuauucccuccucuuucucucuauguucucugagucucacuucaaaccuuguggguccuagaagcuuccaccgagugucucuuccauuuccagggccccacacuugccgggcacauuguccuacugugugcuccaucuccagaauguccugggaaucacucuguguguagguuucuacaaccuguguuauucgugucuguuuguguguuuguuuucgcuucucugagggaggagccaagucucauccguguagcuccacguguaauaaaugugagucgagugaacgaaugaaagauuuccccaagccuuguaguggacgugcuuggaccauggugguccaucaguguggcaguggagucccugagcauugaggauugggagacgugugacuagagagguagaccacacaagccaugaagcaucuaggggugacugcaaacugagugaggcaggucuucugguccugugcugcuccacacagaagguuucagggaugacuuggaagcaagaaacagguaaaugcagugcugcgugcuaagcguugcaaccuccugcacaaacugcucugggcgcuucaauuaauuuggacuguggggguuggucugggaagacuggcguuuugaguugagucuucaagagcgugcaguugcccaccaaauggagaagaacaaggagcauguuucagaagcagcauguaccacgcuguagaggugggaauugucauuuucuugagaaguuguaauggagcuuaagguucaggggcguugggaagugggaaagcagcaggaaaugagauuggagagggccauguguguaaugcugaaugacuggccuuugccccauuggcuguagggaaccacuggaaguuuuaaaaucaggggaauggcggagauucacauuuuagaaaaaugccuggcagcaguguggaagauggacuggaaggggaagacuaaagagaauggacgaguuaggagacugcugcaaaguccaggugagcacggggaagggccuggauuaggccuugacagcggcgauguggcagagaagacuaaguugcaugugauuuugggaggcggaauuugcgugacauaccagagcugcagauaacaguugugggagggauggaagaauagagaaggaagcuuuuuuuaaccuauagccauugaaugggagaguagaaaggaaacauugaguuugguucuggacauuuuagaauggggcacccaaauggagagaaccagcagacggaaacauauucacaugugugugaaugggugagauuauauaaggagagcuugcugagcaaaacgagagagggucaugcagaggacucugggacacuccaacauuuaaagggcacacucgggaaaagagccauuuaagaacaguuucaaaaggagagauagccacaagaggucaagcugagaugagcaggaauacgaagccauuggaacagagugagacccugucucaaacaaacaaaaacaacaacaaaacuuuuucaaaagaauuuguuguaagauuuuuaaaaauaccaagcacuuuucaguauguguguguguagcggggguaaauauauacauaacauaaacuuuaccauuuaaucauucuugagugguuuuuuuggcauuaaguacauucacauuguugugcaaccauuaccaccauacaucuccagaaccuuuucacuuuccaugauugaaacucuggcugggcgugguggcucacgccuguaaucccagcacuuugggaggccaaggcaggcagaucacgaggucaggaguucaagaccacccugaccaacauggugaaacccugucucuacuaaaaauauaaaaauuagcagggcgugguggugcgcaccuguaaucccagcuacucaggaggcugaggcaggagaaucgcuugaacccaggagguggagguugcagugagccaagaucacgccaccacauuccagucuggacgagagugagacuccaucucaaaaaaaaaaaaaaaaaauucuguacccauuaaacaacuccccauuucccucuccuccaucugcugacaaccaccauccuacuuucugacuacucugggaaccucauacaagaggaaucauacaauauuuguccuuucgugacuggccuguuucagcgcaacguauucaaaguucauccauguuguaaccugucaggauuuccuucagcaucuuaaaaauauaauuugaauauaguuuuuuuuuuuuuuucaagaaaccaacuauuuacaaccauuacaaaguccuacgaucugccacaucaguuuuacacagggaagggaauuagaagaagggaauucacgucaaucacagacauccugucgagcaugugucaggugccacauugguucuaagugcuucaucuaacucauugaaucuccguaacaauucugugcagugacauuauuuuucucauuuuacagcugaauaaacugauuuucagagaguuuauguagcuugugcaagaccacacagcuggcaaauaacugagccaggauucaaauccugaucuucccaauacccaaggccaugcucuuuuuaggacccuucaguucucccuuuaguccuuucucuaauuaugucacucugaaggagucaaaucucuuugcuuugaauuuaaugaaguugugcuuuaagguuuuccugguguucagcaaauauacaaggcuccucaugacauuaaacugcucuuauauuguauuuaaccuuuuaagaacagaaucaagcauuugccaaaaguagagaauuaauuguguaacuaauuaauucaguucacauaguuauuuguuuaauguuguuugaugugucuguccaacuuaauauuuaucuggggucguugacagaacuacguugauuuguaggauagguuucugaaggaaaauacuuuuuuuaaacuaaacaguuucuauucuaaucacaaauaggaaaggaagaaacuuuuuaaaaugaaaaauauauaaccacucauuuuugaggaucucacaaaaacaaaguauuaugcaaguaaucugaagccaaaagccacaggcugagauuugccaugcugaagguuuuuuuuuuuuuuuuuuuaaucuacaaauguuucuuugaauucuugaaugcucuauccugugccagugaaagauguuuuucuuuaaagaucuuagcagugacugacauaucacuguuugagcagaugauccugagaaaguaaccaaagccauuuacagaacaggcguuucuguaacuugggcccuuuacggaaguaagccagugggcuugcguguuguuugaagacugggcuuaucuuuguucaguguuuugcuuugagagcacgacugacuuugaguuucaucugcacucugugaccaauugugagacagacccaaagucugaaguuuguguugacuuuagaaagucauucucugaagccuuuuuuuggaaugaguuuaaagaaggaagaguaccaaaagccagguccagucuuguaguggauguuuuggaaagaaaggaucaugguucucugggaccaucagaguggaucagauuacauucuaauguaaugaugaaaacaaagaacaauaaaucagagggacucuaaaacauccuaaaaucuucccucaggcaaauaauaccaaaucuucgaggguggauaauuguuuucucuccauuuucuuuuuucuuuuuccuugcagauugacagaauuaaaaauuugacaagccccaucagugguucauuuaaguguuuugguauacaggugauuagaaacuauaaaaucucuucugcuuuauuuuaaagcuauugucuugcucagacugcguaauuuaaaggcaacuguguuaaugucuguggugaaaaauuucugauccuaaaagucauggacaaaaagggggcauuugccuaccuagugucaaggagcuuaaacuguaaucagaaguccaugcauuauuguuuuauucaaauguaaagggaagaugaaugcucaagauaccgcaaaggaucuucuuaaaauaugcaauuugugugacucuugcugagucagaugagugggugaugcugggcagagcuguagaagaaaacugacuuucagcaaggaauaagaauccaugcuaaacaguacagaagugaggcugagaauaugcucaaggagagugcggugguuggaauguuugucccuuccaaaacucacguucacauuuaauccccaguguggcaguauugagagguagaaucuuuaagaggugauugggucaugagggcuuugcccucaugaauugauuaauccacucauggauuaauggauuaacggguuaguggauuaauggguugucaugggaguggggcuuguggcucuguaagaagagaaagagagagcaacacucagcccccucgccaugugaugcccugcacugccucggaguuugcagagacucacgaccagcaagaaggcucucaccagauaccgucucucaaccuuggacuucccaguauccagaacuguaagaaauaaauuucauuucuuuauaaguuauccaguuucagguauucuauaagcaacagaaaauggacuaaaacagagagggaagccucuggaagggggaagccugagugguuaaguggugaguccagcagcugaggagaaaacuuuugaccugaaaggacuagaucugggacccagauggaaaacgacuuccucuuuuuaccuugggguuugagagagugcucagccugggucuaggaguggagguagaccagccuaacagaaaggacugaguccaaggaauugcuagccagagggaaaauaaaauaaaaucauggaaggcuugggagaugccuuuugauacuuuaaaccaagcuuguccaaccuguggccugcaggccacauguggcccuggacagcuuugaaugcggcccaacacaaauuaguaaacugucuuaaaacauuaugagauuuuuuuuuuguaugauuuuuuguuguuguuguuagcuaaucgcuaucauuaguguuaguauauuuuauguauggcccaagacaauuuuucuuccaguauggucccgggaagccagaagauuggauaccccugcuuuaaaccuaccaugauaauuggauacugugagauuuuuauguguaaaauguaguccagauggauagcauuugaauucccaggauacauagcaguaauuuuuuuguuuuucauagcaguaaauuuuuugguguuuuugaacaaacucgaagucuauuauucacugcggaguaccaaguaggauucucucauuagcagauaagagaaagcaaaauauugugucuuuacaggagaaaacuauguauucaauuaagauagggugacaaaacccaagugugaaaccuacuaguggggacuggcagaaagauacccuauuuaaacaguguucuguccuuacguaacguuauucucuaauuggcaucucuuagaaaauggcuggauuuggcccacuuaguuaaguagguccaggaggggcagagacuuggaguuuauucauuuugggaggaagcccagaauagucaauagaacuaaagguaugacgauaguguuaggugcauguccuguaauguaguuggaauccuaaaaacugggauaaguuugagguguagggguuacccgauuacaauuuaucccugguuuuugucuucauugucugcauugcuguuagguuuucugaagccuugucuucucuaguuuaaauuggagcaggaauuauucuuugauaaaaggcaguaguaccucagcuaacuuucucacucagaauauauuuagucaacagauaacuguugacacauacuaaauacaaguucauuacauacuuuuggaggauauaaagauaaaucaggcagaguuuauucuuuucucauguaauggggguggaggcgauggaccaucauuuaaugguugagaacugggguucugcagucagacccaagcugguucagacccugguguugcaauguaccagauguauagccuuggaaaaagcuacucaaucucuacuaaaccuuccaaggcuauauaucuagugcaugucaacaccaggauauguauaauaguaccuaugucauaaggauggcuggaggccuaugagauaaugguuguaaaggguuuagaagacuccccagagcauagugagcccucucugaacacugacaacacacacaaaugaacagaggugcuuuauggacccaggggguucuggcuuugcugauguccaguguuagagguauggcuuggggaguuaccuauauuggaagcaaucacucagacuguaugucacuggaugacuugccagaggcaaacaagaaacaacauggcagacacagaaccuuauuuuuuuauccacaaaaguggacuguauuuuucuguuugcuuugauguuuuguuuguauuacuuuguuuuuuguuuuuguuuuugagacugagucucgcucugucgcacaggcuggagugcaguggugugaucuuggcucguugcaaccuccacuucccggguucaagcgauucuccugccucagucccccuaguagcugggauuacacacacugccaccgugcccggcuaauuuuuggagaugggguuucaccacauuggcuaggauggucucgaauuguugaccucaagugauccgcccgccucagccucccaaagugcugggacgccuggccuguuuguauuacuuugugguaacucugccauuaggggaguugaaucagacucaucugauaugaagaugacuuaaucauuaauuauuuuaguacacaauuauugagucuguuuuugcacccauuauggguuccagcacuagaucuaguuuauuagcacugaaaguaaauuaaagacuaagccauauuggugguuggcucacagacuuaggaguuuggcuggcuguuaaggaucggagucuguaauauuagaaaguuuucaggcaaaaugaaagaaacaaccagauaauaauuugguaaauaauaaaggaguggugaaguuggauuuccuuagcugacucuuuugcucagacauuguggucucaacuuacuuaucucuaaauauuuaaauagauuacugacuggccugggaugugguuuguucuuuaaaaaaaaauguuauguaauauuugacccauacaaaagguuauauaauucuguacaauuaauaggacguuauuaacacacugaagcuaccgugugaggaggugccucacucauguacugcauuauuauagcuugcuaaacauaccuugguuaauaaggaacuauuucuugaaugucacuuccuugucuccugccacgcaucugguggugggcccggagcccuuguugaccaauaggcucaauauuugugagggagaccuggacagcagaguagagguguguuaggacacgcugggcccugccagcauuugugucugucaccucuaaccacgaagaggauaaugacuugagagagcagugccugcugcugcagcuccuccuucccaaucucaagugaauaccucuugaauuccucuagcuguagccuagaaucauguauagaaaaggauucugggaaauguaguuccccuuaaccaaaugcuaacaguacaaacugcaguugugcaguuaaguauguguuuguacuuauuuguuauacuggaaacaggagagauauuuguaauuauuucugcuuaaaagauaucagaauaguuauuuacuauucagguaucagauuuguuuaaaaaugacauuuaacuugauuauaucauuauuuucuuuuccauuaaacccuaacaauuuuuaaagccaugaaauaacuuaaaaaacagaaguaauuuaaucuuacccucuccuuuggaaagaaaauauuccuuuuuuaaagugaaagcaaguuucaaaaaaagaaaaggaauaaagaacggcuacuccauaggcagagcagcggccuggucugcuugacugaguauccuugcaguuauuucuggauuauaugcuaaacaagggguggauuauucaugaguuuuccaggaaagggguggagauuucccggaacugagaguuccuccccuuuuuagaccauauaggguaacuuccggacauugccuugggauuuguaaacugucauggcgcuggcaggagcgccuuuuagcaugcuaauauauuauaauuaguguauaaugagcagcggggacgaccagaggucucuuucauugccaucuugguuuuggugaguuuuggccggcuucuuuauggcauccuguguuaucagcagggucuuugugaccuguauccugugccgaccuccuaucucauccugugacuaagaaaauauucuuuuaauuugacaaaucaaguuggaucucauugugcuaaaaaagguuuuuaaaaauauuauccaauacagugccaucuagugacaaaucauuuacuugcugguuauugaaaauaguugacuacaaguuuuauguccugauaagucaggaacuucacuucuaauugugcaaauucuuaagacauauuuuaagcgacuauuucuaaauaaauaaaauauuuguaaauagagagcuggaaaauauuuucuaacccucagguuuuauacauauguaucacaaugugucuuauuuaaugccacguggacccaggaguaaaaucaaaaucaguguuuugucuaauaaggugguaauaggauuauuuuagaaaugugauguaaaggaaugagcauggcuuuaaaaucaaacagacaugaguuugucuauuuggacuuauuuuucuuaugacuuagcagguaauuacuaccugcuuggaagugcaccaagcacuauauagguacugccucauuacauauucacaaaacucuauagguauuuuacaaaugaggaaaccggccaggcacgguggcucacgccuguaaucccagcacuuugggaggccgaggcgggggaaucacgaggucuggagauccagaccauccuggcuaacacagugaaaccccgucucuacuaaaaauacaaaaaaaaaaaaaaaaaaauuagccgggugugguggcgggcgccuguagucccagcuacuugggaggcugaggcaggagaauggcgugaacccgggaggcggagcuugcagugagccgagaucgcgccacugcacugcagccugggcgacagagcaagacuccgucucaaaaaaaccaaaaaaaaaaaaaaaaaaaugcggaaaccaaggcagggcaaggaaguguuauggugcuuacuucauuguuuuuuguuguuguuguuuuuugguuuuuuuuuguauagagauguagucucacucugucacccaggcuggagugcaauggcgugaucucggcucacugcaaccuucgccuccuggguucaagcgauucucaugccucagccucccgaguagcugggaacacaggugcccgcuacugugcccggcugauuuuuuuauuuuuauuauagacaggguuucaccauguuggccaggcuagucucaaacuccugaccucaagugauucgcccaccuuggccucccaaagugcugagauaccucauuguauuuuauuguguguguuuauguguuucuguaauaaaagagugccccuuaacagagaaggucuuacucaagaauauuguguuuuucccugccccuauuauagacugguaugucugcaauucaacugcugaauauuugauuuuuuucuuuguccaugaaaugaaaacacaauacccuugacaagaacaauaguacauuacauuguuuugauaaaauaucauuguuuucucuauauucaagaguggaaaauauauguaauuuuuuauaaaggguauuauacaguggcacaagcacuaaacuaagcaacucuggguucuagucucuacuuggccacuuuuaaacuaguguuaauuuaacucuaaaguuguacaugcacacaacccgcauauuccaagagcuuguuagguacaaggcuuguuacaaagaccagcagucuccccgcugucacuccugccccaucccuugcucucugagcucaacucuuagagcggauuguucugcuuguuuaccuccagcucucuaaacaggcauugcucuauccucuucuuacuuuuucaguguuaggcauuaccuuugaccucucaugauaaaggagaauuuaucuuuuuuuuuuuuuuuuuuuuuuuugagauggagucuugcucuguaccccaggcuggagugcaguggcgccaucucggcucacugcaagcuccgccuuccagguucaugccauucuccuacgucagccucccgaguagcugagauuacaggugcccgccaccgcgccggcuaauuuuuuuuguauuuuuaguagagacgggguuucaccguguuagccaggacggucucgauccccugaccucgugaucugcccgccucggccucccaaagugcugggauuacaggcgugaggcaccgccccggccaggagaauuuaucuuaugcacccccaccccaugugcauagcccuuuucuuuucauuauaauuacauuuugaauaauucagcauuuacauuguuaggacuuugaaaacauuauucccagcugaguuauauaaucuaugguugccuuuucuuuccagcacaacuuuuuguuuucccugguguuaauaauucuuuucuuuucuuuuuuuuuuuuuuuuuuuuuuuggaggagggcuuuguuuguuugcuuagauuuuauguacuuuucccguguucaucccuaaacucuucccccgguguaaucuacuugugucgaaaguguuagggugcucugaaacagcguugucagccugcaggcagccauccucucuggcuguguugucuuuucucgaguuagcuggaacucucugcugccucccagagggacggugagacuuagagucuggcugaacgugaagcccuauuuguuugugacuaagacugcuugucagcaagaacugucaagaaugagucuucugacaggcagaagcacuaauuagcuuuuaccgugaccagucaugaagaagcagaguagguaaguaaaggugccaggggugaaaugaagaccacaugguauauaagauaugugcaaacaauaguuaaaacagaaagaauuguuuuucuuucuuucuuuuuuuaaaaauaccuuuuuaaaaauaauggagauggguggggggggggguugggaggagggucuugcuauguuccccacgcuggucucgaacuccuagccccaagcgauccucucacuucagccucccaaagugcugcgauuauaggcaugagccacugcacccagcugagaaggaaucugugaauugcuucucauugauuguuacaggaaaugauguuggagacaugaaugaucuaauuaaugacucuuagcuuuguauauauuuuguuuaccucaaucauagauuuggucugguugugaaucaugucuaagauguuacuuuuggggucgucauuauuacauacaugggagaaaaacuagagggcagaaggagucucuacuauuuucauuaauagaacaauuugcuacagaacuguuuuaaguauuaaauacacaaaagcugccauucuagauagcuagcaguaggaggccacagagaucaugauucugguggaaucagauugaguccugcagauuuccuauuggaauuggaaaagaaaccaaggguaaguagucuaguugaaaugcuguaaacccuucuuaaaauucaggaucagauaaacuagauuaaaaaugccauccuguuuuucauaaugcaguaacaaaugaaucuaaaaugugcaacaccacuuucuuauaugcuugugacauucuuaguaaauaaaacaagcagaguagguauacugauguauaaccaccacuuuuuuccauugcacuucugauuuuuaguucuugaguccccaguccaggcccugauuacuuuauguccagaugacuuucauagccuucuaaugacgcuuuauaucuuguacuccuccacuucauucuauguauugaaagcaagaguuuucaucagaaaugguuucgucacacguguccuaugauaagcaaccuuuaguagucuccugucaaauaguauuucaaguccaagccucuccauucauucauucacucauucauucuagacauacauaucgggugccuuuaccugggcuaaaccuuggcucucaagacagacacucggguaugcccccaagagcuuuauauuugcaugugcauuuucucaguguucugcagucucuguuacggcugaguaaacuuaccuugucuccccuaaauuuuuaccuuugugccuuuaaacauaaagcagcgucugucauuuuauaauucucuucuuucagaacugccucugguuauuaaaaaccugaucuaccucuauuacucuaugaucuuucagcuuuguguuauuuaauuuacaccauauuaauuucauuuauuucuaguuuuucucuauuaaaauucuaugugugugcuguugcuuaaguacaagguggucuuuuauuucuuuacauuuccuguuaaugccaaauagcguaaauuccuucuaaacaaaggaaauauuacuuuaaugacuacagcacaucccaugggucgcuuucccuguaaccuuccagugcccucuucuuuucuagcagaaccuccacuuugcuuaagaauccacucuucucuguauacccauaugcucuggggaagcuaggcucaggccccagucacagcccacggcugucaggaagguucuguucuugccaguugauagguuugagcaugaacaugugacccaguucugucccuugagacauaaagagaagccugguggaggcuuccagaaagguuugccauccuggugaaaaagaguuggaugagaaguucugcccacugugggccaagcuccagcugucuugcagccaugaagggagcuagcccaagcaucaucgccacauggagcggggcagaaagacagcuggggcgggggccuuacugcauugcugagccauccuuuguugggauuucuuguuaugugaagauagugaggcuuugucggcuugggauuuucucuuauuuucagacaaaggcgucuggcuaacucuucaccaucagcucucaguuuagauuucccugaucucugacaacaucuccugccaugcguuuaccacaccacguaguaauagauuauuugcuucucaggaccacaauugacuguaaacucuauaugagagcaggaacuucaccuugaucacuguuaugagaugugccuacaaaccagcauaguaccuggggacugauaaguuuugaacaccuauauuuauucauguuauccugaaaguagaugcagaguuucuggggcagggacaaauuaugauuauuauagcaauaaccuaggacaacagacuugaguuuauaaccccuggaagauuuccacaguccugguuucaucauccuucugaaauguaaacacauagcucaggggagguaagucccucacuaucuguucagucaucuuuuaaguuuuaagguuguccuuuaacacaaguccuaguaaaauuuucccaguucuaauugugcagaaguauaaagacacucacuuccucacacugacagaguaggugcucaauaaacuauuuguugaauauuuaacaaauuuaaagaauaaaucuaauuuaaaucuaauuuaguggugucaacugggucagggauugugggcuuuugugggggguggggagaagcauaugagaaucaucuggggggcauuuuaaaucaacaggauacuucucaccugccaguuccgacaucuccuauuacugucauauuccuuaggguuuuuagguuuguuuuuguggccaaaaggaugagaacuuggauauagcccacacuauguuugagccuuucuuaugaaaguuaggaauggaaccauuuguguugacaccuggucccaaggcugcuaucucaauguucacauucauuccaccugagucuucuguuuuguguuuccuuguacggauuugguagaauauuuauuaaaggauguuucuuuuuuuuaauuaauagcuugccuuuuuuuucacagaggguuugaggcaacuuuaccacacaaauacauaaaaugaaauagcauauaaacagaaaaucagaacugagaaaaaagguugcacauguguugauuuuaauucagauuugcuucauguuuuuauugaugccuagugcaaaaugacaaauagcaucaauuauguuaauaauuuuuaacauuuuuauuuaagccacaucccuguguuguaaucuaugagaccucuucugaaaagaguucacacacacacacacacacacacacacacacacacagacacugucucucaauuuugcuauaaugucugucccuggcacaucauggaaacuuguuauuagagaaggugaaacauacucauuucuuaggaggaaaaaaauauucuugguauuaaguucuaaaaaauuuauuucuuuaauaaaauauucuagacauauagaaaaauagacuaagcuaucaaauaccaucaguuuuguaauauuugcuuuagauuuaaaaaaaaauagagacgaaauagagaccucuuauuuagcucuuuuugauucuauucugcucuuuuccucuacaguagaaaccacuauccugaguuuaguguuuaacauuuccaaacauauuuuauacuuuuacuaccuuuguuuacauuugcaucauuuuauauauauuuuauuuuauuuuauuuuauuuuauugagacagggucuuacucugucacccgggcuggagugcaguggcaugaucucggcucgcugcagucuccaucucccaggugcaagcgauucuccugccucagccucccgaguaguugggauuacaggcaugcgccaccacauccagcuaauuuuuguauuuuuaguagagacaggguuucgccauguggcuggucucgaacuccuaaucucaagugauccucccgccucagccuccaaagugcugggauuauaagcgugagccacggcacguggcccucaucguuauguauguaagacauuauuuuuuaugauuugaaacuuuauauaaaccauguuucaucguaggccucugcagcuagucuuuucaccuaacauuuuuuuuuuauugugaaaaaagaaacacauaacaugagaguuacccucuuaacaaauuauuguguaugcuacaguauuaacuauaagcauaaugugguacagaagaucucuggaacuuuucauuuugcauggcagagacucuguucccauugaauagcaacugcccauuuuucccucccuccagucuggcaacagauucuacuuuguguuucuguaaguuugacuacuuuagacacuucaucuaugugguuucaugcaguauuuguccuucuucacuuagcguaauauccaucacuuagcaacaagguucauccauguuguaacuuacgacgagauuucuguuuuaaggcuaauauuccacuguauguauacaccauauuugcuuuguuuuuucauuuaagauggauuuuagguuguuacuaccuuuugguuauugugauuaaugcugcagugaacaaggggguggugcaagcauuucuacaagauucugauuucaguuuuuuuugaugaauauccagaagagggauuucugguuuauauuguaguucuauuuguaauuuuuuaaggaaucuccauacuguuuuccauagaagcugcaccauuuuacagucccaccaacaaugcgcaaggauuccaguugcuucagauccucaccaagacuuguuauuuucuggguuuuuuguuuuuguuuuuuauaaugcccauccuaacauauaagaggugacaucuuacugugguuuucauuggcauuugaugacauguacgccuuggccauuuguauaucuuuuuuuuuuuuuuuuuuuuuuuuuggagaaauaccuauucgagucuuuggucuauuuuuucaguggguuauuugggguuuuuuugccacuguuguagcaguuccuuauauauuuuggauauuagccccuuaucagauaacaugguuugcagauauuuucucccauuccauaggaugccuuuuuacucuauugauucuuuauucuucuuugauacuuguagcuguccuuauuucuuucauaaauauacguaauacucauauauaagauauuucauuaugagacuauauuguaugcauauucuccugauucacauuugaauuguuuccaauuuuuugcaguuaccuguauucugauauguaccuccuuauguucgugugccaauuucucuaguguacauuuucaggaguggaauuacuuggcuauagguaugcguaucucaucuuuauuagauauuaccaaauuccucuccagagugguugacucaguguaacuuucuuucauuagugugauacuuugccagucugacgcgaaaugcuguuucaucguaguguuaaacugcaucguacugaacuugaacaucuuauguuuauuuucaccgugauuuccuuuuuuguuaacuagcuauucacaauuuuuugccucauuuuuuucaauagaguuguuuguauuuauuuacugacuuuuaggacuuaauguauccugaaaauuaauaccuuuuuguuauguauuuuguuaauaucuuguagucugugguuugguuuuucauuuuguuugaagaaccuuuuguuagaauuuuuaaaaacuucaacauaguaacacauuuaucagucuuuuacuuuauaauuucuacuuuuguauguuauuuuaaaaaucauuaccuaaagagcauuuuuuuccuaaaaauugucaaaauuuuauuuuuacauuuaagccuauagcuugaaaaugugucucuaugaugugagauaaugauuuuauuuucuuauaguuaacuuaugucucaggauaacuguuguucaauagucuguccuuuccccgcugauuugcagugcuacugccaucauauaucaaauuucugaacauacgugagucuuuuucugggugcucuauuguuuuucauuuaucuuuacuguuuugcuuaucauuguuucauauaacuuaaaguuuuagagaguggcugccuguuuucuucaaauuugucaagacuguucuuggcccuuuuuucuuaugaauuuuaggaucagcuuaccaugguccaugaaagacccuguagggauuuugauuguaaucauguuguauuucaguucaguuuagggauauuuauuaagucuuccauccacaaauauaauguauuucucaacuuacuuggcuuuauaauguucucuauaaagcucuugaagauuuuuuuguuagacuaauuauuagaaagcuuauagcuuuaguugcugcuuuaaaugauagguagcuuuucuuauugaaauuacaaugugauguuuuggcuuauaggaauuauauuaauuuuguaucuugaucuuuuaacaauacugaugaacuuauuuuuuauuaguuuuaaugguuuuccuucauaauucucuauauagauaaugauuacuuggagaugaagacaguuuuguuacaucauuuaaauuuuuauauuuccuuugucuuuuuuauuaauguugacuaaguccucuauuauguuauuaaguaaaagugaugauuguagucauccuucuugcauuucguagcuuuugaaggaaauacucccauuauuuaaccauuaagugugauuuuguuguaggguuuuguuuuuguuuuuaaguuaagcaaguucuuuucuauuccugauaugugggauucuuuuuuuuuuuuuuuuuuaaucaugaagguugcuaaagaauuaacgaaagugaccgggcgcgguggcucaugccuguaaucccagcacuuucggaggccgagacggguggaucacgaggucagagaucaagaccauucuggcuaacacagugaaaccucaucucuacuaaaaauacaaaaacuuagccgggcgugguggcaggugccuguagucccagcuacucgggaggcugaggcaggagaauggcgugaacccgggaggcggagccuugcagugagccaagaucgcgccacugcacuccagccugggggacagagcaagacucugucucaaaaaaaaaaagaguuaacaaaccauuuuucauuuuuuuaaggacaaaucugaccuuagauuaacucucuacucaguucuccugaaccccugguaaaagggaaauguucaccauguuaccaggcaacauuguuguggugaaagugaccucuguuugguaaacauaucuggacugggaggaacuguaagugaacucuaaauuccugauuagaagcuguagcuuccccagaaguacugacuuuucagaaauggguauguccuuugugggaaccuuggacgccgugacuagcaccguuauaugauauuugguuucugcuuggggcacaaaguuucuaagccagcaugucugugcaccacccuugugauuuuauuuuauauuauuuuguuuuauuugagacagagucuugcucuguugcccaggcuggagugcgauggugcaauguuggcucacugcaacccccaccucgcggguucaagcgauucucuucccucggccucccgaguagcugggauuacagaugcccgccaccccacaccuggcuaauuuuuguauuuuuaguagagacaggguuguaccauguuggcuaagcugaucucaaacuccugaccucaagugaucuacucaccucggccucccagaguggcaccaaaccagcaugguaccugggcccacccuugugauuuucauuuccuugccccugagcugucagcuggaugccagagagaauagcuccuggauggccgugugggcucaugugggggcuccuuccaugaagagaaacaccugaaaccgcccuguuggcaugcuguguuuucuucuaugcuuccugaguagauaaauggcugcugauuguggccuugguaacugaguagcucagaauguguaauuagaagucccacgugggcacugcagugcauccaaacaaaauacagaaauaaaagugguuccugggguugaucuaacuucauaacucucacuuaaaauccucgauuucuaauauuuauuggaauacucauauuuucauugacuauaaauauuuuagauugaacuuacaaguauauauacuauacuaucuuuuuuaauguguuagauucuauauauguuugccaaccccaaaaugguuccacugcuaaaaaaaaaaguuugauaacuaauguuuuagaccuguacuguccaguggguagauauuugcugcuguaauauggcuauuaaagugaaauacaauuaaaauucaguuucuuagucauaccagccauaauucaagugcuuacuagccauauguggcuaauggcuacuaucuuugacaguguagauauggagcaucuucaucauuacagaaaguucuguugaacagacuuucuaggcuuuauuuuuaaaauuuauccaccuuaucagagagcauuauguuuuuacuauauaugcuauaugcaauaagaaucagcauaucuuucagggacauuauugaagaccccaguguaucauguauagaaugauccacuagagaaauauuucuuagauuugaguaccaggagaaauuuauuuucccugaaauuuacccucugaucauguccaguuuguaacugaucauuuuucccuuuuugcuuugucacuagaguguagggccaaguuuauggcucacuuuaaccauuuggccuacauauuuguaugcuuuguguaauuuuugaaggcucugguuuuaucuugcuagucugcuuauuuucuugucuggauguuuguauuaauaaaacuauaaauuuugcauuuuaagggggguguaaauaccguauaaugaaugaauaccuuuaagauuuugauugauacuucaguuaguugguaggagccauuuauuacugaaccucagaggugagaacgggugaaggagcuaaaagcagucaguccuuagcugaucauuacaguguacacacauguaaucuggacugcucaccaaaugaaauuguguccagaauugguggguucuuggucucacugacuucaagaaugaagucauggacccucguggugaguguuacaguucuuaaagaugguguauccagaguuuguuccuucugauguucggacguguucagaguuucuuccuucugguggguucguggucuugcuggcuucaggaaugaaucugcaaaccuuggcggugcguguuacagcucuuaagguggugcaucuggaguuguuuauucuucccgucuggaguucauuucuccugguggguucguggucucgccagccucaggagugaagcugcaguguuacagcuuugcagugaguguuagagcucuuaaaggcagugcaaacccaaagagugagcagcagcaagauuuauugcaaagagugaaagaacaaagcuuccagcguggaaggggacuggagcagauugccacugcuggcuugggcagccugcuuuuauucccuuaucuggucccacccacauccugcugauugguccauuuuacggagagcugauuggucuguuuuacagaaagcugauuggucuguugugacagggugcugauuggugcauuuacaaucccugaacuagacacaaaaguucuccgaguccccguuagauuagcuagacacagagcacugauuggugcauuuacaaaccuugagcuagacacagggugcugauuggugcauuuacaaacuuugagcuagacacagagugcugauugguguauuuacaauccccuggcuagacguaaagguucuccaaguccccacuagauuagcuagacacagagcacugaugggugcauuuacaaaccuugagcuagacacagcgugcugauugguguauuuauaauccuuuagcuagacauaaagguucuccaaguccccacuagauuagcuagauaccgagugcugauugguguauuuacaauccguuagcuagacauaaagguucuccaaguccccacuagacucaggagcccagcuggcuucacuuaguggaucccacacuggggaugcaggcggagcugcccucuagucccgugcugugcgcccgcacuucucagcccuuggguggucgaugggaccgggugccgcggagcagggggcagcgcucauuggggaggcuugggccgugcaggagcccacggugguggggaggcucgggcauggugggcugcagguccugagcccugccccgcggggaggcagcugaggcccggugagaauuugaacgcagugcuggcaggccagcacugcugggggacccggcacacccuccacagcugcuggccugggugcuaagccccucacugccuggggcuggcggcgccagacagcugcuccgagugcggggcccaccgagcccacgcccacccggaacucgugcuggcccacgggcaccacgcacagcccugguuccugcccgugacucucccuccacaccuccccgcaagcagagggagccagcuccggccuuggccaacccagagaggggcucccacagugcagcggugggcugaagggcuccgcaaguguggccagagugggcgccaagagcaagcgagggcugccagcacggugucaccucucaaaaugacuuagaauguauaccugucauacaaccaguuuagcuugcuuuucuaaaauguuuuuaauuuucaaaauaauguuuaaagaagccuuacugaaguugauuguaaaaaauuucaaacuuuuaaguguugcuagggaaauugaaccgaaaacauaucugauuauuuuacucaaacuagugaacaggguuuaaauaaagaggguggaggcugggugcgguggcucaugucuguaaucccagcacuuugggaggcccaggugggcggaucaccugaggucggggguuugagaccagccugaccaacauggagaaauccugucuccccuaaaaauacaaaaaauuaaccaggcaugguggcacaugccuguaaucccagcuacucgguaggcugaggcaggagaauugcuugaaccugggaggcagaggcuguggugagcugagaucgugccaucgcacuccagccuaggcaacaagaguggaacucugucucaaaaaaaaaaaaaaaaaaaaaagaguguggaggacucuuuuuaacuuugcuuaugaagagaguuuuguuuuuuuuuuuugggaugacagucugauucuggguauucaugccuucucauuggaaaaucaccacugugcuuucuucuuuuuuuccauuuuuuucuuucauaguuagagauggagucucacucuaacuguaacugcgggaggguagugauguaaucacagcucacaguaccuccagccucagccucccgguuagcuaggacuauaggcacacauuaccacaccuagcuaauuuuuuuuuuuuuuuuuuuuuuuuuuaaagaaacagggucucacucuguugcccaggcuggucuugaacuccugggcucaagcaguccuccugccucagccucucaaagugcugggauuacaagcacugagccaguguacccagccuuuuuucuauuuuguucuugucuuguauauuuuacauuuuauagcuuuucauguuucugaaaccacuuaccacauuuaggccaaaaggcaaaauaauaaaaaauaaaaccaaccucaccuaaaaaaaaguuuaaggauuaaguauuuccauauaccaguguugaacagauuugaacaauauauuugauuuuaugcucuccaguugcuaaagugaggaaaagaaacagaauuauauuguuuucaugugcugacagccggaagcauguaaacaucugcagaaaccaaacguuuccuggaacuaagcuugagcagaaaucuaucacguggaccuuuguuuaaagaaccuugugaaaaaccacaguuauguaaaagauccaggagcgcaguucauguggauuagauucucuaggaggcagagagucuaaggagaucaaagaaaacaacgacuugggaagugcaugugcugagcgcuggagccaaacuagcagaaaggaguuuuagaggcacugaauccaggccucugguuuuuggggacuguaguaaagaaaggaguugaggccuggugcaguggcucauaccuuuggucccauuacuuugggaggcugaggcuggaggaugguuugaggcuggaaguucaagaccagccugggcaacaaagcaagaccccuuuucuaaaaaaaaaaauuaaaaaaaaauggaugugauggugugugccuguaguccuagcuacucaggaggcugaggcaguagggucaggaggcagaggccggaguugaaggcugcagugagcuaugcggguaccacugcacuccagucgggugacagagcaagacccugacuaaacaaaaaauaacaacaaaaaaggaggcagggguuuagaaaauaccaugauuguuaacaggaccaucagauuucauuuuuucuaaaauauuagauauugucagugugguuuuuauauaggugcugauucuguucuguucgucuucaaguaacaaaugccugcaguggagauaucuuauuuugaugauuaacaggaagcuuuuaagcuuugaagaaagcaaacaacauuuuccauggaccuuuaagagcugggcuaauauuuuugcccacacagaacucuaauucauuucagagucaagggcaacaauagaauacuuuuucaaggaccuugcauuuguuaauacagguuuucauaauagaaagcaauuuaaauauucagaacuaacguaacauggaagaaacaacuuuuuccugaaauauuugagagacaaauauaacaaacaauucaucuuuacuaugacaaucucaacggaaagacuucaguguggucauauuaaugcauuuucuguucccagcaggcaaguaaggcaagggaagcaucagcucccaggcuauuguagucauccagauggagaugagguaggcucagauggcaguggugggagcagggagaaguaguuagaauucagauguaguuuuaagauugagccaacaggguuugcucaugaauugggcagaggauaugagggaaagagaaaacuccaucuuggaggauggaguuacuguuuccugagaugagcaagccuguaggagcuucaggcguggagcacuaggggaacaucaggaguuuggcauggcaugauguuaaaaggggaaugucuauuagacauccaagcggagaugucaaggagguggcugaaaauaugagccuugaguucagggaagagguucaggcucuuauuuaaggugcugagacccauugagaugaccaggaggagagcguauagacaggaaaguuugagaauugagaguccugggucgcucuggcauuaaaagguggauaaugagaagaaguuuaaggaauggccagugaaggaggaggagagucaguagguugugguguccuggcaacccagcaaagaaagugcuuaaagaggagagugaucagcucugucugugccgcuggcagguccaguaagaggaagacugaacagugaacauuagauugagugaaaaugguuucugcugcuuuuuugcccaaguagucuugaaugaauucaguuaaccugucucuggggauaacaaugguacuuaccucaucaggugguggugaugaacuguuuauuuauuuaaaaaaaauuuuuuuugagacaggguguagcucugucacccaagcuggagggcauuggcaugaucacagcucacugcaaccuugaccucuuggacucaagcaauccuuccgucucagccuccuaaguagcuaggaccauaggcaugcaccaccacacccagcuaauuuuuuauucuuuguagagaaggagucuugcuauguuacccagguuaguaucaaacuguuggacucaagcaauccuccugccuugaccucucaaaguguuggcauuacaggugugagccaccauggccagccuaugaacuguuuaaguggaugaccagccuaggcaagaaagaugccaucucuaaaaaaaaaaaaaaaaaaaaaagcaaagaaaaaaaaaaaaagcuggauguugugccaugugcuuguggucucagcaacucaggaggcugaggugggaggaucacuugagcccaggaguuugaggcugcagugaguuagauugccccacuacacuccagccuggauggcagagugagacccugucuaaaaauaaacaaauaaugcucacuuuggcagcacauaugcuaaaauugaaacgauacagagaggaguaguguggccccuggacaaggaugacaugcauauuugugaagcauuccaucuuuuuaaaauucaauuuuaaaaaauuuuaaaaagaaauaaguaaauggaugagauaauuccuuuaaagcaccucuuccuguaccuggcuuuuggguauuucacaguugaagacauugcuggcuuuaacaauagcaguuuuaggggagcaguggggacaaagccugaugggaaugggaagaaagaacuggagacaguggauggagucagcucuuuugaguauucuuauaaaacuggauuagagaaauggggaguuaauucgugggacccuggggucaagaggaaaggccaguaggcaagaaggccucccucccucccucccucccucccucccucccuuccucccuccucccucccuccucccucccuuccuaaauccacagaccuucuauggugauuggaaucauccuguauagagggaaaagcugaugauguaguuggauuuaggaccauagauaacaauggaccaaaauaacuagauuguccuugccaccugcccccgcuucucagucuuuuauucauucauuuaacaaauauuuauuguagguucacaaggugccaaggacgaagcucaggugcugggaacaguggugguuaagggacuaaucaaacaggcaugagcucuacacccucaugaaguugucacaguccgguggagauaggcuuucuaaaaacacacaaauacagauuuggaugagcacuuugcaggaagaguacagaguacuuuugagaggaagagagggagaguagcaugguguaacuuagauggggggcauacgaaggucuuucagaugugaaagauaaccauggcugaaaagaagagcaucccagcaaagggaacagaccuugcaaaggcccuggggcaggugagagagaagcuggugcuuuuggggauuugagagaaggccaggguggccugagaggugggaagggagcaagucaugcagggcuuuggaagccuccauauuaaagcuuaugggauaucguaucuaagagcaaugggaaacgcugaaaacuguuuuaguugggaagugacauggugagauuugcauuggagaaaaaaauaugacccaugaugaaguauguccuggugaauggaucagaggggcaaaaguggggaaaaaaucccgccaauuuaggcaaaaagauaauaccuaugaaaauacuuagucuaaaauauguauaauuuugguauagaaacagaagugagaauauccucucuuuagcagaauuugcuuugcacuuaaccaggcuucuuacuuccauaaagacagcauuuucuuguuaaaaauaauguuaauucagaagaaucagcugaaggugucagugauuucagauuauuuaacauaaaaugaaaguuucaaaaagauuguggcaaccuugugaaaauuaaaaauaaugagaccuuauuaaauuuuuuuuucuagaagaaaauaccaaugaaucaauauuaggagacagaagcuguuaagaaaacucaguacggccaggugcgguggcucaugccuauaaucccagcacuuugggaggcugaggcuggcagauugcuugagcucaggaaucugagaccagccugggcaacauggugaaacccugucucuaccaaaaauacaaaaaaauuagccaggugugguggcgugcaccuguagucccagcuacuuaaugggcuaagguggaaggaucacuugagccugggaggcaaaggcugcagugagcugagaucucgucacugcacuccagccugggugacagagccagacccugucucaaaaauaauaaauaagggccaggugcgguggcucacgccuguaaucccagcacuuugggaagccgagguggguggaucaccugaggucaggaguuuaagaccagccuggccaacauggcgaaaccccgucucuacuaaaaauacaaaaauuagccuggcgcaguggugggagccuguaaucccagcuacuugggagacugaggcaggagaaucacuucaacgugggaggcgaagguugcagugagcugagacuauccuauugcacuucagccugggugacagugcgagacuccaucucaaaaagaaaaaaaaaagggagcaaguucuaguacuggguggauauuuuauugcaccaauuuaggcuucuccccagagauuucuuaaaacagaaaggcaguuguaauaccaaguauugcuguaucaggccaccugcuacuccaaagccaugaauuaacuuguucuaagcccucaaggaaagaaaagaggaaacagagguuuauucccuaucaagacaguccacuugagaaaguucugucuugguuguaacuucagguuucuuucuuacacaggcauuuuauuaaugcuuuuacgaguuagaagaguugggauaauuugccaucuggaguuucucugccuugcugaucugagcucagaccugccaauuuaccagagauaauugauaacacccuguaacagcugaguaaguagauucuucuguuuuacugcuuuuaaaaaaaguuuaaaguuuuaaaauaguauaaacuuuaauuggguucuuuaaauuuuguuguugaauaaugcaauuauuaugauauuuugugaauauuuguaaauaaugggauucuggaauaaauuaauccccgaugauagaaaagaguuaaugaacacuuucuccauacauaacacuuuagcauucaagaaacauaggacuuaaauacauauauuaaaaauuuaggccaggugcaguggcucacgccuguaaucccagcacuuugggaggcugaggcgggcagaucaccugaggucaggaguuugagaccagccuagccaacauggugaaaucccaucucggcuaaaaaugcaaaaauuagccaggcaugguggcaggugccuguaaucccagcuacucuggaggcugaggcaggagaaucacuugaaccugggaggcagagguugcagugagcugagacugugccacugcacuccagucugggcgacagagaggcucugucucaaaaaaaaaaaaaaaaaaaaaaaaaauuuaaaagcauucuccuuagugcuuuauuucauuuuuacauuauaaaauguaaaaaauauugguaaaacaacuguuaauacauuuuuaaaaugcaacuguauguaaaaauuaucuuuuaaugcaggaugcauuuugguuaauuugaaauaaauacugguuuaguggaaauaaaauuuuaauaguucuuucuauuugaaaauaaugauuuuuccaauacuaauauagauaagaucacagaaucugucuggauuuaacuuucucaaacagacuagggaagaauggcuuucauucuuucuaaucaaaacaccugaaugaaguuuaaaguguuuuaaguguugagucaguuacauugaaaacaaaugguuucucagaacaagagcuauuauuccucguacuauauccuuugaaacuguuuugacaaaacuaguaaaccaugaaguuguaccagggccuuguuugggaaucuuaaacuaaaaacagugaauaaaucuacaagauauucgccacugcagugggauuauuuaauuuugguccaaaucuguguuguccaauaugguagcaacuggccacaugccacauguagcuauuagauguuugaaauaugaguaguacuaacggaaaugugcucugcagaaaauaccauaauucaaaaaaaaauuuaaaaagacuaaaauacuagguuuuauaugacucacauuuugaagugauaauauuuuggauauauugaauuaaaacauguuauuaaaauuaauaucacuuguuuuuguuuacuuuuuuaugugacugcuggaaaauuuaaaauuaguuguagcuugcauuauacuucuuuuggauggaacugaucuauaucaucacauacaaucaacauucuuaguuauccaguaccuagcauucuguaguucuugaacuuucugguccuccuauggaucaauucauauacauuuguauuguuuuaagaauuugauucuuugauucaucaaauauuuauugacugccuaccaugugucagacaguauuguagguauuggugauacaguagugaacaaaacgaacuaaacucucugccuucauggagguaacauucuagcaggaagauacagacuaagaacaaauaaaaaaguacaauauguaguauauuagaaagcaaugagugcuuuggagaaauguaaggcaggcaagaguaagggcugaagaguugacugguaaagagaauguuuagggaaggccucagugagaaguugugaagaaguugauggaaagagccuguggguguuugggggaagaguguuguaggcagagaggauagcaaaugcaaagaccuugaggcagaagcaugccuggcuuguuugaaaauaggaggaggcuagugaauggaguggagugagugaaggggcuguaaucccagcacuuugggaggccaaggccagguggagcacgaggucaggagaucaagaccauccuggcgaacauggugaaaucccguaucuacucuaaaauacaaaaaauuagccaggugugguggugggugccuguagucccagcuacucaggaggcugaggcaggggaaucgcuugaaccugggaggcagagguugcugugagcugagaucgugccacugugcucuagccuggcgacagggcaagacucugucuccaaaaaaaaaaaaaaaagaggagaugagaggauauggauggucaugucauguugucagaggcauaaaaaccagagcaaucccaucuugaguaggggcuggguaaaauaaggcugagaccuacuaggcugcauucccaaagaguuaggcauucuaagucaccggaugagauaggaggucagcacaagauacgaguccuaaagaccuugcuaauaaaaaaguuuguaguaaagaagccggccaaaacccaccaaaacuaagauggcauugagagugaccuccgauuguccucauugcuacacucccaccagcaccaugacaguuuacaaaugccaugacaacgucagguuaguaccccauauagucuaaaaaggggaggcauaaauaauccaccccuuguuuagcauauaaucaagaaauaaccauaaaaaugggcaacuauagaguagccauucuuuuauucuuuuacuuucugaaugaacuuacuuucacuuuaucgacuugccucagauucuuucuugcaugagauacaagaguccucccuuggggucuggaucaggaccccuuucccauaacagugugagcagugguuauuguauggguuuuggcuuccagugagaugaaaaagaauugguggauuuuaaggagagaagcaacaugaucuuucuaaugaagguaaugugauuugaauacucugggcuagggguggggguguuugcaaggguagaagcggagagacccagugaggcuacugcagugacccagcugcaagauggugccugagaccauaagcaagggaugugaggagaaaugacggaauucuaguuauauguugugaaauuagauaugagaugagagacagaaaggagugucagggaagacuccacaguuugcagccugaacaacugagaguggaggugccuuugcugagauagggggguggauuguggagggaccgauuggaggcagcacuaggagcucaguuuuaaacacauuacauuugagauuccucuuuagauaucuaagcagaaaggucauguaggcagagucuggacuucagugggaggucaggauuaaaaaggcaaauuugaagucauuagcauugaacuguuguucaaagucauaagaaggauugaggccaccaagggagugagaagaguggucuggggccucuccuggucccauggagucagcagggcagauugaggaacagacaggaagguguaaaucgugauacucuagacaccaagggaagcaguaguaacccaccuugucagaugcugcugaugggucagguaagaugccagcugaaaauugaucagaagauuuagcagugaggaggauguuagugaucuuggcgagugguuucagugaaaugguagagacaaaagccagaguggagcagauuccagggagaauuggaggaacuggauugaagagugaguacagacagacucucuuuugaguaacuugugaaguccagaagagucaaggaaaguuuugguuuugguuuuuuaagaugagagaaauuacauguuucucccaaugcauguguuagagagauuucaaguuauuuuucugaaauggccuacuagauuuaugacauuuaagaccaccaccuguguguguuagggguggagguguagugcuucccuccuaagaugauuucauagaauuguguuguggaagaggcagaggggugggagggaucgggggagagacagagaaagagagagaauguagagauuggcauuguauguuaaagguggcuuuugcaauuguuaugaaauuuggcugcuucuugcucagugucugcauucacauuccgggaauuaaaaauguuaagguaacaaauguuaagacuaguucucgucaacugaaaauguugaaaaagcugauguuugggguguaauuucuuuuccuuacuuuugaggaaguuauugaaacauuugaagaaauugaggcagagacacaauacccaaggucacacaaaaugaaauauugccagaauaaguggauuuuagaucugauuuccuagcuauguggaacacuuaaucccucuguguucaguuccagcagguauaaaaugaggguaauauuugcuuuaccugccacaggagguuuuuaugaggaucagaugaacuaguaggugcaggggcuuagucaacuauaaagcauuguauuauauaaauaugaaguaauguuaaaacuaaauuauacuugaggauuuugugguagcaugugaaauaacuggaaaaaguauaauguaacaaaaucugggcugagaauauuuguaauacauacucauacuaauagaacugcaagaauuugcuuuuugccugugucagacuuuguuaaugacaccacagaaucgauuguguuuugaguuuuguggccaagucacagcugagguccaagcaaucaaccaguuuaucuucuaggagucucaaaguuacugaacuggcuauuuugguacuuuaauauaauguuagcuugcugguacuauguggaagagccacucucuuaauauaaaauauucacguucugaugauaaauuuucuaucaaacuuugagagcauuucuauauuugauacuuggaguugaauuauagucauacuucauuuuuguauuaucgucauacuuuaugcuguggaaaacugaggaauuaaaaaugaguagccaagaucauuucccuuaauggugaugugaagaggauaggugauucucuuucugaauaaaacaagcguaaaacuggaugagauuguccaaaauggucguuucugggcacuggaaacaaaaggcagauaauagauugagaagcguuauugauacacugaaucuuuggguaugaaggauagggguuguggccuucucgcaugggguuucuucucuccuugcccacuaucucaguugucgaacugcuguuuuaucagacaugauagacucaauuugaaguguggguaaagguugggguuaagaaaucacagcuuugcuagcuaaaaguggcauaaucaguuaauaaugaaaaacucacagcuuugcuacuuugaguuugaaguuugcuaguuugaggccaccauccagaaauuuaacaaggagauccuagaaaugagagaccuauagagggcuaacauggcuccccaaccaucuguagcagacagcuaaacuuugcaugcccaggggauacucaguagagcccagcaaaaagugaaagccagaagagacuugagaucuggguacaacuuugaaugcuaccuuccaugcagacuguuccaucugcagauguuggaagccuuacuggugcaagguggcugggcuuaaucucugcccaaauccacuggcugaccacuaaacuaagcagccacucacucauuagggaaaugcaaauuaaagccauaacaacaaccaccagaauggcuaaaauuaaaaagacugacaauccaaguguugacaaggauaugcggaaaccagaauccucucaaauugcuggugggaauauaaaacaguauggccaugauggaaaacaguuuggcaguuucuuaaaaaguucaauauacacuuaauguguaacucagcaauucuauuuccaagguaugcugucaggaaaaaugacagcauguguccaggcaaaguugguauaugauguucauagugucacccagcaagcaaucaaugggccugcuucccaaggcacauggaggccaauaccauggcgcuggcuuuugaggaaaaauaagcuuuaucaugacuggacuggcaaggagccaggaagaagcacccaaaucugccuccuggagcugguaguuggguagaguuuuauaagcauaggguaauagggugugauccaauuggaucuugugaugaagugaugcugggggguguuuucugacuggcuccugacauggggcuaugccagagcucaaucugguuggauucuggauccuguuaugccauauccacuuuuuuuuuuuuuuuuuuuuuuuugagauagagucucacucuugucacccaggcuggagugcaguggugcaaucucagcucacugcaaccuccgccuccuggguucaagugauucuccugccucagccucccaaguagcugggauuacaggcgccuaccaccaugcccaguauuuguauuuuuaguaaagaugggguuuugccauguuggccaggcuggucucaaacuccugaccucaggugaucugcccgccucggccucccagaguucugggauuacaggcaugagccaccacacccggcuuccacuucuuaguucaguccccucuccuugguuggaacauuuagguugccccuauaguugcaugcuugguucaucuggacaugcucagcuuacaugauguucaaccugggggcccauggcaacugaaaaacaacucacaacuuuguuacagaagagaugaaccagauuggucugacgugguuaaaacagcagcuuuagcugugauugaaaacuggaacuaauuuaugugucugucagcagaugaauggauaagcaaauugugguauaucuauagaauggaauaauacucaguaaugaaaaggaauggacuauugauacauacagugacauguaugcauugcaaaauaauaacaugcugugugaaagaagccagacaccuuuuccuacaaaacagaauacugauuccauuuaggugaaauucuagaaaaugcaagcuaaucuguagugacaguagaucagugccugcagaucagaggauggcuugggagaggagggagaaagggauuccaaaggaaagagcacaaugaaacguuugggggugauguauauauucauuauuugauuaugucuaaugauuucauggguguauacauaugucaaaacucauuguauauuuaaauaugugcaauuuauuguauaucaagaguaacucaguaaaguuauaaaaacuaaaacuaugcccauucaaaaagcaaacagauguucauaguaccauuauucacaguagacaaaaacuggaaacaauccaaauccaucaaccggugaauagauaaacaaaauuugguauguccauaucagccaugaaaaggaauaaaauucugauucaugccacggguacauacuacaauaugguugaaccucagaaacauuaugccaagugaaagggcucuguauuguaugauaccaugauaugaaacuuuuagaacaggcaaaaccuuagaucagaucaguacuuugccuggguguaggguggcagcauggagauugguuuuaaacaggcacagcggaacaguuugggugauggaaauguuccuggugauaguuguguauaaauuguaugaaaacgugugcaauuguguacuuaaaauggauaauuuucaagacaugcaaauuauaccucaagaaagccacuaaacguggguggccacucaaaauuucaaauucucuuuaagaugaccauucaggucaggcaugguggcucacuccuguaaucccagcacuuugggaggccaaggcaggcagagcacgaggucaggagaucgagaccaucuuggcuaacacggugaaaccccaucucuacuaaaaguacaaaacguuagaugggcgugguggcgggcacgguggugggcgccuguagaggcaggagagaauggcgugaacccgggaggcagagcuugcagugagccaagaucacgccacugcacucuagccugggugacagagcaagacuccaaaaaaaaaaaaaaaaaaauuuccauucaaggaauugaacuauaguacugacuucauuguaacauacugcuuuggaauacuuuggugagguucacugaauucauguucuaugccaaaugcuuuuuggauucuaauuguaaguuaguuauuuguaaauuaguuacauuguaaaauaauuuaaauuaaaucguaaaaagaguuacuuguuuuucccagaauuuagugaccaggaauagcuguauuucccuugcauaucauuugucaaaugauugguuuuauguuaaauaguuauuaacaccccccuccccacuggaaaacauguuuuuuggauuaauauucaauuuguguaaaguaguucaaauuuauggugguggguuauccuucaauuuuuaauuuaauuuuuuuuuuuuugagacaaguuucacucuuguugcccagguaaagugcaauggcgcgaucucagcucaccgcagccuccgccucccggguucaagcgauucuccugucucagccuguggaguagcugggauuacaggcaugcgccaccaugccuggcuaacuuuguguuuuuaguagagacaggguuucuccauguuggucgggcuggucucaaacucccgaccucaggugauuuccccaccuuggccucccaaagugcugggauuacaggcgugagccaccaugcccggccuauuuuauuuuuugagacagagucucgcucuguugcccaggcuggauggagugaaguggcgugaucucagcccacuacagccuccgccucccggguucaagcaauucuccugccucagccucccaaguagcugggacuacaggcauguaccaccaugccuggcuuuuuuuuuuuuuuuuuuuggauuuuuaguagagaugggguuucaccaugucagccaggcucgucucgaacaccugaccucaaaugagcugcccuccucggccucccaaagugcugggauuauaggcgugagccaccgugccuggcccuauccuucaccuuuuaguucuuuaggaaggaaauugaugguggcuuaauaccuuugcuucuaggccuggguguccacccaccugaccccaacucccauauauguagagacaucagguaaucugagcauaagauccuugcagugguuggggaagugaagcagagagaugcccucuuggagcacuuccauuuucugcaccagacaggaaucaguuaucucugggguuagugaccucacaccuuugccccugaauccccccauauauaaaauagaagauugaauuuuacuuacuuggguaaaagugggcauuuuucaguuagacauuuaccuaauuuuaaugaaaauacaaugacccuagaacauccugcccaugauucugcccaaguuuaugcaaacagaaaaaauuuauuuuggaaaaaaccggaucuuaaacugaaauucauuaagccauuuuuccaaauaaaguaccagcuuaguuaaccaaauugugcuuuuucacuuuuuccuucccucaaaaggaaaucccuuauucaacaaaaauuuguggaacacucauauguuucaggcacccugaagauaaagacacacccaccugcaaggauaaaagaagcauggcggcgggguggggcugguauccagucugcuucaaaacggaggaggggcauccacagagaagggcuggggaaggccuugcaggagggcauggaagagccagguugagagggaugaauaggacuuggcuguuauccagguugcaagauguuggaaggacuuuaucuaaagcuguggcauugggauuaaagaagagagguugagucaagagauucagugacugggaguuauaugcccuuuugacuggcaggauagggagaauauuggagaaaaaggagucaaggauuaguucagcuucugccguggccuucucagcaagugguggggaauucacugaggugaggaauacaaaauacuuggagguugcaucuguuuguuuugcuuauugaguuaggaaaccaggaauucacuuuggagguuugaucaggggaaugcagccuacguuugauugggcuuuaaagcugauccucuuugcuccauggcccagcucuggggggggacacacguggcacaucaggcagaaaggggcagcuagggaggucuuggccaacugugguugggcagcaucaugggcuguagucucacuuguacagguggaaucacugugggacacuucggggcauuuccagaguggaaaaauucuugcaggugaaaaccugucacauugaagaauucaguagugcuuuugauaauuauuuuuucuacuugcugucuugccuucuucccucuguauuuuuaccauuuaugggaguacaucuuuauauuucucugguaaaaggaagaugaaaaaggugaacuuuauaaaagacuaaccaguccuugacuuguauagcucauuuaacuuuuaaaaccuguaaaggagguacuuuucaucauauaaauucaugaugaagauaaauaaaauagguguuugggaaucagcagguuuugaaauuuuaugacaugccauuaacacaaagcauaaauucuuuuucuuuuucuuuuuuuuuuuugagacugagucucaguuugucguccaggcuggagugcaguggcacgaucaaggcucacugcaaccuccgccuccuggguucaagcgauucuccugccuuagccuccugaguagcugggauuacaggcaugcgccaccacacucggcuaauuuugguauuuuuaguagagacgggguuucacauguugaccaggcuggugucgaacuccugaccucaggugauccacccaccuuggccucccuaagugcugggauuacaggaaugagccaccgcacccggccgcauaaauucuuuuauucagauccauugacauuaacauguaaauaaggaugacaguuuauuauuuuggaaauucuaauuauuugucuuguccuucaaagaagcgcuuuugguuacaaguggguccauaacacacaaaauaaaauucuguuuacggcugggcgcgguggcuuacgccuguaaucccagcauuuugagaggccaaggcggggggaucaccugaggucaggaguucuagaccagccuggccaauguggugaaacccugucucuacuaaaaacacaaaaauuagguggguaugguggugugcgccuguaaugucagcuacucgggaggcugaggcaggagaauagccugaaccugggaggcggagguuguagugagccgagauugcaccauugcacucgagccugggcaacagagcaagauucuguuucaaaaaaaaaaaaaacaaaaaaacccacaaaauuacauacuuuuugauaauauugaaaaauaaguauggaaaaugauucuucuuaggaaaauuuaugcccauuauucacuucgcuguuuuguuaaugaucacgaauauauuaaacugaaaauacaagcuaagcagcugcuuugaaacuacaucaaaacaguagaaguuuaaaauuagauucuucuuauugcauuaaaugcaucuuucaguaauauguggucacuacacuaccugcuuuacagguauucuuggaaauuugguaacaaaaagaacagggugaauagauguuguagaucaugagguauggugcaaagugcauggccuugggauagggauaucagacaucugagcugaaucucaguucucugguuguuaugccucgaggaaguaaguugcuggaccucaguugugcuguuuccuggucuauaaaaugaagacaauaaagaaccugcuucagugcgcuaaaacucaaaggacuucuugggcuugagcgcuggaguaaacaggcaguuucccuuuguaccacaagagggagugccuguauagauguuaaccugagcugagguuuggauuucuuucuaaaaugucgcugaaaauuuaggaauaacuggauuacugggaaaacguuaaagaaaaagauuuuuugacagugucaggagaaagaggaacucgaaacacauaauggguuaagaggaagggauuacguauaaaauuccuuuaagguaugaaaagcuuuguugacagaguguuacauauuucauucccagucaacaaucuuuuauugucaaugucugaccauguugauauauuuguuuuguuuuucuccuccuuuguaacuguauuauaaauuuuuuauauuaaacaaauauagaacuuaaaauuuaguuucuuaguaguaguccugaauaauuaacaucaguugaaauuggauuguuugugcucagugccuuggauauguacaaaaccuguuugcuucaaauuagugaguuagaaaauauuuuaaucuuuucauccugcuccccucccacauacuuuuuuuuccccuuuuauuuugagcuucuagauccuuuuaugugauguguugcugucauacauagcucacauugggugggaacagagaagaacauuguuuccguggcccaacccuagggacauggaacucauuuuauuauacagugaaauuuuaaaauuugaaaccaagaucagaucucaacaaacagagcgaaauuggcaauuguggaauuaucuaacaaauuuagggaaaaauccaguuguaucucaguuaugugaauguguccuucgauuuacaauuuucagguaaucucuuuauuuugcugguauuuuuauuauacauagagcacauuguuuuauagaacuguaauuauaccauaauacuuuuuguauugggaaauguugagaauuuagaaagaacaauccuaggcauuuccuuuugcucuguauucuucuguuuagaaguuuucccugugguuuguuccuggcaauuaaacacuguucaaauucagagucagacugcccuggcucaaaucuuggccccacgaugugugaaacuugacaaagucaaaguuaucacuauaauuucggucacuugaaauccaguaauuucuugagcagaagaaagggaaguggaauuacuguagaaauuaugcauaguuuuauauuaucuguguaguagccuguuuaaagugaucauugcuagugcaugguauagaauuacaaacuuguaaauacuucucaagauugccacuuuaaaaaaaaaagcaaaaagagcucuguagcccuauuuuuuuuuuuauuuccaacaggaaauuuguucuuguuucaaaaugugggaacacccauuauucucuguuggccacaugaaugucauccauuuguuuauugcagcagaaaaaaagugaagaaugguugauacaguggcaagcuguuccuuuuagguuacuuuaaaaagucauggaauuucggauauacaaagaaagcauaaggaauacucuaaccaguauauauguauacaguauccaguauaagaaugaaaauguaauguaguuauuaaaacauuaugugugugcuuccacaagccuguccuccuuucuaccuuccagaaguaacuucucucuugaauuugguguucgucauucuggugcaugcuuuuacaguuuuacaaaauacacacgcauucccaaacauaaauaauacuguuucacaacauaaauuguauuaugguacauguuuuaaaacacgauauacauuguaucuguugcaagucagguuccaagggaaauggaacucagaagauuaaggcugggggccaccagugccucaugccuguaaucagcacugugggaggccgaggcgggcagaucacuugaggucaggaguuucagaccagcauggccaacauaguggaaccucaucucuacugaaauacaaaaaauuagccaggugugguggugugcaccuguaaucccagcuacucaggaggcugaggcagaagaaucacuugaaccugggagguggaggaugcagugagccgagaucaagccacugcacuccaggcugggugacaaagcaaaacuccguauccaaaaagaaaagaaaagaaaagaagauuaacauguaggaaguuuguuaaggagauuuuaggauucacacuuguggaauaggaggaagcacaauugggccaagggagaaauugggcugugguguccgaucacaagauaggccucagcugaucccaaaggggaugcugaaggugggguagcccuugaggaugguaccacguuggggugaggggccaggccuugguagcuucacauugaccaguuaugggaagaaggcuaccccugaagaagggaugagaccuuggugaggugacucuuucaacugagggcuguuaacuugcaacaccccuagaaacugggggauaagcucuucaguccuaaagagagaccugagcagccaccucaguauucacuacagucuauauuguguacauugucugagccugcccuuuuugcuguauauuauguuuuuggaguuuacuuauauuaauaucuguagcucuaguucauuuauuuuaauuguuuuaugguauucaguucuucaaaauaugucacaauuuuaaaauauauuuuccuauugagagacuuuuaaguuuuuacaauuuuucacuauuaaaaaauguugcuauaugaauucauuuauauuucuccuuagugcacacaccagaguucaucugggguauacaaccaaaaaauuaccaggucuuaggguaugcacaauuucaaacuuaauaacuagaaugaaauugcucucuggagugguuguaucucaccccguguccucauaaacacuugguauugucaaguccuaauucuaccaauuugaugggugugaaauaguaucucauuauaguuuuauuagaguuugguugauaacuagugaguaauaucucauuguaguuuuauuagaauuugguugauaacuaggaagauugagaauuuauguguuuauuuagcuauuuggguuucuucugugaaggacauuuucuaaucaugugauuuuucuguugauuucuuuuagugauuuguaggcagucuuuauauauucugcauaucaauucuuuguggucuauaugaguaaaaauaucuucugguucggggcuugauuguuaacuuuuuaaauaaugccauuuguugaauaagaguuuucuuuuaaugucauccuuccuuugggcauuguuucuggguauauuauuuuagaaauucucccuuaggcugaggucauauaaaauauccucuguuuacgauuaaaaguuuuaaaguuuugcuuuucacaauuucaccugcugucccucuaaaauaguuuuguguauagcaugagguauaguugccuaauuuuguuuuucucauggaugaccuguugucuuagcaccauuuaauugccuuugcaacccuucuccaccaaugcacagugccauucuguccuacaaacuucugucuauguagaucuaugucuuuuuguaggggcgggggggggggcggcuauuuaguuccacugguguauuucuuuuuucuugccccauuuucuugcuuuuuuuuuuuuuuuuuuuuuuuuuuuucugagaugaauucucacgcugucacauaggcuggagugcaguggcacaaucucaucucacugcaaccuccaccucccagguucaagcgauucuuaggccucagccuccugaguagcuuggauuacagaagugugcaccacgucuggcugauuuuuuuguauuuuuaguagagaugggguuucaccauguugaccaggcuggucucgaacuccugaccccaagugaucugcccgcacuggccucccaaaaugcugggauuacaggcaugagccaccaucaugcuuuuaaaauaggucuuuauuucuuuauugugucuuagugucugguaguuugucuccucuucuuguucuucuuuaaaaucaucgcuacucuuuguguuuugcuuuuccauauacauuuuagaguucugcuccaugaaaaacccuccuuugauugaggucaugcauuaacuauauagauuaguuugaagaguaaugauauucuuaugggauagauauuuccuguguaugucuucuuuaauaucuauauuuaggucuuuuuacuguauacaucauuuuuauaacuuuuuaaauguuaauaaagauauuucuuggccgggcgcgguggcucacgccuguaaucccagcacuuugggaggccgaggcgggcggaucacgaggucaggagaucgagaccaucccggcuaaaacggugaaaccccgucucuacuaaaaauacaaaaaaaaaaauuagccgggcguaguggcgggcgccuguagucccagcuacuugggaggcugaggcaggagaauggcgugaacccgggaggcggaacuugcagugagccgagaucccgccacugcacuccagccugggcgacagagcgagacuccgucucaaaaaaaaaaaaaaaaaaaaaaaaaaaaaaaaaaaaaaaaagauauuucuucaucaacaauuuaaugacuacaugaccauccauuauuuagcuagucaguaguuuacacccuguuaacauuuaaauuaacauauuucacaaugauuguuucgaacucacauauuucccaucaugaaauuauauguaaauauucaccuguuuuauucuaguagugcuaggaguuguauauaauuaaguauuugagauguauuugaguguaaaaugugagaaaaauaucuuuuuccccacacagauagccaguuauugaauacuucauccuuuggucugacguugacuuuuugguuuugccaucaaguaaccauccacagugcccguacauagcaggcacucaauaaauguuugaauaaaugaauuugaguauuuauuuuguuuucagauguuuucuuauuuuccguggacacgucugucuauucuaguucuacugccaugcuguuuuaauuaucagagcuguauaauaaauguuuguaugugguugaacaucauuauuguuauuguuuuuucggaauuuuucugggcuacuucugcaucacuuuucucucggauaaaugaaaauaauuuggucaacuuucuuguaaaacuaugauaauuuugacugauacuguauuaauuuauuuuccuuccuuccuuccuuccuuccuuccuuccuuccuuccuuccuuccuuccuucuuuucuuucuuuuccuucuuuuccuuuuucuucuucuucuucuuuuccuuccuuccuuccuugcuuccuuccuuccuuccuuccuuccuuccuuccuucuuuuccuucuuuuccuucgagauggagucuugcucugucacccacacuggagugcagcagccugaucuuggcucaccacaaccucugccucccggguccaagccauucuccugccuacccaguagcuaggauuacaggcacccaguaccacgccuggcuaauuuuuuauuuuuaguagagaugggguuuuaccauguuggccaggcuggucuugaacuucugaccucaagugauccaccugccuccgccucccaaaguguuugggauuacaggcuugagccaccaugccuggccuacacuguguuaauuuucuuaaaaaaacaaaaaaacaaaaaacaaaaaaaccuuaaaggcauuuauauuuuaauuuucuggccuaaugagugcuacauauucaucuaguucauaaauucuggaacuuuuugguuagagcagauaaaucccccagaucucuuuuuggauuaaaauucaauguaauuaaagaaauccacugcagcaaacgcaauccugccacguguuuauucuguaaggauaaaauguuuuucuauauugaacagcacugcacaggccuugcugccucccccuuaugaaacaggacucucauggugccacguguucccuggcuggacagauuccugaaaauagauacuaacugcugcuugguugaagaaaucuuuuuugugugugagcuacuuucucccgcagauauuuaaaggaauucuauauccccacuucucugacuuaccuuuuuuuuguggcgaggaaacaggacacagagccugcuggguaugcaagagaagucuguauaacuguuucacaccugccuggaugcuggcagugguauuugccaagugaagucugaaggcugguuugucauguguuuucacagagcacugauggcucccagccaaccuguuuaggccuugucuuuuuuuucuugcauaaaauugccuauuuuucacuucagauggggguguuaggcacuucagagauguuuguucuugucgcaugcaugccaucuguggucugcuggcaucggagacagguucccaaauuggccagugugucuguuggucagcaagcggggugaccaggacccacgccugugcuugccccuguggcugcagccaaggcugaggugcacaccugaaggaccacaccucagugcuguuggccuaguuuuuaaaaauuuaaauaaacucuuuauuuuggaauaauuauacauuugaagacaaguucaaagauaguacagaguuuccauaugccccucacucagugauuccuguugcugacucuuacauuauuauguuacauuugucacaauuaaggaagaaacauugguacuuuacuguuaacuaaaauccacauuuuauucagagcucacccguuuuuccgaauguccuuuuuccguucugcacucaggauaucacagcacauuuagccaccaugucuccuuaaaguccuccagucuaugaucguuucugagauguuuguuuuugauagccucgucaguuuugaggaauacugggcagguauuuugcagaaugugccuuaguuuggauuuuuuucauguuuuucugauuauuagacugggauguggguuuuugggaggacaaucacagaggugaagggauauccuuaucacauccgugugaaaagagaacgccaucaacgugacuuaccacugcugaugcucaccuugaccauggaaauuuguuuccccuuuccaauacucugcucuguggaagcaagucaccaagcacugcauagucccaaguuaaaaguuuuguuacuugucuuaucuguugguacccaguuauauuugaagccauaccuaauauuuuuugacgcugaauauagaguuuguguuuagagccuuaagaaugaauaaaaauuuauucuaaacuuaagaaguauuggaaguaguuaguagcuauguugaaucuuucuuccacuccucauacauuugguuuauuguuguuuuuuuuuuuuuuugagauagagucucucugucacccaggcuggagugcaguggcaugaucucagcccacugcaaccuccgccucccggguucaagccauucuccugccucagccucccaaguagcugggauuacaagugugugccaccacgccuggcuaauuuuuguaauuuuaguagagaugggguugcaccauguuggccaggcuggucucaaacugcugaccucaagugaucugcccgccucagcuucccagagugcugggaauacaggcguuagcuaccgcacccugccugguuuuacuuuuaaaaucuucaugcucuguaaaauacaucauccuucuacugcaucagcuacuccguucugcucauucgccuacacagauuguacuuccuucuucuggcauaagaaugccuccuuuuucuucuacugccagggaauaaaguuuaguauaugaauguuuuauccacacugcagcuuaccuaauaaauaccaaaauauguuuauucugauaaaucugauguuuuuauguauaaauuaaacauuuaugacuuugaaugcucucugacaucaugaauaguugguugguugguuguuuuuuugagauggugucucgcucugucacccaggcuggaaugcaauggcaugauuucggcucacugcaaccucugccuccuggguucaagcaauucuccugccucagcccccugaguagcugggacuacaggcacgugccaccaugccuggcuaauuuuuguauuuuuaguagagaugggguuucagcauauuggccagacuggucucaaaauccugaccuugugauccauccuccuuggccucccaaagugcugggauuacaggugugaaccaccacgcccggccccuaacaucaugaguaguuugaucuuccacacacuucugcuuguagaguaguugaaccucaggaguucagauuucagauagcuuguuguuuucauguuugugagggugaaauucuuaaugaauuugaucauuuuugucugauuuuccuuuccacucagauaacuuucuuuacauuuucacuucaaauccauuugcuaaaauauggauuaaagaagaauauguuacuguuuuagauauaauaggaauguucuugaagagauguauauaaauguuguauuuguucauugaaucaucaugucacauguuuuaggaaacuuacuguuucaaaaaaccuugugauacauuuugugaugauuuauaugaccaauuuucaaacccacauuugcagacauuuuauuucauccucaguugcaggcauuccauuaagguggacugauuaaagugucuuuucagaacauuagaacuucguguuuccucuucaugggguuacugucaacuuauuuaagaagaacaguagaacuucguguucccucuucuugguguuacuguuaacuuauuuuaaaaaguuugaguauguuacaguauuuugucuuuaagccagucuugggaucuagcaccaagggaaaaaguucaaaaaaugcauuuuaacaagucuucucacuucauggucacuugguaugacgacucaaaacaagaauaauguucuuaaucaaccacaggggaaauccuuucuucggcccuucaauucuacuuuuagucagucaaacaauucuuaauuucaugcgggggauucccacacguucuguaaguuucuuuuaaaguuuucagauauguguagaauguaggauaugauugcauucgucucauaucucaguggugugaggucuguugagugugccgcuacuuuguuuuaauauuacucauucuuuuuucuaaguauggauguauaagaaugagcaugauaaaaugaaaucuaaaaauuaauugauuuguucucagguuaaaggccuauuaaauauaagaucuuuggauauauucugagucuuuuuauuuuuuaugcagcaaguaaagaaaauuuuacagagcuuuggacacaaggcuccuccuuaccugccuuuuacugaacucaccaugucuucccugguuagcuguaggcucucccgugcuccaggcucagcagucaggguguauuuuuauugcucagaucugacaaguaugcuuccugcaguuacuguugaggccaguuucuaaggcuuugaaaugaccuucaaaaagaugauaaauguugagucccuuuuggaaaaauauacugagauaaagaacugugauaaaucaaauuauaagguagaucaucuuguaauuagcacacuauaggaaaguuaguuaugccaggcgugguggcucacgccuauaaucccagcacuuugggaggccgaggugggcggaucacuugagaggucaggaguucgagaccagccugaccaacauggagaaaccccaucucuacuaaaaauacaaaaaaaaauuagccaggugugguggcacgugccuguaaucccagcuacuugggaggcugaggcaggagaaucucuugaacccgggaggcggagguugcggugagcugagauugcgccacugcacuccagccugggcaacaagagcaaaacucagucucaaaaaaaaaaaaaaaaaaaaaaggaaguuaguuaaagaacaucuguggggaccaccuauguuguucugggacuuucuaguguuaguguaggagaauaucaugguuucuguggggacaggggguucccauuucaguguguuccaucacccuccucuaucccucuaagaacaugggaaaagccucagugguagacaggaaccugccaucaguccuuccacucugaagcacccuugcagauguaccagauggaaguugucuuaaaugagaagaaaacuacuaagucccugggcauucccuuuguccuccagcaccagguccaguccucagggaaaguuuguucuuauugagaguauucccagagaucugaaaggccagggggaaauugcaguggaacagacugucuuucucuuaaggcauuuaaaagucauccagggcugguugagguagcucccaucuguaaucccagcacauugagagacugaggcagaaagaucacuugagcucaggaguuugagaccagccuaggcaacagauugaaacacugccucuaugacaaaagaaauuggcugagugugguggugcacaccuguagucccagcuacuuaggaggccgaggcaagagaauugcuugagccucagaggucaacagagcaagauucuugucucaaaaaaauaaaaauaaaaaauaaaaguccucccacucucaugcaaaagccaacaaaccacaauaauaaaaaagaauuuuuccugaauauuccugguucacucucaggcccugacauccccggaacuuaccuaacaugauauuuucauaaaacaacuaaauuuuuauguucuugugccaagaagauucagaucuauaaggcugcuuuaaagguguuaucugucuuuucauuuugcuucgccucuaaaagauuucuguauuuuuccucugguuuaaacauuuuaggaaauuuuauauuuaaacauuucuuccucucagacgggcgggcuuguccaugcuuuucagcggguugagucacuccaggacuacccgcucugcgccagguccucaggagagugcugccggggcugccuggcagacuaguuccaccucgguccgcagggaggcugcauuuuaggguugguuacuagacugcacagugaugaccccuuucaguacauuuuccccagcuuugucucccuccuuaacacuaagauguagaaacaacagccuuaacaucagguuaucccaucugauuuuuggcuuggugcaaacacagagcaccuaaaggugaauuacacaaggaaauggaacaccuucgccuggaagguugacuccugcacuuggcuguuggcauuucaugcauucaacaaacauuuaggaugugcucauuuugagccaggcucugugauaggguggggaauacagaaauaaaaaggcccugugcuguccucagugagcuuccacucuggugagauaaaugcagugcaguacaguaacagcucugauacugaagcaucuggaaggacuuggguccagccucuuggcaaguucuccuggaggaacuaacauuugaccuaugauugacauggacuuuggagaugaauagagguuaaccagagaagaugggaguugccauugggggguuggggcagagagugagggaaagugucagcccuggugggugcuaccuggaggagguugcugaguauuggaaggcccaaggaggccagagaccaaaaaguguccuggggacugcaggguaaaaggaccugcuuuagguuagguagcauuuguuaaaacuuuucggacaguuuaauuuugagcaugugccaacaguuuguuuuagcuuugcaaugcaaggagagaguccugcaguaggcacauucaaugauucgcucuugguagggacauuaagggaagaaagugauuaaauaucaucauugaaacgaaugucugguuaaaaaccucuacacucugauaguugacagucagccggguagaugguaaugaguugcccagagcaagucuuaauuuccuuaaaguucauuuaggaaauugcauuagaaaaaaagcaagcuuuuuuuuuuuuuuuucccuggaaugcuguucauuucuuccuaguaggauacugugaauuuucuagcagaccacuugguucuauuccagaccagguacggaacaguuuuucuuugacaauuuugagauuacaguggaaugcaaucaaguuuuucaaggaccuaccuggugaagagcuuucuaaacuaagcugagaggaacuuggguuuucauccugagggcaguguggaagccagggagggaauucauuuaaguggaggaaaaucucgaccauccuuguagggaguggauuagcugcagugugagguuggagcagugggaauaguaguuggcagaaaaguuuaguuauccuggggagaaaugaugagggcuuugaguuuuuuuguuuuuuguuuuuugucuuuuuuuugagauggagucuugcucuguugccuaggcuugauugagugcaguggcacaaucucggcucacugcaaccuccgccuccuggguucaagcaauucuccugccucagccucccaaauagcugggauuacaggcgcaucccaccaugcccagcuaauuuuuguauuuuuaguagagacaguauuucaccauguuagccaggcuggucucaaaguccugaccucaagugauccaccugccuuggccucucaaagugcugggaauacaggcaagagccacaccgugcccagccugagagccuugaguucugaucugucuuuuccucuccuacucaaacuccucuaccccgaggcagaagcauagcuggggggauggagguggaaauugguuguugcuuuuccuccagaagaguugguucaaaauuuuuaaauuuaaaguaaaugaugguaagaucaugaugcaaggauguuagaggaagcagccagacuuugagaucagggcugagagaaaguagucaaaggccuucugcugaguguacucugccuccagccacugagcccacuugccccaucucugucuuucccgggccugcucacgucucuagccucaggcacugcuucagaaccacaguaccaucuggccuggguguucuggcuguucucaguauuucugcucucauuugcuggaauuaugcaacacucgguccuuccuccgagggccgccagaugagccuacuucagugcaucugcugugguuaaaacagaaucuucugagaugcguuuaugcuaaguugcauacauauuuguguauggugaucagcccuguuuacuuggcauacagcaaaauagaucuauguuuucuugccacuguucagugaugaugucaugucauucugggcagagguagagccagauuguaagaaaggacagggaaccagagcugggggcggagcugggggcggagcuaggggugauuucugcagugauugggggguugcacccccucugacauuauuuugcuuuggugucuccauggucugcuuucccagguucuucucuauugucuuucauuauaauguuuaaucacuaccauguuaacauacugccauaaaauaacacuccacaauuaccugguaacagauaguauggguauauuugaagacaugcauuucucuucugaauuugcugugaguagggacuuggccuuuuuaacuuuuauuucccuaagaaaccuguauucagaauaaauaauuauucaccucuuauguuuuuuuucgcaugucauccagguugcaaaaauaucuggcuuuaauaauuccggaggacuuaguuuuuggggagcaaagguagugagucaaaccugcaagcuuagaaaggagaauucauuugaguuucaucauucggucuggagguuuccuaggcaaccacuuauguaguaauuaaaagaugaggaacuaaaaagguaugugcucggcaauuuuaauccucaaaugcaauccuugucagauugagaucacagaaacaacaacuuaaaauaaguaaauuaaaaaggccaacauuuaauuaaaggacacacacuguuauuaaggggggugugugugugcguguguguguguauguguguguguugcuuuaucuuuuuaaugcucugucuuggaagggaauguucauauauauauguauauauuuuauacucaccuauuugggaaagcagaagugagguuaucgcuucaagugacugcuuuagcagugagguugguuauuauugguucacguguuuguaucugaauguguuaccaucaguagaaucuccagcauguggagaagagagcuuauuagucauguuucuuuuuucaguguucaugggggaguuuauccagauguuuuacuuguuucagucuaccuuagauugugcugaaauguccucuucuguggcucaggagaaagcguagaaaggccauucaugaauagaaaugagagacccuuuuagcaaguagaaacaaccucaguuugcuaaagguuuuccucuuaacucuucacacucacccuuuuuauauagguuucuacucaggugaccugaaggauaugagaaacauuuuucuuccucugugaaacacuaccacucccagacuuuaacacagacuuuucauuaaauuccauuuuaacauuuuaaugaaaaagguggcuuuuuuuuuuucaugugccagugaaagaggaaaguucugcuaguuaugugagacucacuuucuuuuuuuuugagauggagauucgcucuuauugcccaggcuggagugcaguggcgccaucucagcucgcugcaaccucugcuuccuggguucaagcgauucuccuuccuaagccucccgaguagcugggauuauaggcacgcgucaccacgcccggcuaauuuuguacuuuuaguagagacaggguuucuccacguuagucaggcuggucucgaacuccugaacucaggugauccgcccgccuuggccucccaaagugcugggauuacaggcgugagccaccaugcccagcccucauuuucaacaguuuuagaaauaauuacuaucugaaaagaaccagaaugacagaaucuuagcacugguaguuuuacauagggugguguuaugguccuagauagguguccuguagaaauguuaaacacgggugagaugugggaaguggcuguuuucuacuggagauggagaggagccaccuccccacgcugagcaucugugggcaucaugaacauuuggaacuuaagccacaaucauuugaauuuuuuuggaugccccaguuguuuuccuucugucaccaacaacuuugggacuucccuacugcagaauugucgcauauuaaguaggagaccucaguuguuauggaguuuuucuccucccuagauaccuagaucugugaaagaaauccacauagcaaacgcuugucuagagcuacaucucuggacauuuuuuuuccuuuuucuguagcaauagugaaaaauuucuuauucuuacaguccaaauauauguaaguguacuuaauucuuaagaaguuuauuuugacacugacauuuuagugguauugaugauacaguucuaccuuuaauuuuauuuguuuuuuuuuuuaaucauuagagauggggucucacuguguugccguggcuggucuugaacucuugggcucaaacaguccucuugccucaacccccaaggugcugcacccuuaauuuuaacuuguuucauuuaaguuacauauuugaaaugucagacuguacuuuaugaacugccuuaaauuacuuuucaaacaagauggguuauaaauaaggugaugcuuuggccuauuauuuuuaauaucuacauuuuuacuuuuuugugagauaaaaacuaauggggcugggcacaguggcucacaccuauaauccuagcacuuugggagacccagagaggcggauugcuugagccuaggaauucaagaccagccugggcaacaugguaaaaccuuguaucuacaaaaaaaauacaaaaauuagcugggcuuggugguacccaccuguagucccagcuacagggacagcugagaugggaggauugauugaguccaggauguugaggcugcagugggcaccacugcacuucagccuggaugacagagagagaaccugucucagaaaaaaaaaaaaaaaaaacugaucaauugaugcaugcauuuauucacuauacuaggcacugcggauacagagauuaagaccuaguccccauuuuaaaggugcagacaaaucugaaaggagagacgugcaaaugcauaucaugauacuaauagcaaaaacuucaguagcacuuacuauauggaaggugcuguucuaacuacuuucugggcauuagcucaugaguggauaaauagccugaugaaguucuuacuguuauuuucuccauuuuauacauaaguaaguugagacccagagagauuaagugcuugcccaagguuacaaaguuugcuaugguugacauuugaguguauuaagugcaauaacagagcuauccauagagugcuauggcagaacaggggagcauucaguugggaaaauggaaaacagagguguggauaucaauuaaauuuucccaaaggagacaagaugauucagaggagcagaagagcuaaacuuccccaugaaauaccucuaguaacauaaaacgaugcaucauauaugagacuguaaguuaaaugagugacaaaauauuggaagaccaggagacaguaaaaauauaccagaucccugcaucuccaguacaaaugacaaggaaauagauuucuaauuuugaggcaaaacuuuguuuccaguugguauaagauauaauaaacacuuggcauuaaaaaauuaauaaaaauuacuuauacccuguaagcuuguggguaaaugugugauccuuuuugaaagccuuaagauagauuuuccauucauugaagauuuu

SEQ ID NO: 14573 - RNA, 958 nt, Homo sapiens
gagccaaccaccaauauggcuuagucuuuaauuuacuuucagugcuaauaaacuagaucuagugcuggaacccauaaugggugcaaaaacagacucaauaauuguguacuaaaauaauuaaugauuaagucaucuucauaucagaugagucugauucaacuccccuaauggcagaguuaccacaaaguaauacaaacaggccaggcgucccagcacuuugggaggcugaggcgggcggaucacuugaggucaacaauucgagaccauccuagccaauguggugaaaccccaucuccaaaaauuagccgggcacgguggcaguguguguaaucccagcuacuagggggacugaggcaggagaaucgcuugaacccgggaaguggagguugcaacgagccaagaucacaccacugcacuccagccugugcgacagagcgagacucagucucaaaaacaaaaacaaaaaacaaaguaauacaaacaaaacaucaaagcaaacagaaaaauacaguccacuuuuguggauaaaaaaauaagguucugugucugccauguuguuucuuguuugccucuggcaagucauccagugacauacagucugagugauugcuuccaauauagguaacuccccaagccauaccucuaacacuggacaucagcaaagccagaacccccuggguccauaaagcaccucuguucauuuguguguguugucaguguucagagagggcucacuaugcucuggggagucuucuaaacccuuuacaaccauuaucucauaggccuccagccauccuuaugacauagguacuauuauacauauccugguguugacaugcacuagauauauagccuuggaagguuuaguagagauugaguagcuuuuuccaaggcuauacaucugguacauugcaacaccagggucugaaccagcuugggucugacugcagaaccccag

SEQ ID NO: 14574 - RNA, 3826 nt, Homo sapiens
gccaaugaaaucaucugacgguagcuucuguagcccuuaaccuaaggagucauuagagguuauaguaaauuaguuucucuaguggugcagagagaaaugccaucggggaaauuaucacugucuuuuuggcuaaaguuuuauauugugaacuggaucccacuuaacagcuuaaaaacacaaaaaugaaaggguaguccuaguuuaucuucuuaauuagaaucauuauuuggaaauaagauuugcaaugugcugucuauccccaaacacugcugagcuugcuggaaaacagaauuuaacaugaauguugucugaaagcuguaggaucaauggcaaaaaaggggaaauguuugguagggaauuggaccaguucuaagguaucacuuuuaauuauaaaauaaugucuuccuuuuuaucugcuuuucagacagccucagugaacuauuaaacauuugugugcaaaguccuauuuugcuuaucuaaggcauuuugacuuggaaguauuaaacuucaggaacgagcuagagaagacaaugaggguauguuagagaaggaaaaauaggagcuuuuugcuuauggauuuuagagguccacaaaucgaaaggaaaaauaaauuucuucauuucuaacccuaaaauaauuuuguuaaugagaugcugggaagaagacuaccaaaaggccucaaagcucaugcuucuagaauauucaguaauucugaauagucuuugggaaguagcauuucuugggaaguagcauuucccuucuuccaaauaacuguuugagaucuuaaaacagaaaauccaguguuaaugggcucuagaucuuaaacuaggugagcagcuucuuacauacaaccaguuccuuguuaaggauccagcaggaaaaccagccauaaaacauuucaacaugcaguuugggggcucccuugcuuauucacugaguuuaagcucuugcugcaacauagcucuguaccaucugggaugcuagcagucacagcaguuagcucagauaucugagcugucugccacacaaagccugaggagaucaucauucuucaguuucauucauuacuuaaugaaugccaaauuaauuggcaggaagaagaaacacugugugauauacugaacaagccugugugcaugaauaaggagccacucaaaaagccaauuuugagcuuuauuucuccguuguuaacaaaucucaagaaagccuuuguuacaguuuagcucaugucauuugguugguuuuauuuucuagcccuuuaacauaggaggaaaauugucauuucauguauaacuuguaacacagaauugaacugauacuaguuuccuugccuuaaauuaauuauaugucaucccaagggucucuguuaauucugcuuugccaagcaauaaugagaucuggguuuggcauuagaaguauuucauaauuuugguuuuuuauuuagguuuccuccacaucuguaaagugauugauuaaauuagaggaggcguguagaauaaaucccaaucccauugcaacuggcagagcuuuauaaaucuuuauaaauucaguuacaacaaaggagaggauccuacaccauuagagccaugccaucagguguuugcaagugacagcuguaguguguugccucaaauaauaccaaguuauaaauaauaccaaguaauuaucaacucacucccaaauuuaauaagauaucaaaguccaaaagguuacuuaggaguagucuuccgugggggaagauaaauuuauuaaagagucauguacugaucuuuuucuugggauuuuuuuuccuuucccagaaaaaaaaauuauuuuggugacugaucaauuguaaacaauuuucuuccuuacuuacaaaucauccguucagaaaaauaaaaguggacuuccuuuccuaagcauuacaauuagccugggcaagagguguuaugauugucuuauucuuuaagccggcuuacuuuuuggauuugugugaaaugucuuuugaaaagaaaguagauaguauaguauuaauuaacuacuuuguauagucuucugcauaauuuagaguugaaaauaauguaacauuuuccugugaacagauuccuuuaugcguacauacuuuauaaauauacauacauacacauacacauacauuuuuaaaaugcucuuuuuaaagagauucuuaucuugcucccacuccaaaagcuauguacaguugaguuauuagccucagaggaagaguacaggaaagcgaagaugaggaccuccuuuucuuguguuggucuugggaacaaacaguauuccgucuuucaaauauggcauauuucuaaacaguuugggaaagauguuagaauuuuuuaaaagucagcucuuuuauaaauuggaaguacucaguagucagaaauuaagauccccucugauagagauagauucucaaaaccaaaauuggacugaaaauuagauugagaagaaagauacaacuuccuccauagccaauaaaaucugucuuuccaagucugcuuauuaaugcugugaaucgcuccuucuguuugugaaaacaucuccuggacuggaaauguggugcuguaaccagcugagccgaaaguuggagaauguuaaauaucuuauaugggacuuacgauaaaauguauugauguuagugauugucaaaauagguuuaucauuuaaaaaacuaggaaauuacuaaguauaaagaagaaaaaccaguauuaauuaagugaugagaccuguucauuuuguuuucccugacuuauuuccauuaccaaacauaguaaaggccagaaaagauuaaaaaaaaaauuaacacagccauuccauuguuuuuuaccacauggagaaaggaccaggcuggaagcauauguccccccacccuuauuuauauuccuuugagcauugccguuuucuagacagacaauccgaaaauaauuguguugauaggucuguuuaagccugaacucuggguguaaaauguuauccagaagcuauagggagcugccuugcucaggucauuggaaauuucaacccuaagacucauuggaauuucuaaguccguuaugcaccauuaugggcauauggagcauauucauaccaugaggaggagucuuuguuuaugauggacuuuuuaauauggccauaauuaaacucacacucaaaaaggaugagcuauugucaaaagccaaaagaaaaacagacaaaaugaacaugaagcaaggaguccauaaaacaagaguucuuuaccacguuuaagcaaaugucucucaaaaaaaauuguauuucugugcacauuagcugagauucacacauuuugcaccucaguaguauuucagaugagacucaauguguggagaaaaccgcuaacuuguuugguucuacucuuacccccucuucuguggcaauguggggucagggccguauccuaaaguauccacauggucuuaaauggaaaucaugggacucuggaaagcuggcaugagcugguuggagcuuuuaaacagaagugcuuuauggguaucagaucucuucugacaucaauuguuucaaaucauuguugggcucugucguguucugcaaucuuccccauuccccucaugaucucuggcuuaucuuuuauccaaucuguauggacuuuuuaggauuuuuuuuuucuuauaguacaaauaauuuucagaucccagcuuugguaaauguguuaauucuacuuugugaauaaauaaaugagugaucugcuaaaaauggcaauuguagaauuauguuguauguaauguacauauggagaaagaauguauuuuguucauuuucuuaauaaaauguuauauauggaugc

SEQ ID NO: 14575 - RNA, 56479 nt, Homo sapiens
accaguuuacacaaaaacacuuuaauugacaguauacaauuuuccaaaauauauuuuuguaagaaaaugcaauaauuauuaacuauaguuuuuacaaacaaguuucucaguaaauuccaguguacuucagaccccuguccacuaagacauauaugaucccccaguuccugggcaaacuguugaacauucacugcagacaaaaagaccaacaccaaagagucaucuguguccuccaugcuguguuugcagcagaccugagggaucagcuagugaccgugacaaaagcuaugcuacaguuuuacucuugcccucucugccucccccaucauguuuccuuggucccucaguccuguuggaguaaguuccauauauaaaagcucauccaaaacuuuguuucuuggcagaaagaaagaauuguucacuuacaucuuaaaccuaaaugauucagagaaaguguagaagaccaguucuuauguuuguguucaugcccucccuagccuugcuaggguaacaacugggaaaggaauucuguccuuugugucauucuggcaccuucgaguagcaauucuuaauuuaccgauuauuccuucugaggcgcacagucuguggauccagguuuuaaucuuguuucuguccugaaccaugugauuuugaggaagucacuucaucuuugugagcuucagauuaucuuuuucucuagaaaaagauuggacuagaucuugaaauaccuuucuccaugacuacaggguugccugccaaccagagcauauugacuccaaccuuuacugaaauggagcugugacuuugcuggggagggggcaggguugcauuuuaaaauuaaaaaaacaaaacaaaacaccugaucuacaagacaaauacuuuaucauaaguuugucuuguuauauuucauuuuuuguuuaaaaaaaaaaaucaagcaaaaacuugucauuuccaguaagacauuuacauuccuguccagagaaaaaacuuggccaucacucagcuaacauaaugcuuuuucaaaguauguucacuuaaagcagugcaggguagguuaacauggucacuguauuuacauuaucaaaaaaauauguguauauguaucaguuugaacuuguucuucaaaguuucuccaguauauugucaaaaaagauaaagcucaagaagugguuuaaauaaacuuucugcuagcuuuccuuaucaagcgggaaaaaaaucuggugccuagacuagauuaaacccguauucugucuuacaacgcaaagaauauucuguaccuccuucauaagcuuugcugccugucuccccacucucaugacaguaggcuuccuagucaucauacuugugguuucuggccuccugugcagcuuggggaaaccacaguuuaccacugaaagagcugaugauaaacugucuuugcuacaaccuguuuaagucaugcugagcuucuaguguuccucuuaccucuucccagacccaaugcucucugaauuaucagagagcauuuagaacccaguaaagguggcagaagaugaugaccuuuauagaugcauggcuguuuggccuguugacauagguguccugguggcaagagcaaggcaaggugucagauucugaagcuguccuaagccuagacuaacacaguuuggacgaauauaaagcaguaaccucugaaucagcccagagccucuccggguucuccuuggacagagcgauggagagucaggagagucaggaccgaccuggccaggcacuccugcucucuaguccuugccagucaucaucugucuccaagaggccauaggguugcagccuuugauugauuugcagaggccuauuugcugucuccgucaaaagcccuggcuggugaagugugacccaggaucagcaaaggaggaauaauccagucuggccucucccacgggaccacaacagaaaaccuacuggguggagagaacccagcgcugggcaagaaggaagcaaacaccucacucaagccuaacaagauuuccuguuuucccccaaacaggcacuguucuccauccugcccaccuccaaacacuagagcaucggggcagauguuuuuggaacuuguuagccucgcaucccucuaacuccugggaaacucgcuggggcccuaugugaaccccuggccuuccuuuuccccuaggauaucagauggcuacagacugugaggaaggaauuaggcagauggugcaggacagaucuuccccagccccucccccuacccuuuuaaaaaguaagccaucccgaguggauagccuauuucaucagagcuacuacagccggagccugacucuuaagacccuggagguguggcguuucacccgaaaaauggcaauuucauuccccuaagcaguucugcccauuuuccuacuugaucccagggaauuuacgcccagaacgauggagaccauggcgaaaguucaacauuccacacaggauucccccuucucaaucagaugaaaccucaccaugcccacugcuuaggagccuucuacauggcagcuaacugccgagcccauaaaaguccuauauuggggaauagacauagcuuuguguuccccugagaugccaccagaaacugcaagagaaccgcagcagccccacuaggcucacagagaagaggaacagcaaggccuagcuccaggccaggacagugggacguucccacaacagucugucccccaggcugcccuucaugcacccagcaugcacugcgcuuuccaggcccucuuuuccuguggcacaggagaaucagagugagugagaugagcuaacuggacgucugccaacugucugagcuuuuggccuuuggcaguggagggcuggguuagaaaacaacuauaacaaaacucucagcaacuugaaaugucccugaguuuccuaugauauacaggggaaagccuguccuuccuggcugcuuuaauggauugucucugaagacacaucgcugauggggggccccgggaaggccucuccugcagccacugcucuuucauacugggucucagggaaucacucccaucagcugagcagugaacaacaaaaggaacacgcugcucucacuagcuacagcagauuuuagucccugguggaaauggaagcccaaagaagaucguggguggccucugcaaggagugccaggggcaaugggccaguguuccugcugaccccucaucagcugcccugagauaccagccuggacucgaguguccccuucucuccucaccugcacgcagguccccuaagcagaccugguucacgcacggagaccuguguggguuaagcccccaucucacgaagcaaaugugagaaaauccgaauccagaacaagggguucaagguuaugaauaaccugugcuaaucccagaggccccaggacagaguaagugggaacaaacacugaguguagggagggguaagaacauagagggugggaagauggguacacgaggcugggguaggagaaggaaaacuugggagcuggacuuucaggucgucagaucccaccgagccaggauguagcccugcccuccuuuccagcccagccaccugcuggaguuucaccccugcccgggacugcucuggacggaaggcacaugugaacacagcaguguggcauggugcaaauggaaucuuuguucucauccuggcucugucaccaaguggcucugaccuugggcaagucacuuacccucuucaggucucggcaaucucacugcagaaugaagggauuccacuaguucaucuauaaagucccuuacguggcuuuuucuugaucucccucaucauccagcagcacugagcucaggcacuaguggguuauuuuacaagaggaaucuggacagaaugugauuuguucagguugaaaagggaaaaauuaaggcccuggggggauugggaggggacaccccucggaguucacucucccuccccagucuuucccuuccccauccaaacggcacuuggggugguuggucuggagcucuguggugcugcuggaggccaccggcagaccggacuagaggugugugucuuccuccucauccaggucguccuuggucagguuguccagagggacgauccagcugucccccagcuccccguugaggcugaccaccuucuucuccugcaucucagaagaggucuccaucacuuccaguguuggguugucaugguaaccauucuccacugucugcagcuccucuguuagccgcugcuagaguggggaaggugaccggugagaaggggguuucagagggcucugagcuuaauacagcgcauguacguaccccucccacucaggagccccacuguagcuaaagcaggcccucauugcucgccuguggggcuggcugcuccugguggucauucuggcucucagccugcccggaacuaguugggaacaaagacuugccccucacccucacccugguggcagaaccugugaaguuaguggagauggacuuuguucuccagaguccucuaagcucucuccuccccuucaucccuucccccaaaaccuccucuccaggcaccuaccucaccuaucauaaugaaugggaaaaacacuauuaaaaaaugaccucucucgggcugggugacugagcccucaagccugggcaggauggguacggugucucuagaaucaucccugcggcagacagcagccaucuggcagaggcgcuuucugucccucucaaacacaaccuugaguguaugcuagaaucaccuggggagcuuuuaacaacuacacugauggacucagagauuguuugaauuggugugggaggcagucaggcaagggaauuuuucuaaaguuccccacggugugcaggcaggagugagaaccacagggucuggguggcaccaucauggcgagaauucuaguaagguaggcagaagaauuuuugguuagacagaacaccuaggccugcuucuaucaaugaauccucagaccagcucugcaaggagguuaucccugcugugcagaugaggaaccugaugcccaaagagcucaucugacugacuuccucaaggucagggccaggacuaaccaagucucccugacuccaguccaggcguggugacucacaccuguaaucccagcacuuugggaggcugaggcaggcggauugcuugaggucaggaguucgagacuagccuggccaacauggcgaaaccccaucucuaguaaaaauacaaaaauuaggcgggcgugguggugggcaccuguaaucccagcuacuggggaggcugaggcacaagaaucacuugagguugcagugggugacaccagccugggugacagagcaagacccugucugaaaaaaauaauaauaauaaaauaaaaaauaaauaagucuucccgacuccaaagcccacgcucuguccucugccacgcugccucuguaaugcucuguggacugaggcggcugccuaucagggguggccucugccuguuagaaaggguccagggccugcucccuuuccucuucugcaacucgggaaucacgaggggaggguuccucuggugaccugggcugcuuccccuguguggcugcaaacagcugcuuaccugguccuuccucugggagaggcgcugguggcagcagccauagagggccgccacgaggagcaggaaugaugccaugcagacgauggugaugaugaggggcaugcugaagcgguccucggccuccuccgguggccccugguccccuagcuucaugucacugaccccugccugcaugggaaguggcagagaacaggcugggggcauccucucucccucagcccccggcuucacuguagagccccuccgcuugcagucugcuaggguccgugccgccgcccucuucuacaugcaggcacaugacgggguuccuccccacagagagaggggaguaaccagaccucccacaaggggcuucggagccacucuguccccacacuuggggggccgcuuaccuccuuuaguucaucccauuuguccuucagccgcucguacacauccuuggcagggagcuuagcugugggagagggagacgaugcccaauggcccagcccagagcgaggcagugggggacggggacugcgccccaagagagggacgcaccguaucucagucuccugagugucucucgggugaccugggaggggguguggcuugacaguucuuagggaacugaaggggcaccacugugacccacccuccaauguggcuucugcaugccccccauucccacccaugcaggccccagcccaggcccccuugcccuccacucacugugaauagugauuucuuugacgaccacggucugacuuccuggaacagaugccagccguaugccgcacuuaucuugggccggguugaagguggcuuugacugcucggcauaucagugagaucaauuucucauccgaagcgcccccugccuaugguggggagagcgcaggugacuccgcggggagcgugacagcagccuaggccuguggggcugcccucccagcuaaggucgggacagugcuguugcugugcuagaaccugccucccucucuagccccagcuggugcuccacgcaggccugccaggaaucaaggguugcaugcuguucuccugggccaguuccugccuccucugucucguucccaucagcccguucuccgcacuguguuuaucuggucuacgcuugcaccuuucauuccuuucacccuagugccucuuuuuucccuccaagcuguuugcggauuggggguuguuuucaucucccucccuagaacgggcuagagagggggcacugcacagcaacccuaccccacagcccgcagggagacuccaauucccccuaaacucccauucaccagccuuucaugcccaguucggagaaaucagguggggaggcugcagcucucagcagaagggucucuacccccaaagcugaaauacaugugcccuugcccuaggcagagccucuggcucugaagccacggacaggcugacagggaaggggcuccacugaguaggggaacaggugggaucuugaagcuaccccuaggauaucuuggagggggucuuauuuagcucuaagaacaaagauuguggcugacguggcuuuagagcugaggaugaggggagaagugugggcagcauguauccaguccugccaugccaucuaggggcaccccucccuggggcuucucugaccugauucuggaauaaaugacuaagacaaagaaaaggacucuagggauagcuuagcacagaacccauacaaaccaccccuaagguuucuaccagaauuuccuuaggcuuaguaauuccccacccugacaucaggaagggauccaggguuuuccaucuuccuuuucuagcaaagggaaaaaaaaaaaaagugucucacaacaaucacacagccuaccaagcuacauccaaaaagagggucugaggaagggcugggcgggcaccugacuguccccagagcccauaucaugcaaugccugccuuguccaauaagcccagcccuaggagagcacugcucccuuuuaaaacucuggucuagauguaggcuuuuguaaaguucacuuggaaaaugccggcauaauggacacccaaaagaaaacaacugcagaaaauucaggcagcauuaaaguguuguaagcccaaauucuccauccuaucuauagacaccguguucaggucuguucuaguucuaguuccuaggggguggcugcaaaaaaccggcacugaccgggagagggcagcagugagccagccaucuccagcacccgccgcgcucggcaguuauuuacugagugugcacagcgcacacuccccagaccaaagccuuuggacccauggagaccgguggccugaaggcugcucacacacugcuaccucccucacacaggugugcucacacgcacgcucaccacccagacuggagaaaugcuggcaguggcuccugcauuccugggcccuuuucucucccacccaucccaucagcuccucagguuagagggagaaucucccagcacuguucguccaucaaggcucucagauaguccacagaccaggaaaugugaagccacagacgauuaaagcagacagacuacaccucucauuuucucuugcuuuucuuuucuuucuguaaaaacagggucuuccuauguuucccaggcuggucuugaacuucuggccucaagcaaacuuccugccucagcuucucaaaguguugggauuacagguguaagccaccacaccuggccucaccucucauuuucaauugagacaucugaaacccaaagagaucaacucaccaaagucacucccagagcuaggggcaaacaggaacuaggaucagggucccucaacucagcauacuggaaauagucacacagugaaagccgaggaaaccggggggugggagggggggguccaguccuguggguguguccugacuuagagaagucuuaaaccuuggucuguugcucuguaagaugggaaaggaccacuuccuacuaggaagaaaugagggccggaaagcaaaugcaccuuagaaagauguuuaaaaaugcaccuagaaagaacauacauucccucucccucccucagcccugcugugagccugcaccuggcggcucagaucagcaagcuacucacacagaggguguuuccugugagguucaggacgagcugcuucucacucugugucugugucucaagauccucacacuuugccuggaagaagccacugagauuaagguuugggcuaauagucauggaaucuuugacauuuccccccaacuaaggggugacccagauaggaaagaguucacggcaagcuggaggcauggcuggacccauuccagagccagguauguccuggcugcguggcuugagggcagcucaagccaggaccaggcuaaccagggagagggaggagggaauggguaagugcugcucaaagccccagccaggggcccugcguuggaggaaagaacagaaaaccuugucuuaaagccucuucuacccgagucuggguucuccuacuugccccaccccugcuggaguuacccaguuacucucaugagccacagugggagaagguguuuugggguaucgguggguaguugaugcugcuguggggcuggagcucauggucucuggcaggguagguguucucaaugccguugccgggcucgugggcugcacugucuccugggaggaaggggccguagagcuggcuggcaucugacuggaggucuguugaguucuuugcgagauaaccgaugacgcugucauugggaaaacgaggguaaugagaaaagaugagugcacccuugcgagaagaggacaaucuuuucuugcucuaauaguuuucccagguucuuuggucuuaccucccacagagacggaagaaguggacuccuaugacaagccaguggaauaacccggcaaagucacagcagccgcagcaaacguucacugagcacuuaacuuugugcaagggacugggugccucaaagguacuuuccuacugaauccucacaauccucuggggaaggaaucggcaucaucccuauuucauaaacaaggaaacugaggcuccgaggggcucagugauuugcccgaguuccugugccaacaauggcagggcagggauucgaagccaggauuaucucagccggagcccgcacuccuacuguguggcacccuccuguggagcgguggccugcugacuucagaccauaugccucugauaugcagcaacaucaccaggagcgcucagaaacucuggguccacaggucugagaugggccaugauccuaaggcucuugauccauagguagauuuugaaauugauuuacuagguuaagacaagcucuuauaaauaauaaguaaguaaguaaguaaacagguaucggccgggcaugguggcucauaccuguaaucccagcacuuugggaggccaaggugggcagaucacccgaggucaggaguucaagaccagccuggcugacauggugaaacacugucucuacuugaaaaaaaaaaaaaaaaaaaaaaaaaaauuagcuggugugcuggugcacaccuguagucccagcuacucgggaggcugaggcaggagaauugcuugaacccggagguggagguugcagugagcagagaucaugccaccgcacuccagccugggugacagagcgagacuccaucucaaaaauaaauaaauaaauaaauaaauagguaugaaauagaaacuauuccccucucagguucaagcaauucuccugccucagccuccugaguagcugggauuacaggcgccugccaccauacccagcuaauguuuguauuuuuaguagagacaggguuucgccauguuggccaggcuggucucgaacuccugaccucaggugauccaccugucucggccucccaaagugcugggauuacaaggcaugagccuuuucagagccaucacgccuggcccugaaaaguuucuuggugcuugaagaaaaccaggcauuacuuacguagggugguggucauccccgggcuugugaagguguagccagggauagccacagugcuugaacugcuugaaauuuucauaagauggucaugucccgagcuuguugggguggccacaggaugcgucgaaguggguugucgggggcuaaguggacuuguagggugaggggucgucagauguucugccuuaguggaugugaggucuguggucacacuguggcugcuuuuccccccagaguuuguuguaucuucugcuccauucuggcugcuugugguguuagguuuagcuguggcuguggagguugcaacuguaguggugucugcacuuuuugugcucuuggggcucucgauggugguaguaggguugccugagccgccuccucuagccacgguaguguugacugggccugagacuugcugagccaggguuguaguccccggugagucacuggauacaccaaggguggucgccuugaccgaggccaagauuucguuggccuuggaaguggggacugugcucugcugggcuguaucuguagccaugauggugacacuggaugcuggagucggugcuguuuuguuagaugaguccguaguagucuggguugcuguuuguaaagauaacagagaauggaguuagggcugggaggcuuccucaccacgcuucuccagcucuuccccaggauucagaggccuugcucgcagcccugcugucugccuugcuaaaggccugggucuuuggugaauccagaauuuucggagguucaagaaaccucuuuuuucugucuuuuuuuuuucuucuuccuuuuuguggagaauggggucuugcuauauugcccaggcaggucuugaacuccugggcucaagcuauccucccgccucugccucccucagagcugggauuacaggcgugagccaccacgccuggcaugaaaccucuaagagggcagcuuggagugcagcagggucagaaaagcaaaauucugcugaaggcgagcccaggccaaugaggcccaccacacguggaggcugucaugcaugcccugcccuccccguccagccccacacacauccccuuuaaguuucucaauaugcuaccccagaaccagcugccaggaacaccucugucuccuccuccccagcucccaggcacguggcccacagaaaauuccacagacuaaugcuuccugaacugcccuggcccuguucugagcuuaagcaaaaaagacaugggcccuguucucauggaaguuauaucuaggagaaacugaugauaaacugaaauuacacaaauuacuauuucaguacuaggugagcugugccaagaaagaaaggccgagugcccggacugcaugcagcaugguggcuucaccugucauuucuugaggaaauaggaucugugucaggcaauggagacacaauggugaacacgacacagagagucguacccucaagaagcuaacacucugguggggaggcagagacuaaccaccuggacagagcagccgucaaaucugcuuacuacacggaggaagugaggaaggaaaugaugcagagacgagcggggagggaccaugucgaaugagggaaagaaaggcaucucugcgaugaugguuaagcuaagcccugaaggauagcaaggagaaugcugugugaagaaugggaggagaaguguccccagcagaaggaacagaaucugcaaagcccccgaguagggaaagcugcugacagaagacaagcaggaauggaguuugguaaggaggggucagguucagggcugagaaaaugcagggucuuaugacagugauagcaacugagcguccaaaccagacauuuuugagaauaaaaggcccucuuaaaaaucacauucagccgggugugguggcucaugccuuuaaucccagcacuuugggaggcugaggcaggcagaucacuugaggucaggaguuacagaccagucuggccaauauagagaaaccccaucucuacuaaaaauaaaaaauaaauaagcugggcguggugaugguaguaaaguaacugggcguggugaucccagcuacuugggaggcugaggcaggagaacggcuugaacccgggaggcagagguugcagugagccaagauggcaccacugcacuucagccugggcgacugagcaagacuccgucucaaaaaaaaaaaaaaaaaaaaucacauccuacgcagaagaaggagacauaagaucauacuccucagaggccaacaugcagauuccagauuuuauucuuggugcaaaaaagaagccacugaaggcauuaaagcacagaaguuuuauaggaugacuuacagagaaaccuguuccugcugcuuuggggaaugcagacuggaaagaagaguguguggaagaggaaagagaaguuaggaggcaaucacaguaauccagauggaaugaacagcguuggccacaggaagcuauugacacuggagacaaaagguggagagagucaagacuguuuuggagaucaacugcuuguugauguccuaagugagggaagaagagaaucuaaggugauuccuaguuuucugucuggagcagaagggaguggugggaagggggcugauggcugcaucccguacucugugccagccagcacccauaccauuucucuauauuugggaguuccgcaccccgugagacuugauggcagcagaaucugccuccuauguugaugcuccuaugaaaaugccagcucuuugccuugccagccuccccugggaugagcauaagcagguggcagugccaccaugaacgugcagucucauuccagccgugacgggcucugcaggcaggaguggugacaucaugcauggaggugaggccaagcacucauccugggccgcagcgccaccuagugcuuggcauggguaagcagcgcuggccucccugaaucuacagccuggcuugagugagguucaaaguagcccugcauguggccuccagcaaucccagcuacuccauacacuggacaguauccccauaucuuuuacacacacauuuugcuacugaaaagcagaaauguuuaucaggaguagccgccagcagcaagacuucaaggauugguugucaggccuuacuggggacaaagggcagucaaaauucugcaaguauuaaggaauacuugcaagugucccaugauaucucaaggauaagcagucacauuaucaccucuaaucuagagugaagugcccaggaaguggcuuugguguggcccaguggcugcugccagaguaugaaaggcacacucaccaaauguguuuuaaaaagcaauacaggcugggugcgguggcucaugccuguaaucccagcacuuugggaggccaaggcagguggaucaccugaggucaccugagaccagccuggccaacauugugaaacuucaucucuacuaaaaauacaaaaauuagccaggcgugguggcgggcaccuguaauccuagcuacucaggaggcugaggcaggagaauagcuugaaccugggaggcggagguguagugagccaagauugugccacugcacuccggccugggugacagagugagacacagucuccaaaaaaaagugggguggcggggggaacagugcaaugugaggguuugacaggcauuuuuucuucuuaguaguucauaaaguaacagugcuucuuacuauugauggcaucauagugucaucuggcaagauacuagauugcuaagggacuauaucagcauauuuagggaauuaagaaauuggugggaugauuguuuuuuguuuuguuuuguuugugagacaggaucuugcucuguugcccaagcuggaguacaguggcacaaucaggacucacuacagccuugaccuccuaggcucaaucaguccucccaccucagccuccgaguagcugagaccacaagcacgcaccaccacacccagcuaauuuuuuuuucuaauuuguagagaugagaucucacuauaauggccaggcuagucucaaacuucuaggcucaagugauccuccagccucggccucccaaagugcugggauuacaggugugagccauggcacccagcccuggaugguugcuucuuacaguggugaacagcuuaaaacaggauuugucaacucugaaacuauuggcauuuugaacuggauauuucuuguuauaggcaguuguccuaugcauuauacgcagaaugcugagcagcauuccuggccucugucuauuagaugcaaguaauacacaugcacgccccuuuccaguuguaaccaugaaaaaugucuccagauauugccaaaugucuccugacggcgacaaaaucacugccaguaaaaacuacugguuucaagaaagagaacaacaaauucaaauuccuaaaccuccuauaaaagcacagacugaaaaccagagacuuuccaagaacacauucaaggagucucuuuguuugcagcugaagggcugagagggcccuuuaaaagacuuuaaaagcuuaauuccgugaguugccgaauuaggguguuaacuuaauucauaagcucaccaggucucuuaugugaaaauaggaccuagagaauuuuuuuuuugagacagaguuucgcuccugucgcccaagcuggagugcaauggugcgaucucggcucacugcaaccucagccucccagguucaagcaauucuccugccucagccucccaaguagcugagauuacaagugcacgccaccaugcccaacuaauuuuuuguauuuuuaguagaaaugggguuucaccauguuagccaggcuggucucgaacuacugaccucagauauuccgcccaccuuggccucccaaagugcagggauuacagacgugagccaccgcgccuggccaacuuagagaauuaaauggugacaugagaggguguagaugaaucagacuacccauaaaucuccaucuucaauggaauucacuugccaggaagcucuaccacugcucuccuguaagauccucaauaaccucacuucagcucauuggcaccgaaagccaaaucucaucaugauccccacugcucuuuauuuucuucauaccuauaacaacagucagauuccaauaugucccaggaggaaaaacacagacucugaccuaggagaaggcucacacacuaaaaauaucuacaaaaaaacuugcaaauauuuauggauauuuaacauaagggugcuguaucaaaaggaggaugaugauaauuuuacaucaggcugaauuacccaguauggguaugcauagcauagguuuuggauccaauaugcugacucaagcagcuacagguaguucucauugcuuucuuaguuggaugacugaaaccuggacucaauggaaaccuacauuaaauaaagcugaguugucagaaauucccuggaacaauguauaggaagaaaugaaagucuuggcugggcacgguggcucacgccuguaaucccagcaauuugggaggcugaggcaggcggaucacaaggucgggaguuugagaccagccuggccaacauggugaaaccccgucucuacuaaaaauacaaaaauuagccgggcguguuggcgcaugccuguaauccuggcuacucaggaggcugaggcaggagaauugcuugaacccaggagauagcaccacugcacuccaaccugggagacagagagauacugugucucagaagaaaaaaaaaagucuuggagaaacagaguguuuaucauguauguccugcucacucaugcucuggugugucaugagaacucaaaugacacucccuuuacaaggcuuuaagcaacauaauucaugacuucugagauucacaucuuuccaugucucugaaaugagaauguauuauaaauaauugugggucacgcuuugacuguggugcuuuuuuuucucuuuuuuuuuuuuuuuuugagacagggucuugcuccaucaccuagguuguagugcaguggcaugauacacugcagcaucaacuuccugggcucaagugauccuucugccucagcuucccaaguagcugggagcacaggugugcacuacgacaccugagaaauuuuguagaaacaggaucucccuauguugcccaggcuggucucgaacuccugugcucaagugauccuucuaccucagccucccaaauugcugggauuacaggugcaagccaccaugcuuggcuuuuuuucuuagugguucauaaaauaauagugcauccuauaauugauaguggcuuggauuugauuacauuugggauauuguuaagaggacuauucauauguucugagaacucuuguggcugaccuucacuggucagguauguuaauaggaaaugcugcugauuucaguggggacggacaccagguuccuuaguguagagaaaauaacagaauuucguuuccaggaaaaaagguguguguguuuccacagugggcagcaagaccagcguagugaucgcaauggucuaaccaaggcuauuucgagcagcagcuaacagcuugugugcucuuuaggaucagaauggacgggcaacucacugacuuccuagguguagggcccgcaaacugggaacuguguugacucacaacgauagagaacgcagccagucaaccaggucccagaacucgauguuuucacagacucagcguuccuugaaugaaucgugcauuucuuuuccauggcugcguuaacaaaugacuacaaacuagguggcuacaaacaacauaaauauauucucucgugguucuggaggcuagacguccaaaauuggcagggccaugcucccuccgaagacaccagggaagacucuuuuccugccucuuaccagcaauccuggcuacuccuuggcuuguagcugugucacugugaucucuggcuccaucaacacaagaccuuccuccuugcguaacucuuuuuuuuuuuugacacagagucucugucacccaggcuggaguacaauggcgcaaucuccacucacugcaaccuccgcuuuguggguucaagcaauucuccugccucagccucccaaguaccugggaccacagguacacaccacuacaccaggcuaauuuuuguauuuuuaacggagaugugguuucaccauguuggccaggcuggucucgaacuccugaccucaggcgauccacccugcucagccuccugaagugcugggauuacaggugugagccaucggggccggccguauaucucuccucuuauaaggauaccagucauuggauuuagagcccucccuaauccaguaugacuucaucuuaacuugauuacaucugcaaagacccuauuucuaaguagggucaccugcacagguaccagguaccagagauuaggaccugaacaugucuuuuugcggggggaaugccauucgcucuccugaucugcucuccuauauccucgugaaaauaccaggagucuuucaaacauucgaaauuaacucugucugcuuuaaagagaaaguaauguauuaaaaagauaaugcguuggcuaauaaaauacuugagguggcuaaagaaucaagcguaagucagaaacagugcucaagaccucuucuccugaacgggucuggugaggucaucacuucuaccaucaucgagcaucaguuugcaccacuggcaacauuaguauuggauacuggcuuuuauuggggaugagaguguuuaaggaugcuguccguaagaggucuuuccauuuacuuuuaugacuggcaccauggggaauccccuggguucuagccauauuccuuccugcuucauuauuuagccccauguaggguucaggcuaagucugauaaaauuuaacaggccacuuauccugccauagagugagcuccuugguaaagccuauggucugugggguaauugugauggugaauaaagcauccuggaaguccagaaacggcgccgcugacagaaacguggcagccuggagggcacacgcagguccagaacgggccgcccuccaccacgccacuuggucacagauccacagcgccaucauuaggcgauggagaagaaaacugauaugcugaaggggucaucuugcccaucugauuacccagagccuuucucuagacgcaggcaaauauccucacacuccagaccuaucccugugggucccuccacaggccugccuaaccuuccaggucacacugauucuccauugcuguuccuucugaguucccuagcauuguuuuaaaaaugauuagcuccugcugaugaaucuguucagagccucgccucaguggaccuuuccuucaaaaacaaaagaccaggaaauguauucuuuaaaguccuggccacugggagaauuuucuuucuacgccacccuucaggauauagagcuuuucuccugucacuguccaguuugggcugguacuagcauauuaucccaaaucauauaaaaccaggcuugguuuuuucacuccucauucagcugaucucggguaacuaauucucuuagagaccuuuagguauggguggggguaggaacaggcauucugagggugugagccgcgcuccaauuuccauuguccuccuuuaagaccagcccaggccugguccucuaucuaccaccuucaaucuaacaauagaaagccacaaaacaaccuaaagaaaaaaauggaggaaugaaagaacaaccaaagaaauagaaaccaaaauacaauagcacauaucaaaaucaaaaauuguuuuuuuuaaacaggcuaauaaagugccaaaaagucuuuggagagguugaucaaaaggggaaaaaaaaaaauccaaaggcauaaguaaacaaugugagguacaaaaauaguaauaguuauuuaaagcauaauaccuuaugggcaaauauuuauaaaucugaagcagacgagacagacaaauuucuuucuuuuuuuuauuuuuuugagacagagucucacuccgucccacaggcuggaaugcaacagugugaucuuggcucauuacaaucuccuggggucaagcaauccuccuacuucagccuccuggguagcugggacuacaggcauguaccaccacgcucagcuaaaauuuuuguauuuuuuguagagauaggguuucaccauguugcccaggcuggacucaaacuccugggcucaagggauccaucugccucagucucccaaagugcugggacuacagauaugagacacugugcccugccacaaauuucuugggaaagaaaaaaacuuaccagagugacucaaggaaaacggaaauaaucauuuauccuauaaucauaaagaaauugagccuuuccaacuugggugcgguaaaauggcuccugcgaagaggguggugagaagaaaggccguucuaccaucaacgagguggugacccgagaaugcaccaucaacaaucccaagagcuuccuggagugggcuucaagcagcaugccccucaggcacucacagagauccagaaauuugccaugaaagagaugggaacuccagaugugcgcauugauaccaggcucaucaaagcugucugggccaaaggaauaaagaaugucccauaccuaucccugugcgguuguccaggaaacagaaugaggaugaagauucaccaaacaagcucuauacuuugguuacccacgugccuguuaucacuuucaaaaaucuauagacagucaguguggaugagaaauaacugcugacugucgaauaugucaaauaaagguauaaaaccacaaaaaagggaaaaaaaauaaauugaauagguacuuuuuucauaaagaaacuccaaaacaggauucaaagaucaaaucauucuggccuuacaugaacuuucuguagcacaaucuguucugcucuaauaugugucuguaaaaggaauuguuucauguacaaucguccaucaacaaaacaugaaaagcgcaaaccaaagaaaaagacugauacauuuagcgucaaaguuaagaauuuguguucaucaaaagaaacaauaggacuuccaguuucagcuaaugagagcagagacuggaaagaacuuugcuccuacucugacuacaagaaaaaagcugagaggcugggcaugguggcucacgccuuuaaucccagcacuuugggaggcugaggcgggccgaucacuugaggucaggaguucgagauaagucuggccaauauggcgaaaucccaucucuacuaaaaauacaaaaauuagccgggcgugguggcaggugccuguaaucccagcuacucaggaggcugaggcaggagauuuacuugaacccaggaggcagagacuacacugagcugagauugugccacugcacuccagccugggcgacuccaucucaaaaaaaaaaaaaaagcugagaagccaaaaaguuaagacuuuucuugagcccugaggucaugaagaaaacaaugacccugaaaaguggagacagauggacaacugcagggagcaaugggacccgagcacacuugcuuuaccugggacauggacaaaguucguuaagaagauuaaggucaauuuuuuuuuuuuuugagacggagucucacucugucacccaggcuggagugcaguggugugauuucagcucacuggcucacugcaaccucagccuccaagguucaagugauucuccggccucagccuccugaguggcugggauuauaggcaugcaccaccacgcccgguuguauuuuuaguagagaagggguuucaccauguuggucagguuggucucgaacuccugaccucgugauggacccaccucggcuucccaaagugcugggauuacagacgugagccaccacacccagcugauuaaagacaauuuucaaaugaauuucuaaaagcuguguauggguuaguaugaaaaugugaagcccugugagcuguaggcauuguaagguccacaacacagggcaguuuacuccugggaaccccgccaggugcucauaggaagccuugaaaaagcaaacccuugcggguggggcuggcuggggaaagaaaacagccggugcugaaacuccauacccaccacauucccacagggcaggaaagaagccuuucagguggaggucaguaaaaucuacagccugagggcacuggcggaaaccucccgcagccagggaagagaauaggaaagauaaaacagcuccuuauuccugaagcaaagcagagcugugggcuaaacccagcccgaacaucuaggaagaggcaggaaugccagugaaggccgcacccucaagcucagcuucccagggccugagugagacuuaaacagaacaucaggaaaugguccccuccccuguuccacaaggccagcaagugugaaguaaaaaauaacaguggagcagcagggcgcaguggcucacgccuguaaucccagcacuuugggaggucaagguggguagaucaccugaggucagguguucgagaccagccuggccaacacaaugaaacccugucucuacuaaaaauacaaaaaauuagccaggcuugguggcacauacugaguagucccagcuaccgagacaggagaaccgcuugaacccgggagguggagguugcaguggagcugagauugugccacagcacuccagccugggcaacauggcgaggaugcaucucaaauaaaaacaguggaauacagcuguggggagcugcaaaaggcagacuauuugaggagcagcaaacaaggaugggcuacagccaagcagggacccacagagauauuacuggaggacuuugcagccccgggugcaccgaagguauucauagcaacaacaaauugugaagcccagccuaacucgugccuugauuaacauaaaccuucgcacuaaagacacagcaaaagaaaagccacacaguaggcagccacuaaucuacuucugucuauggacucaccuauucuagagaguucauguaaacgggaucauacacuacguggucuucugugacuggcuucuuucacuuugauguguuuucaagcuuuucucuuucacuuuuguuuuccugguucauccaugcuagcaugugucuguuccuuacuccuuuguauugcuaaaugauauuucacaguauggagcuuccauuuuugcucauccauuaaucggcugaugaacauuuggguuguuuuaacccuugggcuauuaugcauaaugcugcuaugaacauuugugcacagguuuuuauguggacauguuuucaauuucccuuggguacauaccuaggauuggaauugcuaggucauaugguaacucuuuauuuaguaucuggagggacugccaagcuauuuuccaaaguggcuaccccauuuuaacaugucaaucagcaauuuuuuugugaauccaauuuuuccagauccuugccaacaguuaucaucuuuuccauuauugccauuuuaguaggcacuaaauaguaucucacugugguuuuaauuuuuauuucccuaauuacuaaucaaauccaacacuacauagaaaggacauaaugaccaagugaggcucaucauggacaguucaguauuugaaaaaucaaucaaugcaauucaacacauuaagaagcaaaauaagaaaaaccauaugagccgggcaugguggcucacgccuguaaucccagcauuuugggagggugaggcgggcagaucacgaggucaggagaucgagaccauccuggcuaacacggugaaacccugucucuacuaaaaauacaaaaaauuagccgggcuugguggcgggcaccuguaaucucagcuacuugggaggcugaggcaggagaauggcaugaacccaggcggagcuugcagugagcugagauggcgccacugcacuccagccugggcaacagagcgagaauccgucucaaaaaaaaaaaaaaaaaaaaaaaacaagaaaagaaaaagaaaaagaaaaaccauaugaucagcagacuccucaacuccauacaagauuauuuuuauauuugcagaaaaaucaucuaacaaauuuuuuuuuuuuugagauggagacagucucacucuguugcccaggcuggaguacaguggugcaaucucggcucaccucaaccuccgccucccggguucaagcaauucuccugccucagcuuccugaguggcugggauuacaggugcacgccaccacgcccaguuaauuuuuuguauuuuaguagagacgggguuucacuguguugugcaggcuggucucgaacuccugaccucaggcaauccacccgccuggaccuuccaaaguguugggauuacaggcgugagccacugcaccuggcccaucuaacaaaauuuaauauccauucaugauuuaaaacaaagcaaaacaaaaccuuucagcaaaccaggaauaguagagaacuucccucaccuaauuagugacgucuccaaauaaaccuacagcuaacaucauacuuaaugggaagagauugaaugcuuugcugugaaguuugagaacaaagcaaggauguccucucuuuccacuccuauugaacacuguacugugaguccuacugaguucaauaggaaacacacacacacacgcacacacacacacacacagagagagagagagagagagagagagagaaaacaacaaggaaaacucaacaauaaaaacccaauuuuuuaaaacaggcaaaagaucuccaaggaaaaauuaccaaagauauacagauggcaaauaagcauaugaaaagaugcuccucauuagucauuagacaaauucaaauucaagcuccaaugcagcaccauuacauaccuauuggaauagcuaaaaucaaacaaacugacgaucccaaaugcuaaacaggaucucucauacauugcuggucagaaugcacaaugguacagauaauuuggaaaacagguuagcaguuuauuuuaaagugaagcaaacaauuauuauaugacccagcaauuccauucuuauuuaccuacaugaaaugaaaaccuauagucacauaaaaaccuacaugcaaauguuuauagcaguuuuauuuaccaucacccaaaacugagaaccaccaagauauucuucaacaagugaaugaauauuauauagccauauaaugacuacucagcaauaaaaaggaauaaacuagugauucaugugacaauauagauaagacuuaaauacauuuugcuaagugaaggaagccaaaagucugcacagcauuugauuccauuuugauguuauggaaagggcaaaaugauagggauagaaaacagauagguagacaccagagguugagggaacugggaggagcagacuccucaacuccauacaagauuauuuuuaggacagugagugaugcacaaggauccacaagacucugcaucuguugaaacccaaagauuugcguacuccaagaauuaacuuuacuuaaugucaauuuagaaaaauaaucaucucagauguccaggaaauccuaggauguaauggagacuaugaaaaucaauuuaacuauauuauaaagguauaacauggccaggcgcacugguucacaccuguaaucccagcacuuugggaggccgaggcggacagaucaccugaggucaggaguucgagaccagccuggccaacauggcaaaaccucaucucuaccaaaaaaaaaaaaaaaaaaaaaaaaaauacaaaaauuagccaggcaugguggugcgugccuguaaucccagcuacucgggaggcaggaccgcuugaacugggaggcagagguuguagugagcugagaucgugccauugcauucuagcccgggagacaagagcaaaacuccaucucaaaaaaaaaaacacaaaaaaaguauaacauaaccucgcugaagaggguggagaacaagaguugacucugggaaaguuuuuuuuuaaacuagauacuguaacgaacugcauaaaaacaguguauuuuaaguaguaagaauguuucucacaagggcaugucaauuucaaaccuacuugacauguauacuaggauugaacaaauaauuaaauaaacuauagauaacauaagccagguuucuagcucuuggagaaagaaguuacaaauaaguaaacggguggggaggaggcuagcccugugaugcuugaugagaggcagugaugucagucagucggaacucauguuucaauagacaaauagaugacagaugaggaaaugaauacauacuaaacaaauguauauuucccagcucuguccacucagagcaucuggaagcagugacaaaccaguagcauaggguacacccagguccauguuugguuucugauaccauucuacaaugaaaugaaccaaggcuccuuggagaaagggcuugauuucuaaugcugauacaaggaaaaugcaagauaagccuggaacaucuuguaaugucagaaaauaaagaagugcuaaaaaaaauaaaaaugaaacgaagaggaaggcaaguucagccugcaagaccugaaagagggucaacaggaaagagcucauaauggccaaaccuggaacaauuugagcaacaaaacaagaaauacuggaucggaaccccaagaauaaaauaaauauccacgagucuaaucugauaaauaaaugauuaaauaaauaaagcauccuuacagugcuuuuccaaaaaaauuguagguaugcccccaaaacuucuauacuuaagaaaacaacccaauagaaaaaaaauuaaacaugcauuuuacagaaaaaaaaaaagcacagccuaagaacaucugaaaauguuaguaauuagggaaaugcaaaauaagaauuuucauuucauacccaucagauugacaaacauuuuaaaguaguaagaagugguagcaagaauaugaaguaguguaaauugguugaaacacuuuggaaaagaguguggcauuaucaaagaaaguuagacguguacacauauuguucaauccacaacuuccuuacucuuuuuuuuuuuuuuuuuuuugagacggagucuguugcccaggcuggagugcaguggcgcgaucucggcucacuauagccuccgccuccuggguucaagcaauucuccugccucagccuguauccgaguagcugggauuacaggugcccgucaccacggccggcuaauuuuuguauuuuuaguagagaugggguuucaccauguuggccaggauggucucaaacuccugaccucaagugauccacccaucuuggccucccaaagugcuggcauuacaggcgugagccaccacaccuggcccacaacuucuaacuguaucacuaggcacuuauccuagggagacaaguaugcaucacagugcauuuacaaaaaugcccuuaagaguaguuucacauuggccccauacagguagcaagaaaacgcaauguugauaguaguagaguacaguugacaguacagcugacaguaguauggauaaauaaagugauagcauauucuucuagaaugcucuacaggacugaaaauggguggacuacaucuauuagcauuaaucuaaagaauaauauuaggcaauaaaagaagaacaagaacacucauacgguucuacuuacaaggcacaaaaaucggcaauacuaaauguuuuuagggaaacagaagauguuacuaaaauuuuacagaggauuuaacaguaaguuuagaauacuaguuaucucuagggggaaacagggagaugcaacagaagcuucugcuuuagauucacguuuuaaggaaggagugguuggcugugcugaaugaugagacuggcaaagggaagucccuggcaaccaccaugugcaguuucagugggcacagugcagguggaagccugacucgggcagacugaagagugaaugaaugguaggaaaaugaguuugcauguguggacaacucuuucucaaaugcuaggggaccagagacauacggcagcagcuggagggagcugggacagucaagaaacuuguuuccuuuucgaagguaggagaugcuagagcugguaugaaugcuuucuuuguguauguguucuccuccuacuguuucauaggguccuuaagaugcagaggagauagaccugugccaacucagcaccaguagaggauuuggccuucacuggauagucagacacuuuuuuuuuuuuuuuuuuuuugagagggagucuugcucggucacccuggcuggagugcaguggugcaaucucagcucaccgcaaccucucucuccuggguucaagcaauucuccugccucagccucccaaguagcugggauuacaggcgcccaucaccuggcuaauuuuuguauuuuuuuaguagagaugggguuucaccauguuggcuggucucaaacuccugaccucaagugaucuaccugccucagccucccaaagugcugggauuucaggcgugagccaccgcacccagcuaacacuuccgucuuugaaacaggagggaagaaaauggauacagucauaacugcagcuguauuuuggugguagaaaaaguuuacauuugacagcuuuaauuuucucaaugaagucuagaugaaaucagcuauagugauauagauagaaaaaaggagaagggaguauuugagggaaaaguguaaaauacucauguuggaaauaggaacgugaaccucuuagaaaagagguucucaaucuucagcaagcgucagaaucacacagagguugugaaaacaccagcagcuggauccagccccugaguuccugauucagcaggccugggaugugaaauaugcauuucuaacaaguucccaaaagauucugaugcuucuggccagaggaccacacuuugagaaccacuaugcuagagaaguaaaaugugauugucaaguaguauuuggugccaaauugaggcauggcaucaugaauuuaaaguuaaugcaaucggccagauuuuacuguagcgauguucagcugcuugauguagaaaaauggaggcaaagguuuaucugagaauggggguuuugcuagguaugacagcaggagagggugcaaggaauuuggggauaucuuuguaacgcaaggauucuaaugguggauuguugaccuagaggauggagaaagacagaaauaaggccagguaggggcugacaggcaaugaggaagguuacuggacucuuuguuaggucuugaguucaagcaucgugauguggguuuacuugagcagauaaguuggaagguagagagacagugauacaaggaggaaaugcugagauuucagaggugauacaguuugaggggcugauaaaguucagggggggaaacgggaaugacccaaugaaguagagaugagaaaauguugagaaacagaggccaggguauuucauuguuuacccaagugaguacuggagucaccaagaaugaugacaccuauuaagauggagaggauggagugaaagucuuuggugagugauggacagggcugaagaggucaguacaucacagcaggguagaaaugacaugacauuccugcugauguugaagccuguguugaaugaguuaacgcagugccagcucccccgggggccagggggacagugggaggagaagacagacuucagucugcuccccuggggugggaagccugcuucaaucuucaaggagggccugcuuccucuguuacuggcuauuuccagaccugggauugacucuugacuauuaauagugggaaaggaaacuggaaagaaugcuccaggaagagggguguggaaggaggccagggaggaggugggaugagaggcucuggccuggacaccaguaucgaccucuccuuccuucuuuauccccugcuuaccacccccaacucaucuccacagaaauaaaaaaaaaaacuuccaaggggagagacaggcaagaugagcggauguguuccucgauuggugugccaaagggaagagcgcaggcugggaaaugagaaggucugaaccuucucauccugcccccgccuuggacccucaggccugggcaagcugucugcccucuugaaaugcaucugugaaaggugggccagaagauuccuaaggucccucgggguguguacgcacucuccugagcacgacacuguauacuagguaagccugcuuuggcugugacagcagagccauccuagccagucauuucagagggcuugcgcugggccucccuagggguauaggcgggagggcuugcgcugggccucccuagggguauaggcggggccuuuccaagggcugcccaacccuaacacucauuuuuccaacaugugguaucugcuccacaagccucuucuuuccagggggugcagggagcugcuaggacucgggaagggccuggugugaugccauugcagguucggccagguugaggucuacaccccacccccccacccccagcucuccagggcacaccuucucaggcuacaaguccugcuggccauuguacacuggccuuuuuauugccagcugggcaggacagcgaggcaggguggcaugggagagccggaucaguaagggaccuggggcugcucucuguucacuuggccaggacuccucccagcaccaagguaucaggugcccucucucgccccugcaugcagcccccucacuccccagccuuccuugugaaggacgugaugcuccccauguuacggucccaccucugugugucuuggguguuauuaaucaggucagggcugggcuugguggcucauaccuauaaucccagcaauuugggaagccaaggcgggagaaucacuugagcccaggaguuugagaccagccugggcaacauagcaagaccucaucucuacaaaauauucaaaacauuaggugaguaugguggaggggcaccuguagucccagcuacucacgaugagguaggaggaucacuugagcccagugagcuacgagcuaucacuugaggcugcagugagcuaugaucacaccacugcacuccagccugggcaauggggaaagaucaugucucagaaaaaaaaaaaaaaaaaaggccaggugugguggcucccaccuauaaucccagcacucgggaggccaaggcggguggaucaccugaggucgggaguaugagaccagccugaccaacauggagaaaccccgucucuacuaauaauaaaaaauuagcugggcgugguggcacaugccucuaaucccagcuacucgggaggcugagacaggagaaucgcuugaacccgggaggcggagauugcagugagccaagaucgcaccauugcacuccagucugggcaacaagagcaaaacuccgucucaaaaaaaaaauuaagucaguacgcuuaauucccugccccagcggucuggucauccccuugcccugcucuugcuuagcugggcacucauuuccuuccaccaaaaggcccuucuggaucccuccagcccaguguggguccuguccuuggaggcuguuggcucuggucuucugcucuggaaucuuauuaaugcuauauccagccgcuuauaaacaauugaccucuguggcuuuaagaaaaccaguaucucccccucucuacccugcaaggugccaaccagauguugaugccuccaggaggaaccugaccugggauaagagcaaggagcuugucugcagaggacagcaugggaaggccaucgaggaacugacucgccucacucucgccaaccagugucggcucucuuccccaucugcaugugcucaggugaaccuuggcccaucucugcgccucaaguccuagaucaguuuaccuacgaccgccauaacaaauuaccacaaaggcuuaaaacaacagaaauguagucucucaccauucuggaagccagaagucuaaaaucaaggugugugcuucugacacucccuggcugaagcaguaucccgccaaccucugcccucauggucacauggccaccuucucuaugugccucuuaugaggacacuugucauuggauuuagggcccacccacuuaaaaccagcaugcucucaucuugagguccucaguuauuaucuguaaagacccuuuguccacauaaguuaauaaucacacauuccagccaggcgcgguggcucaugccuguaaucccgcacuuugggaggccgaggugggcggaucaccugagguugggaguuugagaccacccugaccaacauggagaaaccccaucucuacuaaaaauacaaaauuagcugggcaugguggugcauggcuguaaucccagcugcucgggaggcugaggcaggagaauagcuugaacccagguugcagugagcuggagaucgugcuauugcacuccagccugggcaacaagagcgaaacuccaucucaaaauaauaauaauaauaauaaucaucaucaucaucaucaucaucacacguggccgggcgugguggcucaagccuguaaucucagcacuuugggaggccgaggaggguggaucacgaggucaggagaucgagaacauccuggcuaacacggugaaaccccgucucuauuaaaaguacaaaaaaauuagccgggcaugguggcaggugccuguagucccagcuacucgggaggcugaggcaggagaauggugugaaccugggaggcggagcuggcagugagcugagaucgcgccacugcacuccagccugggcgacaaagcaagacuccgucucaaaaaaaaaaaaaaaauuaaaaauaaauaauaauaauaauaaucacacguuccagagauuuuuacuuguauaucuuuuuuuuggaggggggguacauuuuuggucugccauagguccccaucuggaaaauaggggguagugacuccugggguugugcucuuucccucuaaaugguccccugcuugggcucagggccccaaaagugggguggcuugacuucccuggguauaagggguaugacagacuugacugucugggccccacauccagugcauauguggaagccccaacccccagcgugaaggucuuaggaggcggugccuugggagagacuuagguuuagaugagguccugaggauggagccuccaugauggauuaguguccuuuuaggaagaggaagagacagcagaacuucucucugcccggugaggucacagcgugaaggcccugucuacaagccaggaaacgcccucgccagaaccugaccaugccggaacccugaucugcgacuuucagcccccagaucugugagaaauaaaugucuguugccuaagccacccagccgacaguauuuuguuauacuguaacaaaaaucagagcuaagacaagggguucaggauggagauuaauaacgagaacagagacagcaggaagggcugcuccaacugucuggggcaaggccggguccccaacgugcgccccuuacccccacacaggcugagugucagguagauaagugcagccacagacuccagucaugcuccacccuccccgucccuucccugggacccuggcaggucuguuggcucugugguccccaggacccuggcagcugugagacuuggggccucuggguagcaggacggcaccucagggguggggucgucaggccugccucucagcaucaccucucccagaggggcugagagcugcccccuuaggggagauaauuccgggcauucuucaaaucuggaauuguucugcccuuaucagcuuguuucagcuggccugcccggcacccgcugcucccuguaggguggggcccgucugccugcuucccugggcaggagagggcugccacugucuagcguggagaugucccagcgauggggaagggcagccuucgcuugggugcauuucucccugcagggagggcacuguggccagaucaccuguaagaagcccugguucacaccacuucuucccagggcugacaaguccucauucuuuccuguccucaacaccugggagcagggcacagcacccaaggauacuuggcucccaucugcccacaucccugccucagaggugccccucuguaacuccccacuaaagcaguacaggacagaggcuaagagcauguaccagggagcccgacacccggcuuccaguccacacacaagcuguauaaccaggcaagagucucgacuuaacauaaaugucugaaugcuguuccucaguuuccccaucugucaaaauuggagagcaggguaauaaaaguaacaaacucuauaccuuugaguacuuagagcagugugugcacauagaaagugcccgaucuauggcagcuauaauuauauuccugcugagcugugcaggggggaaggaaaggcaccccaccuccccuuacccguuagagccgcgcagcccaccuccuccuccacuccuccuccacucccucucgagccacucacaccugcacaggccuugccaaggugagagugggugcaggucugcccagacccauguggcucuuccuucucagugaggcauggcugaucuggggaggggagaagaugaggcaccagggcagcuguggucaagagaagacccagaugaggagcugagccugaaccuuccuggagaaggaaaggaaacccaggccugggggaccccaacuccaggaaguguuuccucaccggcucagagauggagggaggggcuuuccggcugucagccucaaguucuacccugauaaugaccccgcaccccauccuggcggggcaaggccgccaccugugagagcucuaugugaggucagcugggcuccaggaccagugccuggugucagggccacagggguggccggcggggguaggcaguaggguggggugggggucaggagggggcuggagcucagacuucacuggcugugcccuucucccucuugggccuggcuuuccuccucagggaaaugaagcucaaucacuucugccuccuucccuuguccaucacgauggguguggaccaagauggaagagucugguaagugagacucuggaggaagaaggcagggaacucaaauguauuaaaagauauuuuaauacacauggccgggugugguggcucacaccugaaaucccagcacuuugggaagcugaggugggcagaucgcuugagcucaggaguucaagaccagccuggaaaacauggugaaacccugucucuaccaaaaauacacacaaaaaaauuagcugggugugcuguagccuguaguccuagcuacucaggaggcugaggugggaggauggcuugagccugggaggcagagguugcagugagccaagaucgggccacugcacuccagccggggugacaaagcaagacucuaucucaaaaaagaaaaaagaaaagaaaaagaaauauauugaccaucaacggagggccaggguaucuccuuaauucucaaaaggacaugagauauguguuauuaucuccacuuugaaagugaaggcagucuggagggaagggaaggggaguuagcaucugaugggugcagagcuucagugucggaggaugaacaucuucugcagguggaugauaggagcaggugcaugacagugugaagaagguacuuaaugccacugaacugcaccccuaaaaaugguuauuacaguaagcuguacgguaagucaauuggaccacacacacacacaagugaagaaagcguucaacaccacagcaaguaaacaggucaguuugggacaccagugugacugggggcagcuuucucuccauggcccugugugcaggaaagaacacccucucguguguggaaucacucugugacacaguauuguacaacagaggucacacacuuuuuccauaaaagaccaaaguaaauaucuuaggccuuauagggggccauacagucucugccgcaacuacucaacuuugccgucaugggccugaagacaaccgcagaaacaaccuguacauaaauggguuugacuguguuccaagaaaacuuuacugacaaauacagcuggccaagcagucauaugcugaccacugaugucuaagaucccccuggggcuaggccuauuuuuguuucuuuguuuuuuugagauggucucgcucuguugcccaggcuggagugcaguggcacaaucacagcucacugcagccuugaccucccaggcucaagcaauccucccaccucagccucccgaguagcuaggacuacaagugcuuaccacccugcccaacuaauuaauuuuuuguagagacagagucucacuauguuauccaggcuggucucaaacucuugagcccaagugauccucccuccucugcuucccaaagugcugggauuauaggcaugagccacugugcuuggccaaagaggacuauguuuuuuaacccagcuguggauccuauucugacuuuccuaaagagccugacaagugucacuuguacuagccuguuagaaaccaagccacaucauggcaaacugggaaaaaauauuugcaacucauauggcaaaggaaaauaccuaagcugucagcuagcuacucaaaaccacuuaaaaacuaagauagauuuuaaaaucugaaaguuccacaauccaauaauagaugccaggggagauguauggcaugacggguccuuggagaggugcccuccccucuggauggcuggugcugucuacugguauugccaccccucagugggcagaugcugaggcuucugugggagggaccacgacuguuucucucguaucccuggcaccugcacagaacccagucccaacaaacaccugauaaguguguuccaggauggugcuuacacccucgggccagcagcagcuggugucagggcugggguagaagucagccagcaaaaaaggccaguccaacacagcagguuaaggcgccuaaucuggccuucccugccacuucuccugggccucucccugcugguuccuguccccagcgccccucccccugggaggcucaccugaacugccugucuggagccugguguuuucauccuucagugccgcugccccaugcucacaguagguucuacugugcucagucaggagguucucagaacagccccuuucccuaucauuuuaaaaaauguuucacuaaagaauuacaggcauuuaaaaaauggcacguggccaggugcaguggcuuacaccugcaaucccagcacuuugggaggccgaggcagucagaucacuugagaucaggaguucaagaccagccuggccaacauggugaaaccccaucucuacuaaaaauacaaaaaugagcugggugugguggcgcacaccuguagucccagcuccucaggaggcugaggcaggaggaucaccugagcccagggagguggaggcugcagugagccauaauugcgccacugcacuccaucccggaugacagagugagacccuguauauauguauguaugcguaaauuaguuaacuaauuaauugauugccaggccuggugguguguaccuguagucccagcuacuugcagggcugaggugggagaauugcgugagcccaggaggucgaggcugcagugagccaucauugcaacacugcacuccagccugggugacagugagaaccuguuuuuuuaaaaaaaaaaagccaagcacgguggcucacgccuguaaucccagcacuuugggaggccuaggucaggaguucgagacaauccuggccaauauggugaaacccugucucuacuaaaaauacaaaaaucagcugggcaugguagcacgugccuguagucucagcuacgcaggaggcuggggcaggagaacugcuugaaccugggagugggaggcagagguugcagugagccgagauuacaccauugcauuccagccugggcauggaagcaagacuccgccccaccccaccccacccccccaaaaaggugcauaucacaaguguacagcuugaugaauuguccucgagggaauacacacauuuaaccagcaccagauggugaaacuggacagcucgucucagaagcccugccuguguuccucuccauccccgaggguaaccgcuauuauucugacugagaagauucgggguugugucuguugugggauuucauaucaauggcaucacaccgucgugacucuugggucuggcuucccucacucagcuuugcuuuguguaacucauccuucucguggugugcggucgcagacuguucgcccccauuacaguggaggacucuauugugugcacaugccacuauguauuuguccauucugcugcugaugggcauuugggcggcuuccaguuuagggccauugugaauagggcuuccgugaccaucgcagucccugucuuugggaaacugauguguacgcacuucaaacacaucuguggcaaggcugcacagggcccacuguggcccugcagaguacaggagggagaugaaccaggagaccagcuccuggccccuccccugugcucugacuuaguugggaggaugaccccccuacccccaggcagacccucaggcuguuucuguaugggcugccccacuccguugugugucccagacccauucucugaccgagcuucccauccccaaggccuggcagggaaggaguggcaggggcagaagugcucugcggggagccagccucauccuccaucaugcccuggcacagcagcuaguggggcucaguuuccucauaaugcagggagcacaggguucaaugaccucuacagucucaccugaugaaaaucaggcccagaguuggugacacugcauccuccagguggaggucagagggcggaaccccaccccuacccccuaacaggacccagcgccucagcaggaagcuucuagauacauucuuuggaaugacucaugacuauaauucuguggcugaaggcagagagguaacaggagagccuggaauucaaucgacggugccacccaagauuccugcgucgccacucccuggggcucagcccaccccugcccgcucugguuccucucccucucaacugcuccccacuccccauccugcuccccacucccgcucccacuguuguugcuguugcuaacaagagaggcguccccaugccgagccccuggagcuuuguacguggugucaggcuuugucuagggaccaccagccugcccagagaaggggauggguucuuccugagcuggaaagagcagacuaaccuccuuaaaacaauacccuccccaggggccuccuaaucccuuccccugcagcagaccaugugaauccugaucugucuuccugggccuugugcccagggacagccaacacaccagccagcuggcaggcgaggacggggacagggcugaugccuggaugccuucgcuaaccucgccugcccaagaugggcucccaaacaagucaccaccacaggacagcacccgggggagguggcagaguggccacucgcccugccuuuaaggucaguuuaaaugaccacauccaagaugugaugcagccuccacagaaaaagugagcucugcaaauggagaccuggaugucugugugagccggggaccucuuuggaccuugguuuccucaucugucgagggagacauaucuaucuuggaacaaaaugaacauauuuuuuagaauguauaagcucuuuuuuuugagacagggucuugcccugucacccaggcugcagugcaguauugugaucucggcuuacugcaaccuccgccucccggguucaagugacuguccagucucagucuccuggguagcugggauuacaggcacgcaccaccacgcucagcucauuuuuguauuuuuaguagacauggggugucgccacguuggccaggcuggucuugaaguccugaccucgugaucagccucccaaagugcugggauuacaggcgugagccaccacgcccaguccccgaaauguaaaaacuuugaggaaaauguuuaaauauuccaaaucuacaguauccuuacugagggcggggcuggaagaaggggcagccaggcucagccagccuugccgacccccugcugugagcaggagacaggaacguccgugcccagucugggugcugcauguguccugguacacucggggcagcucugagaccacgggguagagggguggacaugcugccucacucacaugcuggaacuuucuguaaauccaccuauuaaaugacaccuccuaagagcaguuuauccucaugacuguaaacuuaauacugggcaaauacugaggucuuagcauauuggccagacucugcgccacguucuuccugcauaugaucucauuugugucuccagcacccucugaggacacaccuuuaguaccuuuuaauuuuuaaucuuuuuagagacagggucuugcucugucacccagauuggagugcgguggcgcgaucacggcucacugcagcuucaaccuccuccugggcucagaugauccucccaccucagccugccauguagcugggaccacaggugugcaccaccacacccagcuauguuuuugauuauuuuguagagauacggucucacucuguugcccaaacuagccuugaacuccugagcucaagugauccuccugccucagacucccaaaguauugagauuacaggagugagccacagugucuggccuauuauguaccucguucagaaaaggagagacagacuagcccagggaaggccccaccccaggucagagagccagauucuaacccaacugucucggggaugaguguucuacccugcccccgccccccaauacccaucacacugggucugcaccgacccgcacccuucgcaccgacccucacccuucucaacuggcccugucccugcucccaggagcaccugcaaccuguccccaggcacacacacacuuccagagccaaagcgcccggacauuuggcacacaacucuuccccuagcaguaaguucaaaaacaaccuugguaaauauuuuucugagggagcacguugucuuucccacgccaccuccggccuccugcagccgugaaaauaaccagauguguauggguuucucaguggccucuggaaaccuccaccagggccgagucuccacuccuggccuaaaacaaacaagggccccgagccagagggaagucccgcaugcauggcugugggauagucaccucugaaacggagagugccucugggaagagagggagaaaguucugugaaauggagccugugaauuucccagggaaugaucugcuuccgucugguggacacugaagguuaaggcagcaaguucagcucuccaaauuucuauccucuuuguguucuguccuggcgagaauucuccccuuccaggaauaacaccuguguccuucuugcugcagaguaauucacagcagggcacguuccccaggcaaaaucccagacuaaauccgugcaugcugggguuggagcaggagcaggagcuaaggcucucugauggucacccgcuuacucugcaaagcagggcaaauaaagcuaaaacuaucaccuaucucucuccuuggcccaggagguggaagaaaaagcaugguuaccucccacagagcacacgauccgaauuucuuuggugguuuuugacaguggagccuguaucuuuuggacaguagggaguggaguggaagugggguugggggugacuugggggugggaagguguugcuuaaaaagaacaaacaggccaggcgcaguggcucacaccuguaaucccagcacuuugggaggccgaggcggguggaucacgaggucaggaguucaagaccagccugguuaacauggugaaaccccaucucuacuaaaaauacaaaaauuagccgggcuugguggugggcgucucuaaucccgcuccucggaaggcugaggcagauaauugcucgaaccugggaggcggagguugcagugagccacugcacuccagccugggcaacagagcgagacuccgucucaaaaaaaaaaaaaaaagacaaacaaaccaaguaaguggauaucauuaaacaauugaggacuggcucccuuguccccugccagggccugcagggaaaguuaaaggccauguuccuuuuaaacaaagccaagucaucauggcccucccuguguuugagacgcuagaguucgucaaggaagcccgguuuccuaugggcaccgccuagggaagugaaucaagaaucucagggccagccccaguuggagccagguguccaaacagcugaacauucauccccuaaaaguaguuucaugacaucagagaggggggacagaggcaugacugaguacaugccucaaugacauacacacacacucaugcgcacagcugugaacucacagcucuucuuuuuccaagaaacugggagcaaaauauuucccucugaaguuuugcaggucaggaaaggggucagguuugcuuagaucacacaagauugauucugaagucagacuuggggcuccaaaagggguggaggaaaggaaggcaccgucucuugcccccuggcccucaaggcuccaugccccguucucucucugcccucucucucugcccagucuggcuacccugcaaggugggugcagaggcccagaugucuaggccaaguuuauuuggccacucccaugcccagaacaagaaaagaaggcuaauucaaaguggaagggaggcuggcugcggugacucacgccuguaaucccagcacuuugggaggcugaggcaugaggaucacuugagcccaggaguucaagaccagccugggcaauauaacgacaccucaccucuacaaauaauuuuuaaaauuagcaaggcaugguggugcaugccuguggucccagcuacacaggaagcugaggcaggaggaucgcuucagccuaggaggucaaggcugcaguaagccauguuugugccacuguacuccagccugggugacagagggagacccugucucaacgacgacaacagcaauaacagcaacaaauaaaguggaaaggggguaccuggagccucaagacgugacucuagguaaaaucaccagcauccuccgccuuggauuucucgucuggaaagcauguacagcgccaguuagagccucccucccucuagagcauggcaguagugcagcuucuagggagaggcagagccaggaucacaggauccagagauccugguccgaggagcugucaccuuucuuguuuucccuuacagccuggucuuugcuggcacaaggucuagagaugcagagcacgaggagcugaugccaccccucgggcuggacgcaggggccagggacaggcuggggcugaguucacggugcucugugaccagaggcugggauguucucugcuuuucuuuuuugucaucaguucagccaaauguauguuuugaagccacaguuuucuacuuuuuaaacuuauuauuuucauauuuauuuaaagauagggucuuguuaugucauccaugcuggaguacaguggcacaaucauagcucacuacagccucucaaacuucuaggcuuagcaaguaguacccaccucagccucccagguagcuggaauuacagguccauaccaccaugcuugacuaauuuuuaaacuguauguagagauagggccucacuauguugcccaggcuggucuugaacuccuggcuucaaacgauccuccugccucggccucccaaagugcugggauuauaggugugaaccacagugccaggccaucccuuguccccugcucuuuaaaagccaugcaggcaucacauuccuccgcaucccagagucauaauguuacagcuagaggaagccuagaugucaugugaucucagcccaacaaguagagacgagcaagcagucagaggaccaggcaccaccacgccuucuuuggcaucuaagaaccauguagucccacuccuagugcagcucuccaauccuguggggucugagugcccacauauaccuggcuccaggugcugcaccccucuugguuguuggacaggggaaagggaggcaucugaccugcagugagaugaagaaagggccgaggccagcaaaacacgaagagcccccaggacacuacaggacauguguccaugccccccuucacauuacccaggaauccguggugucacugccuguccccagaagccaaaugcaugagaacagcccccuccagccauucccaauggcugagaacauccacacuguccagcuggguucccucugcauaugcagccacacacacccaucagucccaugaugccagcaguccuggggccgaaaucacccagcuuuagaccaugggaaauacuaaacaggaaggccccugagagccacugggccagcuccucauucacagaugaggaaacugaggccugcagggaggacacuggguugugagugucuggacagaggaucuguuucuuuugcaaacccacuccucagcucaacacccaacucagauggacccugcugguuuucuucacugugccugccaccagcccuguguacauguggcgcacccacacaaauacccagcgcuuagccaacaggagaccccagggccaguuauagcuggcacauggacaugauugcccuagagugccuguggcauucagagaugugauucugugucaacaggaccagacuuccagauucauccagggcuguaaagccagagaauuucccugcccaaguguaauccccauaggaugccgugggugaacgaaaggccaggacggcucccacccugcccuuccccagaagccgauccacagcacaagcucucuagaaccccagccauggagaagcaaaacccaggaugaccucaggaugagaagcaacuuuuugggcggugcucucagggccuccagaucagggaggcgugggcaggaguuaggacagcacaggccuggggagggagcagcagggccuccgcacgcacgcccuguacuacgcacgcacgcccuguacuacgcuuggcagugcccccggggcaggaugcaggacugcaucuggcugaacaaugggcaccccuccucauugucccaccugcgaguagugccuuaggugcuagcugcagcuggaaaagcacaugcaagcugguggcuuaacaaacaagcacacuacccccucaaccaccaacucccaggaacaaugacagcaugaagguggaugagacccaugcacucagcaggcccuguuuauccagaacugucugugagccacuaugacagugcuggcuaccagaacauccuggaauccccuucuccaagcuccuggggcaggaugacaggaugacgggacucaggaucuaaaacagcaccgugaugcugucagggucaaggacucaaaaagcagcagggggcagaggcacaacaggaaagagccagccacaggcaaccggcaaacaaugucugcccccaucugggcagaaagaucaaacaucaaaaacacacacuuccauaauucuuuuaacagagccucccacuucuggcugagaagcaacaccacugcaaacacucuugaggggccaccagccuggaauguaacuuguucccaauggacucuggggcaagcagccuucaaacuggcugcgaccugccauguuguuuccuauaaauccccuaaggucagagggcccucuucauuucagcuagacacaugugaguguguuguuauagcuaacgcuuuuccagcuuggucuuuacgcaggacugucuggguuuuaguacucuaagucccacaucccaggauaaccuguuuauacuggguaaucugggacaguuggucacucuaucuucacaucaguauuucccccaaaauguccuggggaaacaugaguguuucacaagauguuaaacacucucguucuacuaaagagaggaagcuguuccucucgauguucuacuaaaucuagaucgauguucuacuaaaaagaggaggcugaaaaggaaauggucccauaguuaaaguacguuuggggaaugauggguuaaacaaagguaauaaguaaucuuccuuagaggauauuucaaagcauguaagaucauaauguauuuugaccuucuaagaagggaaauguauucauuuuauuaaauauucauugagagcauaacuauuaaaaucuugaggauuacgaaauguucuuacuggacacaguuuggaacacagcuugcuuuauggaauauaaaaguaaaauaaaaaaccucauauggugcuagcccagacuuaccauguggguaaacugaggcacagagcaaugcccccaaggcagaucugugaguacuuccuaccuucccuuccuaucuuccucccacuuuucggccuugugaggaaauauuccuuucucuaguuguuggacuguagcuccaugcaccucccccaugcccucccuuuccugagaaggaaaauggagagcuggccauagaaagaucaacaucgugucacugccugcuucacugccuggcucgauggcaucaagaggaauuuggugcaagagaggggguaggcucaggguuggaugaucugagaaaggaaagugaaagggagacugggaucccagggcuaggagggaguguacagugggcguguccaggagcugauuacccaaucacaagcgccauuuauccagguagaaagagagccaagagguggaagacugcauuuaaccacguuaugggcuaaccaccuagggggcugccaggaucggggugcagguggcuucagaaagccuguuuugggccgggcgcuguggcucacgucuguaauuccagcacuuugggaggcugaggcgggcggaucacuugaggccgggaauucaagaccagccuggccaacauggggaaaccccaucucuacuaaaaaucccaaaaucagcugggcuugggggcaggugccuguaaucccaacuaugggggaagccgaggugagaggaucgcuugaacuccugaggcggagguugcagugagucgagaucgugccacugcacuccagccugggcaacacagugaggcccugucucaaaaaaaaaaaaaaaaaaaaaaaaaaagucuguuuugacucaaagccccaaagugaagggcagugcccccuaggggugagcugaggagcaccaggcaggaauaggaaggcagggggcgccaucucaguggcuucuuagcuaagcccacccuggccaccuucaucuaaaacugcggucuccaacuaacccugccuccccgcacugaggcccccagccugaguaauggggaagggccuugaagaagaaaaccuggcccugugaggucgcagaggaugcugcucuagcauggcguugggggugggguaacagggucuguugacucacacugggcuagggcugacgccaauacaagaaauaaaaucaacaugccaggugcggguggcucacaucuguaauccuaucacuuugggaggcugauuaggcggaucaccugagguugggaguucaagaccagccugaccaacaaggagaaaccccgucucuacuaaaaauacaaacuuaggugggcgugguggugcaugccuguaauuccagcuaccccagaggcuggggcaggagaaucacuugaacccgggaggcggagguaguggugacccaagauugcgccauugcacuccagccuggacaaacaagagugaaacuccgucucaaaaaaaaaaaaaaaaaaaaaaaaucaacacguguggaugcuuucugcacaucagaggcaccaccuacaugauccuauuuagcccuugcuauggaggagggcacaauaccuauuuucccgcuggagaagcccaggucaaggaacaagucugagaucacaaggcuaacaagugucgaagcuguggcuaaaauccaagccucuuaacugcagagucuagggcaucagcagagauuuccauuuuucuucucuucaccaucacagcaaaauuuuuugucaaaggaauucuuacguagagaccuaucauacggaacaguuaaaaguaggccuucgugaagaggauggacguaaaacuccccccaaaucggccuccucuuaauuuuccucuccagguaugcaccccaagcccucaguggcccccaaggcagcuccacggaauaccacccgcagguuucaaagucacuggcccccggcugcugcugucacugagagcucauagccaaaccccuaagacaguauuuccuuggcccugcacucaccugcucugaggugagagggagagauggggagcagaaacacuucuucccuauccacaggccagugggggaacccagguccuuccccuccuacccugcccaaggcccagcuuauggggguccugggacaccucggaucccuguugcagcucaagacccaauuaggaaggagccagguuucuuugugcauuaccagaaacugccccucaggaccagaaggcuacagccacauaacuggaggacuaagugggaccaggcuuccugagagcuguguuuccugagagcugugugcagaggcgaagcugaucugaccggcaaggugaggacagagggcagcuacagagacguccaagguuugcagggaccaguucugcaguagcauuugccagucaccuacuccaaauauccacucucugcuuccuccuuguaacugaaccacuguuuuuuggguaggcacuugggugccugaaauaaaaauuacucuucccuaaguucucuuuccugccugccuuucagcuagugugaccacaugcuaaguucuguucaacaaaaugugacuagaagugucacaugugguuucugggaggcacacucuaaagaggagccacaugcuucuuguuccuuccuuuuuccugauggcuggaacuccagcagccaccuuggaccacgaggccacgugugaaugauggcagaaccacuauaccaccccucugaaguucuaugauaugagagagauauaacugaugccugucuuauuuaauccacuacucuuuuuuguugcuaugagcagccaaaucaaguucuaacaaacacaagccccaauccucagcugaaggauccuuuggguggggacagcacaggagacauggcccccuccugcuuccuaccaggaaucccugcuccuuccugcccauaugcccccaggaccuaggccggcccccaccugccaccucuuucuugaaucagguagccuugcauuuacagagcacaggcuggcaggcaaguucuaagccagcccugacaccuacucacuuacuaacucauucauucaaccuauauuuauggaacagcuacuuugagcuaagugcuauucuaggugcuguggcuacagcacaauggaagucccugcccucauggaacuuacagucuaacggggaagagacagacaaacaaacaaaccaaugaacacauaucaggugacgagugcuauggagaaaauaaaggcgaguaggaggaaaagagugugcugggggggagggguuucuaagcagagcagccccgguaggccucuuugagaaaguggcauucauggggagagcugaaggaagugagggagugaaccacguacauauugggagaagagcugguuguaugaucuacugcaaguccuugcaucugugccucaguuucuccucucuggaauggucugugagauaaaggucaugcaaaggcaggcuaccccagcuggagggcucugugguuccaaucaguguguugggaguagguuggcaugggaaccuggcuggauggagaccaaagggacucaguccucaggcagagcuccaugaauuucagguaagaaggagcuguggcuucagccucacacacagccaguauguucaaaaauuacagagugcccuccucaccggcuugcuuaacugccgucccuucuacucugaucagggucagguagcuggaagguuaagaaaucagacagcguagaccccaggucaguccacacaucccuaggggccuggcucugggaggucccugcaccccaauccagggccagauagcaagccucucucagccgcuccuuagaauucucuucccccugaguggaggcacauacauagccuucuggccaugacaauugguggacgaggugccacccuacacccugguccucggaagugugagguggcuuauucccaaggggaauaaggcuacaaaagaagagagggugguggugauauaugucggggaaggggguggggaugguuggagguggcccaggggccaaccuuagcugggggacccucuuagcugagggucugugcuugcugcugcuccagcgauucagggcagggccaggacucagagacaaugcaagagcuugggaugcgggagaugugggcaagggccacugaugaaucugcagcugaacgcugcauuuugugcagccaauuaucccgcaaacauuucuuaaccaccuauuuggcuagaggcuguggaaaugacaggggguccucagccagugggccaguggcaaacaccgacauauuuaggcacaaugcaugguggccagugcuauggcacaguauuccaggcacccuuaggagucuaacucuuaaauagcaacauggccccaagccucaauuuacccuuaugguagagggguagggaaagagaugugggcacaguauagguuugucaccauccuaaaguccuuuuuaaagagguuuuucgccaggcaugauggcucaugccuguaauccuagcacugggaggcugaggugggcagaucacucaagguuaggcguucaagaccagccuggccaacauggugagacccuauuucuacagaaauuagcugggugugguggcgcaugccuguagucccagcuacucaggaggcugaggcaggaggaugucuugaaucugggaggcagagguugcagcaagccaccugcacuccacccuuggcaacacagcgagauuccaucucagaacaaaaagaaguaaaauaaaaaaauauauaaaggggauuuggugaguuuuuccaauucccaggagggaaucagcacugaaagggcugaguucuauucugguauuuacagcugacacguaugcgcacaugcacacacauacaugcacgcacacacacacacacgcacacacacgugugcacacccaccuccuggaaagcuauuuauugagagucacugggaacuugggcgaaugaacccaccucccuggccugcaaucccccauuugaaacaagcagguuguaguagaugauuuccagaaggcuccccagcucuagaauucuguguccuaugauuuucuggcucauuuagaagugguguggaaaguacccuuugccaaccgaauuccacauugcacagccugcaggcugccgacucgaagcagucauauggcaaauguuacugcaaauaugaagaggcuccuuuaagggauccucugugucaauuuucuugaaggcuuuucuuauagagaaugcccccgucauuuggccugugcaggguaggagucaccaucccagaucugcuacaucacuugauuucuuaacagccccauagagcagacaggauacaugauaaagagaggcccauccaacuuagcccauguuccuggguccgggacaggaaaccccaccagcugagcucccugcccugcuucauggccagugggugcaaauaggaaaugagcccagagcuggguaaagagcuccuggcugagguccagugaaaguguccaggcaggcucaggcugguggguagggaugggcagggcaaugccauucucuuucucugauuauguaggaaugacuuccauuucagcuagagcaaagcuugcauucagcagcccugaagagggccucugccucaaagggugugaagaagcagcacuuccuggaauaggggucaucuacguccccuccugagaaguccagugaacuggagacacgauuccucccacuucccuuaagagugaagggcucugagcugggugcgguggcucaugccugugaucccagcacuuugggaggcugaggcgggcggaucaugaggucaggagaucgagaccuuccuggcuaacauggugaauccccgucccuacuaaaaaauacagaaaauuagccgggcguggaggugggcgccuguaguccuagcuauucgggaggcugaggcaggagaauggcgugaacccgggagguggagcuuguagugagcugagaucacgccacugcaguccagccugggugacagaacgagacuccaucucaaaaaaaaaaaaaacagugaagggcucugagcuaagugcugagccagcuccacagcagccaccagcaucacaggggucaccagccccacagaagccuuaaccuucagcaguugcucccaccagcucuagcugcuggagaacaagcccacuggccagacaucccuucccaggaugcaaacuccccuuccagggagccuaaagccagggcugaagccgguuccccucaguucuacaguccagaguaucccaagcgaccgcucagcgcugggugcugggcugggcccuggagguggugauaaguauguuguuggccccucgagggccucaccgcaugguggaggagacacacagaucauggaacacacuuugguucucccuaggaaaccagggaaggcaucucagagaugaugccugaggguggcuaggaguggcucuuccccucccucccugcaagggggggaauucuaaccacagggagucuaguccccuuccccucucagcuuuccacagggcagugguguuaaaaccccaggcagcacccuccucuccuuucaaacauggguuccugaggaaaaccagaugggggacagccuccaugccucuucccccaccuucucuaggccugggggacacccugaggacccuccugggcaggccacgcuccccuccucagcccuucucuggacgaccacacuccaaagcucuggccacacugacaccaggugcuuuugggucugcccuugaauggcugggcuccuaaccccgccauguccagcucgcuccugccucagauccugucccaagcugcaccaugcugggaacacccacauucccccaccccagcccugggcaccuuguuuuuuuccuugagucagggucucccucuguugcccaggcuggagagcaguggcgugaucuuggcucacugcaaccucugucucccacguucaagcaauucuccuaccucagucuccugaguagcugggacuacaggcgugugccacuaccaugcccagcuaauuuuuuugucuuuuuaguacagucuuacuagguugcccaggcuggucuugaacuccuaggcucaagugauccucccaccuuggccucucaaauuugcugggauuccaggcgugagcagccacacccugccaccguggaauuuucucuccaguucugagagcuaaucuccccaaagccucaaugacuccaucucaagaaccaccaucacagacuccccgacccuaaucugcaucuccccuacacacuacaauucauagagccucagccacauuaggaaacacugacccuuuuaauuuuaaaaucccuaugugaaaaccccaccuccuucaggaagcuuucuccagaccuccagaccaccccuuccaaaucuuauacucuuuuccauaugccucccucucccacagaguggcacuggggcuucaguuuuuauuaucauauauccacugauacccacaaacauuggcaggaucccaaugccuggggucccuuaaacccaccaggugcucaauauauaugcuuacuaaucaucauagcuauuuuuugaguguugauccugaguugggcguaaagccaagcccaugauauauauacucgcucaucuucauagcaacccacaagguagggcuguuauuacuuuauagaugaagaaacugagguucagggagguccacuauuuuguccauggucaugcacaucucucugacccaaagucugaguguuuccaccccaccaagcugccuuucuguugcccagaauucauccauugaacaucagauugagaguacugaaucagcuuguccuuucaguagcugagggaacacggaaccccagauaucuuaucaugguggaacuagaggucccuuugguucuuuuauucuaucucacaaauaacgaaacggaggcacggagaugugacuuaccauugugguucugccagaugguuaucaaaccaaaaagcacugaaagggggucugaugaauuguccaacccuuaaggugaaugcuuucuuugcuguaggcugcauaaucugcccauauauuggaagguaagcugggggagaggggcagggauggaccugucuggggauaauuccuuuguugcagagacucgagcuauaaaucuuucuugcuuugaaucaaaucacaggauuccagcagauggggggcaguguuuaugcuauucccgaugacagcagcccaggcgaccacaccuucagaaggacagggauggagcuggccuuacugagucccuagagggugguguagaaugcaccauagcuacugaacagaccaaucuugccgcaacaugccccccacaagccuuuucuggccucaauacaugcaaaucaucaucaccaucaugaucaucauccucuccccaucccccacuuagcacuuugcacuuuucuaagugcuucccaacagugcugcauacuauaaugcauacagugcucagauaggccaaguuacuugcugguuagagcaggcacuggguuauggucauuuuuguuugccacauaccaaacuucugccaugugccaaacccuguguuaggccagaaguggugcuucauggaagagacaugguuucuggcagugcccaggugccaggaaaaacagugccauccuugaagccagcagugagcuggagucagagcuuugcccacuggugacuuaugaacauuuccuuuuagggcagacagggagggucuugucccacagugccucccacuccucaaaggaaggguggcucagcuuccuuaagcucagaagcacuagggacuaaccccucuuuccugacacagcccaacgcccuucugggugguucuaagaggcuucccaacaaaagguucguaugaaggcccacccugaaguccagcuguccccagaguagggcuaaggagccaccauacucucgugucaucucaacccugcaugucguguggcucuucagugauugccacucugaaagcuguucugacuguuccucacacugcagccccucuuccagggacacacauucuuccccccgccgggaccuucccuuucuagucaggcugguggagucucccgccggccacaggaggaugcccacgccugccugcucccugagugccagcgccugcccacuaccaaagguuuccugcggugcagaggagagacuguacugcccuuccaucuccccuggccccuuagaguccagucccaaacugccggcaccugcucacagcagaaucccuacccugucugugcuguccccgcaguccuccuggcccuagggugaucacaccaccucagcucuuccugcagacaugugcucaggugggcaaaagagaaugagaaaugcaccucucccguggggcugagcugacucuggcuguucccuaggggcuuaagaacaccuguucugguugaguuugcagccaucgccugucccccaaaagggaaagaguaacauuucaccuugaaaagaaacagggaggggauguuucugaggugcagguguuucaugagagacagguacauuuucuaaggugugucuaaaaugcagcccaauccuauucuacgagagagaaguucccguuugaacaaguucccguuugaacaagaggauucgaggggggucucaccaucguagccacgcacuaagaagcgauuguuuuagggacacggagguaggacccccacucagccaggugacucugggacuguggaagguccacuuacgacucuguaccugccccagcacgggcucaaggaguugagccugcacacauuacuuagaaaaaaccucugcaaacggguaaguacaucgcccgcgugggccguggcuggaggcuugucaccugcuucagggacuuccucgggagccucucgccugccucuuugccuggaauuaacgaauacacacuacagccccucauucccuccaacacgaaggaaagguguaaucagaucccgagagucccgcagaagcguggagccucgcggugcggucucccuuuucuuucccaugcaaacccacuuagcaccggcgcgccccuguuugcccgggcagaauccaccgcccacuccucccgaguggagaguggagacgaaucuacgcccaggcccugcaccugccgcgcugcggaguuuggagggggcguggauggugcaaggucagggcuccgugugugaccccggcggugauagggcugcucggggucggaccacgcggcgcgccgggcuucccugcagcucggccgggcagggggcacaugggcacggugggagucccggcggaacccaggccggccacucaccauucugggagggcgacggcgacggcgacggcgacgacggcagcagcggcggcguugacaacaguagcagcagcgccgagagcgccagcgcgcagcgcaucgugucgucgccucugggccgggagcagguggcugcggugccggcggaggauccgcgcguccgggcgguaggagcgugggcgccgcccggggaggccuguggguggcuccggaggccaggcuguggcccggggcucccgagucgcgcugcggcggcucuuccucccugccgcugcagcagagccgggcuggggcgcagagccaguggcagaggagcggcggcggcggcggcugcguccugggcggcgucugcgcggcugcggccccacuggcggcugcggcuacuccuggcccgucccgucagcgccggcccccgcccccgcccccgccccucccccucccccaggagcccgccagcggcggcggccgggccgggcggggccggg

SEQ ID NO: 14576 - RNA, 3462 nt, Homo sapiens
uaaauauuccgccucuccucucucaacauuaaaaaaaauuucagaggaagaacaagucuuccauuugucaccggcuccucgguccggagcagaggaugcauuuugcuaucgcuuguggcgacuuggagacagggaugaggaauggguuuguuuccuccaaucaguuuacucgugcuuggaagggccauuugugcccuugacccugguguggccauagccuuggggaagggcaggacaggaggaggggagcucugggcaaugguuagggcagaggcaguaggagaucagacaagaacagggagaaucugggagaugccagauagaaguuuggggaagcugacuugagaugaucugucccuagggaggacgaggguuccaucaucaaaagaaggaguccaacuccagccuguugcacacccaggguguguggcuuuuucuuuuuuuuuuuuugagauggaaucucacucugucacccaggcugcagugcaguggugugaucuuggcuuacugcaaccucuaccuccuggguucaagcgauucuccugcuucagccuccagaguagcugggauuacaggcauccaccaccaugcccggcuaauuuuuguauuuuuauuagagacgggguuucgccauguuggccaggcugcucuggaacuccugacuucaggugauccaccugcauuggccuccccgugagccacugugcccggcuguggcugcuuuuaucuauggaccuuggcucuucccggacacuuggaaagcaacaggagcacaagguuaaaugaucaaccauccgaacuccagccuugcugugggggcuagcccagcaucucagcauccuaggggcugucuagcugcuacgcuggggcgggaccucugugcucuacaauacuuacguuuucucagaccucugcuuaucucuacuuaaugugccuuccagucuguuauggagaauacagaccacuguuagacccagccucuccccgcccacaccugccugucaccaggcaacagguugggucuggcucuggggguagaggaaguuuuugucagaacaaauucucaugcucuggggccaccacaggggcccagaaacacuuguucaauaucacacaucagagcagaggcagacauuaugcugggugcagcccagcaccugguugugccacuguaguugagggauaccagcuccuugggcuuccaugaucucacuggaaaaacagaaggaacccuaccugcccugccccugccuuucagggucgucuggaagagcugugauguucagugaacaugaacgugcucuguaaccugggaagggcagugcagauggcaggggcguguauacacuuacucuucaggcuggcuugcgagcucccaucucucacccuccucccccugcucuccuuuucugugcugcccguucccucucugcaaacugggaguuauucuggccgcagccaguuccacguccccacugagggccgcaccccugaauguucccuguuguaaagcuguguggaggaagggaggaggccuuucugcguauucugucuugucaucagcccgcgguguuccagaagcugccagcagggggcaguagcaccgcaucccugggacccucccggcgcuucccggccacggcccugggcuccgaugaggccaccucugugagugggugugugccugccggucgcaggucgagaaugucuuaaugacuugugccgcgugugcgcgcucgaugagcagagggccugaugcggcagggccaccgugggggccaggccuggaaacacgugcugauuuccuuugggcagcagggguugagagggggaguuguccuggugacgcuaauggggaggccaagguggccuucaggggcugcuuguguaacacacggugggggggaccguggguguggcucagaugaacgcagaggaugggauggauuccacuggccagguccucuaggguauccugcugagcccggguaguaacaaugacaagggcacacccacccagcgggccuugaggcaggcucucagccuccacccaggccccucuugaccuugcauggaccagaggggcuguccucugugcccccaccauugucucuucagcccccuccgaccgcacucaaacuccugacaugaaccccggcucccagcugcucuagcuuuuggaagccccugcacugggcucagccauuuccccuuucuggauuccugggccccucaggacauggcugucagcgccacugaauugagacuggaggcaggugccagguuccacucauagugauggguccugccacucagcaucuggcagcauugcaggaugauguugcaggacggugccugcaaccacaaagggcuuggcccagggucucuagggacuugcaaccccuugaggaaagaucaacucaccugcaucuagaguuucuguuauuguuuuuugccuagagggaguuuuugagggggggccucaaggugggguggagccccucagcaccauuguccucucugccaucugaaacaauggccagcccuguccugugccuuggaggucacccugcuuuccugggugaugcagggccucucucgcaagcucccucuccccagaaagcagggauugaacacaguauuugcucgcaccugagaaguacuccaugcugcagaagauccuguggugaggaugucaggguucuguucucugcacuccugagcuuuccaggcguacuguuauuuaauuauucauucugcaguguucauucauucacucacugguuuaucacacauuaucgagccucuacuacauaccagguguguauucucucucccucaguuagggaggggguguuucugggcucuaggaauagucucacuccucccucccauuuuauuauuuauuuauuauguuuggagauggaguuucacucugucacccaggcuggagugccaucucggcucaccccaaccucugccuuccagguucaagugauucuccugccucagccucccgaguagcagguauuacaggugcccaccacaaugccuggcuaauauuuuuuuguauuuuuaguuagagacgggguuucaccauguuggccaggcuggucuugaaccuccugacuucagguaaucugcccgccuuggccucccaaaaugcugggauuacaggugugagccaccgcacccagccccuccucccuccuaaagagaaccauugguggguccacauguggggacagacaggggagaguacgauggagccagaggacagaggaccagcacugggggccgaguggggcauguggcaaagcagaacugacugggagcagagcuguggcagagcuggggaagaagagggcagagcuggacagagggcgggacagauugggggaagagacaagguggauggggcaggccagauccaggagaagggaugggacagauccagagagg

SEQ ID NO: 14577 - RNA, 3462 nt, Homo sapiens
ccucucuggaucugucccaucccuucuccuggaucuggccugccccauccaccuugucucuucccccaaucugucccgcccucuguccagcucugcccucuucuuccccagcucugccacagcucugcucccagucaguucugcuuugccacaugccccacucggcccccagugcugguccucuguccucuggcuccaucguacucuccccugucuguccccacauguggacccaccaaugguucucuuuaggagggaggaggggcugggugcgguggcucacaccuguaaucccagcauuuugggaggccaaggcgggcagauuaccugaagucaggagguucaagaccagccuggccaacauggugaaaccccgucucuaacuaaaaauacaaaaaaauauuagccaggcauuguggugggcaccuguaauaccugcuacucgggaggcugaggcaggagaaucacuugaaccuggaaggcagagguuggggugagccgagauggcacuccagccugggugacagagugaaacuccaucuccaaacauaauaaauaaauaauaaaaugggagggaggagugagacuauuccuagagcccagaaacacccccucccuaacugagggagagagaauacacaccugguauguaguagaggcucgauaaugugugauaaaccagugagugaaugaaugaacacugcagaaugaauaauuaaauaacaguacgccuggaaagcucaggagugcagagaacagaacccugacauccucaccacaggaucuucugcagcauggaguacuucucaggugcgagcaaauacuguguucaaucccugcuuucuggggagagggagcuugcgagagaggcccugcaucacccaggaaagcagggugaccuccaaggcacaggacagggcuggccauuguuucagauggcagagaggacaauggugcugaggggcuccaccccaccuugaggcccccccucaaaaacucccucuaggcaaaaaacaauaacagaaacucuagaugcaggugaguugaucuuuccucaagggguugcaagucccuagagacccugggccaagcccuuugugguugcaggcaccguccugcaacaucauccugcaaugcugccagaugcugaguggcaggacccaucacuaugaguggaaccuggcaccugccuccagucucaauucaguggcgcugacagccauguccugaggggcccaggaauccagaaaggggaaauggcugagcccagugcaggggcuuccaaaagcuagagcagcugggagccgggguucaugucaggaguuugagugcggucggagggggcugaagagacaauggugggggcacagaggacagccccucugguccaugcaaggucaagaggggccuggguggaggcugagagccugccucaaggcccgcugggugggugugcccuugucauuguuacuacccgggcucagcaggauacccuagaggaccuggccaguggaauccaucccauccucugcguucaucugagccacacccacggucccccccaccguguguuacacaagcagccccugaaggccaccuuggccuccccauuagcgucaccaggacaacucccccucucaaccccugcugcccaaaggaaaucagcacguguuuccaggccuggcccccacgguggcccugccgcaucaggcccucugcucaucgagcgcgcacacgcggcacaagucauuaagacauucucgaccugcgaccggcaggcacacacccacucacagagguggccucaucggagcccagggccguggccgggaagcgccgggagggucccagggaugcggugcuacugcccccugcuggcagcuucuggaacaccgcgggcugaugacaagacagaauacgcagaaaggccuccucccuuccuccacacagcuuuacaacagggaacauucaggggugcggcccucaguggggacguggaacuggcugcggccagaauaacucccaguuugcagagagggaacgggcagcacagaaaaggagagcagggggaggagggugagagaugggagcucgcaagccagccugaagaguaaguguauacacgccccugccaucugcacugcccuucccagguuacagagcacguucauguucacugaacaucacagcucuuccagacgacccugaaaggcaggggcagggcagguaggguuccuucuguuuuuccagugagaucauggaagcccaaggagcugguaucccucaacuacaguggcacaaccaggugcugggcugcacccagcauaaugucugccucugcucugaugugugauauugaacaaguguuucugggccccugugguggccccagagcaugagaauuuguucugacaaaaacuuccucuacccccagagccagacccaaccuguugccuggugacaggcaggugugggcggggagaggcugggucuaacaguggucuguauucuccauaacagacuggaaggcacauuaaguagagauaagcagaggucugagaaaacguaaguauuguagagcacagaggucccgccccagcguagcagcuagacagccccuaggaugcugagaugcugggcuagcccccacagcaaggcuggaguucggaugguugaucauuuaaccuugugcuccuguugcuuuccaaguguccgggaagagccaagguccauagauaaaagcagccacagccgggcacaguggcucacggggaggccaaugcagguggaucaccugaagucaggaguuccagagcagccuggccaacauggcgaaaccccgucucuaauaaaaauacaaaaauuagccgggcauggugguggaugccuguaaucccagcuacucuggaggcugaagcaggagaaucgcuugaacccaggagguagagguugcaguaagccaagaucacaccacugcacugcagccugggugacagagugagauuccaucucaaaaaaaaaaaaagaaaaagccacacacccugggugugcaacaggcuggaguuggacuccuucuuuugaugauggaacccucguccucccuagggacagaucaucucaagucagcuuccccaaacuucuaucuggcaucucccagauucucccuguucuugucugaucuccuacugccucugcccuaaccauugcccagagcuccccuccuccuguccugcccuuccccaaggcuauggccacaccagggucaagggcacaaauggcccuuccaagcacgaguaaacugauuggaggaaacaaacccauuccucaucccugucuccaagucgccacaagcgauagcaaaaugcauccucugcuccggaccgaggagccggugacaaauggaagacuuguucuuccucugaaauuuuuuuuaauguugagagaggagaggcggaauauuua

SEQ ID NO: 14578 - RNA, 7175 nt, Homo sapiens
caguuggugcugcagacucaaagucaagugcucccauagacgccccacucgcugccauagugaagacccccauuugccuccagaggucaagcuuccuuguccaaguuggaaaguagacaagaaaauccucagccacuucccccauuucuuuucucacuugcuccucaucccuucauguuuguauucccaagaucucaggcuucuaagaaagcucaucuuagccuucuaagaaagcucaucaaguugggagugagaccugccauggcuguggucaugucuguccugucacucaggaggagcagaggcuucuccuccuggggacacucugcccucccaggcucucccagacuuccccuacccacuuguuuuacaauagcaguaacuaucgcacaucauccuacucuacuugagucucagaaucagacacaugucugucucuauaaaaugggaacggcgguggaggugggacuuucacagacagaggggauggcagccccuaagaaagaaguacagguggcuucucuuaaugacucuuauucccagcaaagacaaacagugaugccaucauuugcaguuggauucugaggccccgccuaccugggaggcaggacacauuggggaccagccauccuagugugacaaauaauugaguuucauaaugaccuuguagagccagauuccuggaaauggcauaaaccuaccugugauuguugucaaacucuaagaugcuuuguuaccauugcucacuccaggaggggaagccaugguucaugaaguucauuaggugggugguaaacaggauuuugguaguuguugaagguuggggcucaagacccucucuggaggcccaggcuggcugguuaaagacauucugaccucccaacauuagagcaacacaucagaaggcauucgaggcuguggggcuucuagagccagaauucucaggucaucgcccucagcaccagugcuguaggguuccaccugccugcagcuuggggaagaagaaaggcuggcugcccagagucacggccuagcuuggcugggaggaagauagaggagcugucuccucuuccucacuugucuucccugugccugcuccugguccagcugggugagauggaaacuaucucacauggagagauguuaaggcaauucuggcaaagcaagcgcuaauaaagugcugggaacuuccccaucucugccucuugagggaacugagcaugcucugaagggcauggccagguuugccuuugguggaggaaccagaggcuugguuuggucuuggggcaggcugggcaaaaucgcugaguaugaguguuuccuccugagcauccucggggaggggagccccucccuucucuacauccucccccacuggcuccuucauuuccgggcacuuugccuucuuauuucuguucucuccucugaaccagagaaagaaagaugauuaaacgcuucugcuauguggaugcccaugacucacuggcaggaauggccucuccaggcaggcugugcuuucugucuccuucccucauuucacccuccacuuuccccuccccugccuugccccuugcaucaaaaugaagucauguaagaccaauucaaauugauuucucuuuuccuucuauuagaauaucagcuccauaaaaucaggauaagaauuuguggucuggagucugaagacagggauuggaguccuggcuuuucugcccacuaggugugguuuugagugguuauuuaccuuccauaagucuuuguuuauuuggucauaaaauagggaaaaugauagagccagccuuucaggguuauuguggggaucagcggaaauaauauuaagugugaacugguauugucuguaacacauagugcaugccaugagccaggcaccauggggaucagacuggaauucgcuccaguguguaacaggcagauccagugacaaagaaggagagaaauaagccagccuugguaccaucaaaggagcacccagccuucccccugugccccacugagcaaauggcuaauaccacauagcacaggccagggggacagaugccuuuguauggaagagcuaguacugguagccagggaccuggccacacggggaggcacaauugaauuuuucccuuccaucugacaguucaggacuggauguuacuuuccaaaugaaagcgguucuggaaggucguugggaacagugaauugugauuaugcuggcacauuuuuaauucugucucauuacagcugcuguuaaggcugcauuauaauaauugcuuuaguucugcuuugguauuugcaggcuccuuuaauguagcuguaaucuauguguauauuaaaguaagcagagccaaagagcaggggcagccuuauuagacuggagaaaugcauguuggggguggcggugaagcagacaggcagacgggagcaggguccuggcgggggaaccucgggacagcaugcggaguggaaguucuggccucaggcccaaugcagacucacgcugugacuuugagcaaguugaagcugccugucucagcucucccauccauuauaugaguuacaaagucugucuuggaggugcuuaaaaguucuuaggagaaaaaccguuacuggcaaagagcccagggagauggcugcauugggcccucagagcagccagaguggagcccagcaggagccuccucggccgcccacgguggagcagccaggcgaccccucggcaagggacagucaucaaauaaauggcaugcagacacccccaauucccagggaaaauuuggcucuggucuuccugcgaucacucccuguucugguuucuucuuuaaaauucgguuuguuugaacuguugccacucccugcacgguccuguacacacagcauuucagccacuugauggaggucuuacugcuguccuugaauacuauggcucuccuuuuuccccuucaagggcagugggugucaguuucaaggacagaaugcaagggcuguccuggaccagaccacucaccaaguacucacuaugaacggcauucaccuccuagcuguuauuuugggauaggaauucauauugugcucacaccagucauaugagcuaaguagcaguaucaucuccuuuauuuuauuuuaguuuuugagacaaagucuugcucugucacucaagcuggagugcaguggcgugaucucagcucacugcaaccuccaccucccagguucaagcaauucuccugccucauccucccaaauagcugggacugacuauagcugcaccacuacaccuggcuaauuuuuuuuggucuuuuuaguagauacaggguuucacuauguuggccaggcuggucuugaacuccaggccucaagggaucugccagccuuggcuucccaaagugcuaggauuacaggugugaaccacugugccuggccucauguucuuuauagaugagugaacugaggccagugaagucccacauaccuagugaguggcagagcuagacauggagcccagaccaugcagaggcugacccacgauuuuagcacuaccucaggcugccucccccucguccucucucccuccucaagaaucauccauuuuucugugcugauucagagcucgccacugaauucagauuggucuggggaucaguggaaggaucagaagguucucucaggaccagagacacaggccuggguagaugcaugggaagagaccacggccaaaguguggacaagggcaaaucagagccauugaacaaaacgugucuuuggcuccucagcucucccaaaugaugccuuugccuuguaacaguggguguugcaaagggagugagaaugaggcagaacucuugguguuccuaugcaccuguaccccccaccuuguacgugggccaugaaacacccagauauucccagaaggauuccuguuuugccucuucccauuucuaaagacuucuacaugaagaagauuucagacuuucucagcaccuugcccuauugcuucugcagggagaauacucuucaucguaugcaacugaaaugcagccugcuacagcucaaaaucuaccagguucauugaaucccaauguuuaagggaacuuaaacauuccucccacugcagaaauuccuuucaagcaccucugauuguugccccauagccuugggucuaagaugcaggaagaugggugccaacccacccccuuccuucucaccagauagccuguuucauuucuugaauaguucuaauaauuaaaacguucuucuuuacuuuggaucaaugucucccuccugauaccuuccaccaauuaauccuaguuugaucuccuggaauuaauccauuccguuuuucaagugauaguauucugaauuuaugaaggcagaaguuccucuggagucuucuuuauccuucagcauccuucaguucuuuuucuguuacuucuauucagauauuccucaaagagaaaaaacauaucaaaagguccuagauugucuccagcauaaauuagucucaugcaaauguuuccucuucuucaucuacuguauuccaguccaaauguuuggguaacuaccaauacuacauauucuccugagagcugagaaauauuaagaaaauaagauguggucucugcucuugguuguauaacaguagcauuaacaacuaaauucugacuguggacaaacugccuccuccuuccuauaguacuuuaugguuggaaugguaaaugcacuuaugugcaaaguguccuguuuugacuguaaggagaacuguggaacucacuuccugccaugcuaucuccaucuuguuccugccucugucccacaccaucuucugggucugcucucucugugucuuuaucucuauucuugguuuuucuuaauuggcccauccaagagcccucuccaguccucccauccuuuccuacaggaucagggaaauacuccccccuaaauacuguccuuaauuaguuaauaaaaucucccuccacgacacaggcagcucucccccgagaaaaaccagugacagauacgaacaccauuuggucuaauuaguucugauauuucacacaacauauuugugagguuuuuuggaaggaggagaggaaggcagcaaaaugcuucuguuaaaagaacagcagguuggcucggaugacaggagggacagaguuuggggucuucuuuuguagcugcaaauagagccuuggugaaaucaguaccaccuggccuagugacacuugcaccuguaguucuccuugcaccucugucugacugcacuggccuuccugggucugagaccauauccuuuccuuauucuagugaagcaaaguuccugauugagugaccuuuucuuuuaugaugacagaaaucuaugcagagugagguaacgugagaggagcuuaacacuagagaccuggggauuuggauuuggggcacagcauucuauaucuguccugccuuuggcuugcucugugaccuuggaaugauuauugaacucuaaggccuuuuuucagucuaagggcuacauaggggagaggagggaggggguuaaacucauaucuuauauugcuagaauagaugucucucaagauauggaauacuggcuauuagagaguauauaaauuaggaguagcuguugacauagaaaaucaauccuauauuccucugucacauuugcugucaucuguuuauaaccugcaaguuuuaagagguauguuuacugcuccagagagcccaaugugcaccuugcauauccagcaacauggguucaaucucaugaaccccauuguaagucuguagcugagauuggaaaucaacuccaggcuuuucagacacugacauuuaucacagugucuaacccaaaguagauuuccauaaagguugauaggaccagaaucccgagccuuaugaugaugcuaugggaagagcccuggagggggaggaagaaugcuuggguuugcagccagguucugucaccacauaguuuagugaccuuagguaguuuauucaccucucuagucccauuuacucaucucuaagaccagagaguuaaauaacucucuaagcuuuauaguucuaaugucuacaguuuugugaccaaacauagcaaaaggaaaugaggguauuuuaauaaacuuauuggcuuagggaauggguaaagccaauagaaugagucugagcuccaagcuggagggaucccugaggggguccugcaagcuucucccaugggcugccucugugugacucucucgggaaucauugcuugggcuugccugccccccgcccacccuccccuccgccacccaggcugcuguacaucucaccucugguuacuuggccagguggacaccuguccugguccuuguuuacccugcucuugucccaucccaauuucugcuaugaucugagcauuguccuauggugagcuccaccuauacuagccgucuguccuagccauuccugggagacagacagacugccuucucaugaagcaggaggacagagugaaaucgcccacucuaguggcugcugcugaagauugugggcugugaagucagccuggaugugaaucccagcucugcugucaccaaccuucauccuggugucucugugucaguuucuaaugaaauggaaauuuaaaaaacaaaaaacaaaaaacccaaaccauguaaaguacuuagcaccaugucuggccuuugguaagaacucaauaaguguuaguugucauuguguugauguuguuauuugugaguuccgaaucccuucagaaauagaccagacaugagguagagauuuuuuuuuuuuaaauuagauuaaucuuuggcaaagcuggauuaggaaaaaaaaaagcggacccaaggacaugucuuccaaauacuuucccccaauucuagaccuuaaggcaaagaucccgcccuugcccguccaacucagagagggaccccagacagggagagaggcccgaggugugcgccaucuuaaacaagguaacucugcugggagcagaugaaccgaucccaggagaugugaagccugcucguccaaucauugaccagucucuuucagaguaagagggacucacuggaggggcaggguucuccuaacagcucagcagggcuagaaguuccuaauuccuggggugaguuagagagacaaggaggggcuucccucuucagcugccuauuacaaac

SEQ ID NO: 14579 - RNA, 15135 nt, Homo sapiens
guucaagggucugagauauaucccuugauaaagauuucugcucccgugguguguaugaucuagcaaggguguaaacaauaaccaucauaaaugaacgcaggacacaguaugucagaaggggacaagcgcugugaaaaaaagcaaaagcagaauggggagaggggauuggaaauccaggggagaggcaggagggaauacuuuuaaaaaacaaaagcccuggggaagaugugaggugcuucuaugagugcagucuuauucucagaugcccuuggugugggguuguagggauauuggcagugagggccuggggugugagggagcuccucugguggggagauggacuugcagcccaucagagucugaugggaacugagaaauccuccagucuaccagccugcaaacuaggcagcucuuccacaaggaagguccccuuucugaagacguuuaacccacaacgagccaguugccaaguuacucagaccucaugcccguauucgcaucugucuugcugccaaccugcugcacccuucccagcucuucuuugccccagacacgguuguaucaccuguccucucucccuuucugcagaaugagaaagggaaaauucuagagauuguguuugagcugagauguggccccaucuucagagccagagagugcacauguguauacaugugugugcacacaugucugugagugugcauuugugucuccugguuccagcuguggcaacucagacccagaaucagcuucucaggccauucauucauucauucaacgaguacuuacccugugccugauucuggcacucuuuggugugcuaauucuuccuuucaggugccaagugacagugaugagggcuacaucauuuagaaccuguggguccaacugaguaggcugcauaucuaugauccaaauggcucacaguuugcucccuccugagagagaucauacugcuguugugugccagagauacggcuggucacucauugcuugccaaggaucuuuguugcugccuccuugagagccaggucagagccaggagagagacucaggacagcuaggagagcugaagucaugugcucaaggcuucugagaggagccaaaccuggcccccuuacuucccuccuucggcuccucaccuaucccugccugccccaaugaagucucccuuuugcaaacugacugguuugcauuuuguugcaagggaucuccuuccaauucugggcacuucaaggccuaacucuggcucuggcauggcuggaauauggggcgccuccgcacaagccccuccaccucuggcccugugagcaaggccugaccuccuucuguccugaccaccagcugguuugccacgugccucuguguuugagguuugagggucuagguggggaauucagauuugcccugggacauaugccuccagguuugcucuguuccccucuccaucuacaguuccagcucuauuucccugccuguuggauaagagcccacccuugcauucuuauaccugggcccagcucccaaaucucgaagguguagaccuccauuaggaaguuuggggaggaugugaagggagagaggaaagggagagugcagagguggccugcaucuuuagagaugaauagcacuguuugcucauuagggagauuaguccaagcaagacggcagccagaaugcucuagugcaagcaucugccugcuacugggagacuauauuuauuguucaauccuucaauggauguaaauaaacagcccggcccagauaauguuccaauaaacaaacaagcagcugccaggagcuccccggauggcugaccuuugcggaggccacgcugcugauguuucaauagcagucugucuggcagugcggagacucaccgugccagggauggagauagguggcggugcccacugguggaucggcagggggccagcagggcuggaggaaaggggcuggcugccuuggaagaucccgggccagggacugaguggcuggggaugcagaugccuggauacccagaguagaguguguguguguguguguguguguguguguguguguguguguguguucuugguaagcugcauguaguguggaguagugcagugcacacugaacacuguaguggagguuucuguguggcacaggcaagaugaugcucaguccuuaagugcucauguggccucaccagucguuaauauugaaaugcaucuaugcaauuguuagucaguugcugcccccagccccagaugcccaccaccgucuaggugucccacuuaucaccacucucucccaaggcaguauuacuuggugcagguaagagucuccaagaauccccucccacagcaacgauucuggcugacugguugguccccucccacgagcagggguaccagggguccugcugcgcaggagguuugcccagagugugggaagagaaggcaugggugcaucaaaugagccuggauuagaaugaggcccaugcagcagcauucugacuugauggggaccauacagcuggcuggaucauacagcccaagaaugcccaaaaaguaagggcaauggggcacacugcacugugcuguagcuugaaggucccugggagacacaaagggguugcagcagaggacaggggggagggagggccgguugggguugggggugguugcaaaaucucaauggagcaugccuccgggggauagucaccaaaccaaauuauuagcaaggucacuuggugaaugcagaaucaauacacaggaaagagaauagucuagaauugugcuguccaauaugguagccucuggccacauagugagcaccugaaacguggcugcuccaaacugagcugugcuguaaguuuaacaugcaccucagguggcaaagguuuaguuaguaugaggaaaagaauguaaaauaucucaauaaaauuuuuauacuuguagacaugcuaaugucauauuugggguauauugggucagauuaaacauauuaugaaaauuaauuuuacuuguuuuguaaaauuuggccacuacuagaaaauuuuaaauaacguaugugacccacauuuguggcuuguacuaucuuccauuguccagugcuguucuggaacuaucuacgggggcugaggugaggccugcaggggcaccccucccuacuacagaggacacaguggcucucugaucuucucuagucucucucucuccucaagaugaugcugcaggaagaugaucaaauucuuccccucagacgcccuuuuuccaaguuuuacucuaacccuucucucaguauguuacgucuuuaugaaaucuauuaguccugcuaauuuugcuacuucagaucagccuuccuacugaucuaaaagauuuuguccccuaagguggcuuugaguaaaucugacguuaccugcuauguguuguauuagucaagcucucaucacuggcaugccauauugguagcucuuggucaugaugcucccugcccacuagccucgccuggagcugggcugaucaucccugguuaaacuccaguuggcuagaucuccugagaagaacaaagagaggccuuagaacacuccucugccauagcauuugccaccuggcauuauuugugugaaaucugagcccuccaggagacaggccuccuggaaggcggggcuggcacuuaccaccucuucucucuaggagaggcucuggaacagugggcauucaacagacacauggugggugugggaugugucgcuccgucaagggacacacaggauugggaugugguuuccuccuuggugucauccucagagauuaacaucuuccaaacaaccaaaguaccuucgugaccugugauugguuucuuuacauuuucuuuuuugagacggagucuugcucugucgcccaggcuggagugcaguagcaccaucuuggcugacugcaaccuccgccucccagguuuaagcuauucuccugccuuagcaucccgaguagcugggacuacaggcgcccaccgccacgcccagcuaauuuuuguguuuuuaguagagacaggguuucaccauauuggccaggauagucuugaucucuugaccucgugauccgcccaccucggcuucccaaaguguugggauuacaggcuuaagcaacagcacccggccaauuucuuuacauuuucuaccaaaaaaaaaaaaaaaaaaaucaacuucuguuuucauccuuucucauuguuuaggugauccacaaguaucuauacuauguaaaaauaagaaaucuaggcugggccugguggcucacgccuguaaucccagcacuuugggaggccgaggcgggcagaucacgaggucgaguuugagaccagccuggcaaauauggugaaaccccgucucuacuaacaauacaaaaauuagcugggcguggugguaggugacuguaaucccagcuacucaggaggcugaggcaggagaaucgcuugaacccaggaggcagagguuacagugagcugagaucgugccauugcacuccagccugggcaacaagagcaagaaucugucugaaaacaaaaacaaacaaacaaacaaaaaagaaaucuaauuuguucaaguugucauguuacaaguguugggguggccucuguauuggugacugaaccauggccacuggucagugugucuucuuucaucucaacuauuucuuucuggcaugggcugucuuuccuaggcuguucuugaguugcaggcaucuggauuguguuccuaccuuaugagcggugaacugaaugugaucucguauguucaggugaacuugaccaagaugauggcuucugcuugucuguuuuucuaugaaaucuuacuuaaaugcugccuaacauuuugugggccuuuuuggcugcccgaguauugggaguaguaaaugguggcucugaucccuuccucgauccugacucuuaccucgauuauaacuagcagcucagauauuagagacugugguuguuuuacauuuauucaguaauuacuuacuaagcaccaaccauguauuggggauugcacugaguacagcaggcaugaccucuuccuugggagacucauggucccagggcuauuugccacguggcaacugucagccccugcagaggguggaccauuuuuuuuuguaguucaccuuuguuauuggccuucuugcugucccaaagaguuuagaaucauuugcacauuuuccugcucccuccuccagaccauuuauaaaaaauauuaaaugagacuagucguaacacuaguuacuucuccaugcagaaaucugucuuuuccugucucuuagucaauucucucucuccauggccaaacugcccgaagucccauggagacucauuauuuuuaaauaacuuuucauguggaaccuugucaaaggcuucuggaaaaucuaaauagcuaagagacaagcacugagcuaggaaucaggagaccuggguucuagucuuauaugccauugguuuaucauugaacuuggggcaaggcacagaacagccuccaucuuggcugcuucaucaggaagaugagaaugauuauucuggcaaucaacaucauaaaaauuuuacaaccaucagcugagacaguguuauuuaagaaugcuuugcaagguauaaagcaaaaauauaagggaucauuauuuagaaaauuuacaacagcaucuucauucauaugcacguuucucucccagaacugcaguagauaaagacauggcuccuccagcaccccuggggugaugcuuguuuaaaaucaacuccuuugacgucuugaaggaaugcagguuuacauaaacaauagugccggauucagugugagccuuugguguagagugugaacucauagaagcaugaccacuggaaacaaucagacccugguaagggugcagccugugccauccgccagaugugugaccuuaaccaaguuauuuaaccuuuuuugugccacaccuauaaagggggacaauauuaaugcuuacuuuacugaguucugagauuuaaauaagaaaauaaauauauauaaaaugccuaucauugucccagacccauaguggccacucaauaaauaacagcucuuguucuauuugucuauguuaaggguccaagagccggcagcugguccauucuaccuaaauuuuuguauugcucaucaaacauucaguaaauuccaccauaaacuccuuuauccaugucuugugugaauuuuuucaacagaugaauaaauaaugcuuuucuuugguuuucugaaaauuuguuggaggguggggugggaaaagagagaaggagccuuuccaguuacauauuucucgcuggcagagugcagaggguggggacuaaucugcauccagccuccuugcagaaggccaggccuauggaaccuuguccaguuggugcuuccucauccaccccucuguccaucccccaagucaacuggcuuccuuugauguccagccacacccagcaaaccccucauccuaaggagcagugaaguuggagucgaaagauaaaggagacugcucaggcacugaauguaauuucauuuggggaucaggccaaggggcacuggauggagcuuaguuccgccagcacuccccuggggacccugcucuggccgacgguggccugagggggcuggagaccagccagggcauucaguaucacucucugcuccugcuccaggggcaccucccagcuggggaugaagcuuggcugggccaggggccaaggccaucauugcacggucagacuugggugguaaucccaauugguuuugcaugaacuccuguuucaucuagauuaggaaaggaccuggccagcauggacaucugguggcuuggggugggcacagaagaaggaaggcucugggaaucagaggcauuuccauuuuugacacuaaccacgacuccuuaaauccuuuaacuguuguuuucaugggcuuaaugggaaaccaucaaagaggaaucugaacuacauucauuaauuuauucauuuuuaaaauaaauauuugucagguucaaguguuugagcaccaaaaucaagaaugacuagagaaagucucaggaauuguacagacuagagacagacccugaccucagcucccugccuuuagguggccaccaccgggagacauacaggaaacccucugggagcaaggacucucauguaacuggugguaggaaaagcauggacuuccagagucaaacugaauucuaauucuguccccagauuuuaucccacaggccacuuguuuaauguaccuggguaucauuuuucuugucuauuaucagugcauccacuaggacuuuugauguugcaaaaaaccuuuguauuacuuuaaccuaaagaaaauaucugcaguaacuaggaagucccaaugucaggcaggcuuugggguuacuuugauucaguggcucagcgaugucaccaaagaccaauauuuucccaucucuguguuugaccugcccugguuccaguucccuuccuuguuaggagagggcugcccacagaucuuugagccgcaaguucauucuaccccuuugagagugaagaaagauggccucuucuuucuaccaugagucccugcuuugcucugauucacguugauuggcuugagccuauuuucucuuaaucacuguggcagagaguaagaucaagcugguuuguuuaugcucaucacggacaaccugggaagcaaggaguggguucaaucccacccaaaaggugggagaagguggaauggaugcuggagggacacaugagccgugaugaaugaacauuaaacccacaggauugagaggauuauaucaauaaggaauuaugugcaaaaccaucucccaguaccugauguccaugaagcuugaaaauaaugcuuaaaaggaaauuuuaaaaaucagaguccagaacaaacccaaaaucaagcaaauaaaccacaaaauaaccugauaucagaguucauggacucaagagaaaugaaaggugggagccuucugggggaccugguguggucaguugucauuaacaugguguucuuucuguaauuuaguuccucagaaugacucuuuuauucuccuugaucuugugagagguuaaaaauuauacauuaaaaauuaaaaauaagagugccuaaugggaauauuuggaauauaauuuuuuucuuuaguuuuauuguugaaaucucuaaaauuacguuauguguagcuuacaguugugcaugugguagggaaguguggugauccccuaguucuugccuagccacacucucaguaauauuuguuccugauuuaugggagugguguuuuuagcacugacugcgcagcggucauguuggaucuaugcacucaaacacaggauguuuccagagaccuuggccaacauccagaggccagaugagcaucauguaggguuggaaagcucaugucuuuucuagguuaguucucauucauggggcaugugggcagaagucuucuuuccauugucucuaugcugucccagcauuucuaggaaggacuuauggauggccggggaugaucuauucagcugaguguuugcagaagguuguggaugacucaugccugaagcacauuuuccuguaauucccacaucccuuuugcuggggacgugaacaaaaccucuagaagguuucaggaccuaaugguauaaguauaagccacuauuucaauggcaaaaaaagagacccuuagugugaaaccuuugggguuggcccccugccugguucaccuucaaggaacagcaaugacauccagguagcaguucccauccuuacacugacauguuuuucugcuaacaaaugcagcaaauaauauugccuuuccaaugcagggugacgcucugaucugaggcaguuucaauuacauguuguuccuccaagccucagagccucaucuuuuucuccaaagaccagcaagaaaggcaucaaaugcuugagccugaggcauagggaaccagggagauuaagacuggauucuuggugaagcccagcuuggucccccacuucccucucugccacucccauccugaggcccuuggugagcuuaugucacuccacuccuuggcuuuagccugugagcacuguggagacagaacucaugcccucucccuuggcuguugacagggucuuuggcugaaguuuggcugugggcagugcaggaucugaacucacuuuggcucuccucuucuucuccacagauccggguggauggacccaggggcaacgcccuccaguaugagacggugcaggugguggaccccggcccaguccuccgggauauggccuucuccaaggaccacgagcaacucuacaucaugucagagaggcagguaaggcucuucgggcuccgcuagacauuugucuugcaguuaaauacuagccuguggcucaguacaaaccuuaggaggccagcugcagagaggugauuugauuuauuuggcguaguauguaucuuuucaguuauacuuuucaguuaugcugccuggggacugaggcuugguguucugaaacaggaaagaaacauuuaaaauaucaaaauauuggagagucuaaaacaaauccacuaauuucaaaaucaugcauauauguucggggccaacauuugcuuucuucugaaggaacgucguacagaugcccaaauuguggguccagauuucccuauacaaaaugcuaccucauaccaaagucaccuuccuggcccccagaagccugugggaucaagaauuuauugccaaaagaguguaguuaagggaacaccauggucaggacucagaaaacagucugugugaugagaugugaugggguagggcacggccugaacuuuuguguguacauacaacucuuuguggaaacuccagcaaaugccauggagcccacccgagaagaacagauauggugcagguuugcugaugcugaguaggaaguagaaaaccugggcuugguucucaaacugagcugagaacgaagugaguuuuucuggagucccugagcucaggccaggagucauaugucugcagcaggcaaaggaagggguuucaccuuggacauccauguauuuaaggguauuuccuggaguccuccaccccacaacacacagcccaccccaagugaggugcagcacugcuguaccucugcccuguggccucuguggaggaugggucauucucgggagcugccccucuaucccaugaauauguaugcguuagcucugaguggcagcagcggccaugaggggcagaucuccccucuuuuucauccucgucagcguggccugaacucucuggaggacccugcugacagagucuggauuguucugccuggacccucuuggcauugugggggagaugaauuccacauuaugccacccacggggcuugugcauuaugccuuaacagucacaggagcucugcccuccccaagagcucgaugacaucuucuccuguugucagacuccccguucucccgacuucagccauacugggacccacugugcccuggaugaggcugccauggcuugggaauggucucauucccaagguaggguggaaaauggaguauuuuuuccugggaggggagacuaccgagauggagccugcagcugggcacgaggcuucccauuugucugcauuccuugcuuuuauaacagcuuccacacuccccacuccaagcccaccucugaggcccuaggagcugaggggaagcagcuuuccuugguggcaugaaucaucuggagaagaucuucacaaggcauugaauauucaagauuucuugccugaucugaaagccagcauuucugaaccugggacuuaaaacauaagaggacuuucaaagacggaaaauauaaacggagccaggugcagggucuugcaccuauaaucccagcugcucgggaggccaaggcaggaggauuaccgaaaggccaggaguucaaggccagccugggcaacauagcaagacuuugucucuaaaaaaaaaaaaagagaaauuaaaaacaaaaaaacaaaguauaagcugguaauaugaguuaucagcccccuuugagaacugagucagcauucugagcauuacuccuucccuggaggugcccaucugaauccuuguucaccucuuuguccucagcuguuuccccuuggauggguaauguggucacuguccauucaggcuuggcaaugaggcauccugagaacuccauauuaugggcacauuggaaaggaaggcaggaaugaauagagccaggguguucauccauuccagggcugcuccacacagauguggagacuggccugccacccaaaugaccaucucaaaggccuaacaccugggccgacacuggucuccacugggcuuguggauucuugguggagauuuguagaacagugcaaugauuaaguccacagguguugccauugaaaugucugagugggaaucuuaaaucucauuuacuaaauguagucucugguaaguuccuaaccuuaagauucagcauucuuuacuguccuauguuggugacaauaauaucagauaguuuuuuuccaagaauugaaugagauaggcauauaauaagcuuagaaccauggcuggcacagaguaagugcuuguuaaauggagagacucuuguuuuuuaugacucugugacaggaguuuccagacacuggccgugcuuagagucaggcaggggcugguauugagauucuagaugguccaucuggguuggagcacagcagcccaggugaggccaagggaggcagggagcaaaaauccagucccgggggagagcgcaucaggaacccaggccugcuugacagguugggcaugcggaauagagcucagggcaaagcagcuugauaaauauaccuggguauuuuccagacccaggguaucaagacuaauuccagccuccuucagguggugggucucccucagccaugaugggucagaacacguugcacacugugucugcaggcuaagggcauagcuuagccaugaugucagugcagccuggaaagcacuuuccuuucuuaugugacuaauuuuuccuuguccuucaaaacuuagcucggcugucacauucuucauuggacuauuccuggccugcaguuagacaugucuauaguagcucuugucagaccaggcugugauuaugacuuccuugucucucuugcugccagcagcuugagagcauccgaugccuugccagccuaaacuucaccuaauaggccccucuuaauuuuuuaaugaaugaguccccagugcccucauugaaccagaauuggaaaagagagguaccaacacaaauaaccuauugcuucaguuuauuacaaaguucaaacuuaagucagauaagggaagcacuuccugcaugucaguaaucuaccacuuauauucauuggcuagggcugccauaacaaaauagcacagacuggggagcuuaaacaacagaaauuuguuuucucauagcuuuggauguuggaaguccaggaucacagugucagcagggcugguuuuuucugaggccucucucccuggcuugcagauggccaccuucucacuguguccucacauagccuuuccucugugugcacagcccugguguuucucuauguguccuacucgccucuucuucuaagagcaccagucaaauuggauuagggccucucucuaucagccucauuuuaacauaaacaccuugauaugguuuugcugugucccacccaaaucucaucuugaguuguagcucccauaauucuacggacucuacaaaauguuuccagaauauggcuauuucccaccacuucauuguuacccaccuggauugaacccccauggucucuugccugaauauuugcaauagcccuccaacuacucucucuguuuccaccuuugucuuuccagucuuuucuccaugcagcaguuaaucuucaaaaguuugaguuagauagugucauuccuccguuuaaauccuuucaaugaccaaagugccuaugaagacccacagggccuuauaugcucuguccucaugagauguccaagcucaucaccugccgcucuccccgcucucccugcuccccuagucugcagggccagggcgggagagagugcucuggacacagaaauguccucugugaugcuccugcaauauggcaggcuccugcuucaggaucuuuguccugguuguuccccuuugccuggaauucuauccagguaucugcguccccugaguaccacagguaaaacucuagauugccuuccacucagacucauaaacucccaaucuccucuccuggcucuauuuuuauccauagcacuuagucucuucuuauuugcuauaugauucuuaauaauuguucuguauuauaugucuuccucauuuaaaauguaaacuccauaagaauaugauuuuuuguuuuuuagucucuuuaguuuacuuguguguuaccccuagaacagcacugacaccuaauaaacacucaaaucacauuuguggaaugggugacuaaauggaucugggcucaagagagcugugguuucaauuuuggugcucugguugcuccuauaacugaagacuaaaaucuaacaugaaacauacuagcaccuguauucccagaucuuaguggaagggcauccuaaacauaugugagaguggcaaucuggaugauaauccaggaggcuuauaugggauugaaggacacauuuucuaacagggaucacuguguaaaaaaacuggugguagaaaaugugugcuuuaugcuguccauucuuacauaccagccucucucuucucugaucuguuugguaucugcagcagggcaguggccuaaacaaccuuuuuguccugguguuguguucaauacaaugacaggugauaugguuuggcuguguccccaccuaaaucucaucuugcauuguagcucccauaauucccauguguuguggaagggaccuggugaaagauaauugaauccugggggugguuucccccaugcuguucucauguagugaauaagucucacaagauccggugguuuuauauuugcuuggcucucauucugucuucccugccgccauguaagaugugauugugaggccuccccagccacaugaaacucugaguccauuaaaccucuuuuucuuuguaaauuacccagucucagguauguuuuuuucagcagcaugaaaacaagcuaauacaacaggcgaagagaugagcaacugaaucgggaggcuugugagcacuuuccaaguuaacagaauggguguucauggaccccuccuaccaucaggggcaucucaucauucuuggcauaaggcccaagcuccuggcauggucccuuggccccauccugugacucaucuccaccucugcaagcucauuuugugacccuggacccuggcucuccguguaccagcaaacaggccuuuguucugucccugagcccagcuccuuccugcugcagaacuugcacgcuuacuguuuccucugcugugaaaacucucuggcuuuuccuguggcuggucccuccucaugccugugguuuuugcucaaauaucguguccucagagaggccuccgcuggccacccuacauaaauaucccucacccuggaaucuugacuucuuccuauuaagucuuuuuguuuacucccuucugcugcccaccacaguaugaaaauuaccuguuuauuucccaucccuaugaauuagcauauaaguuccuggagggcagggaccuugucucucuugugucuagcagguagaggaagaccucacccagagaaagggccagguauauucuuauagaguuaauaugagugaaugagcuuuggacuucaucuguuugugaugaagagcagcccuucuuugagagcacucugauuuuggugagacugggaccuccugccuggagaugacgccugaagacuuaaauagagauggcaggauucugaguuuuauuaagaaccagauaacuuugauucgucagcaacccggcaagcucuaucuaggguguuaccucugccccugaggaauguuccucuuuaccauuuggugggcaggggcugcucucucuucuaaacacucuuucaucccuucuugucccuaguuucuuuguggauggagaugcug

SEQ ID NO: 14580 - RNA, 4713 nt, Homo sapiens
ggaaaugaauugagggcugccagagguauuuuguuaaaauaauuuguuuaaaugauuauaaggaugauauucagaauccguaaccuagcugguugcauaacaaaacaauguuuuugggggagcuguugaccuuaaaugcugcuuuaauauuuuugauuuaaaucaaauuuauccugauuuuaauaacugauuuucauuucauuccucagauccauucucaaaacugacacacagcaaucaauauuuuaucuuauuguuuaaagucaugagaugaccacuaugucaacaaaaaaacaaauugcaucugaagaauuuagcguaacuaccaaaugaagccaauccgacaucauuauacgcauucccugugacuguagcacacggugaugaggugaaaaggaagcacuggguaaaagcccauaugagcuaaagcaaauucuagagguuuucuuagcucuuuauuaguuagggcuccucagaugcuucuguguguuugagcacacggggagcucccugagcuagcucccugaucucccagucguccccacacugggaggacuggcccaagcauuggaccuuccuuccaaccccuacccagaagccaaaccaaaccgcaaccuuccugggcuuccagacaccaaagucccuagacuucaaagagcaggccucagaggcuugaggaaaugaaugauggcagaaagaccacucuuucaagaagaaaauaagucaugauccucaagugagaagcugagaucagacacgagaaaagccacacaggagaagauagagugaagaaaagcuccacucucaagugucccagaguuuugacaacaggaagagagcagcggguucuacuagaaaaggaagccagggguaacuugguuuccaaguuagggaccuaccucuagacacccuaaccaaaccucaccuaaaacuccuagccuaaaauuccaggggacaaagguacuaaugucagauuaacuucgacccaauggaggaggaaagugaggaggguagcaggaacugagagcgggaggguccgagaagggaaaaucccaacucacuacagcacucaccaaaacuugucaagucuacacagaugauuuccuuucuaaacuaaauuaguaacuaggaggaggacaugaaccuccacaucaauguuuccaaauccagagccccgcucccuagccacuccuccacagacucguacuuuuccccagaugguacucaagaaagugccucuuccaaaagggcuuccuugggucugcuacgauugagaccugaaacuggcauuguauaagcaccaucaggagccuggugaagacacucacacccaugcccaguggaaccaaccuaagagaaagaccccuuuuccugcuugccucuuaguggacacaggcacuuguacauaucaggcuucauuaucugauuugcuuuagcucacgcauuccacaaacauuuaugaggcaccuaacuuuauaauacggucacuguggcugagcguacagaacaugggaagcgaacauacacuucuuucaaaggcucauaaucaaaugggaaaaacagacaaguaaacauguaauuguaacacaaugaaguacauacuauuacaaggaucaguacuaaagagaauuaguaacacaagaaaaggaaacucuucaaaaugguaucaacuuggaaaguccacacugagaaaaugaggaaauggcucuugaaggaaaucuccucgacccucugagacuucuucuuuuccugcuuugccuaauuaucuggucucaacaggucaauguuuaccugcagcaaacacacacaguucuauaacggccuuggcaaagagagcucagcaccaaagcaagggggagugcugaaggaagugccagaagaggagguccugggaggaccaaugagaaaauagaagcuaugggaucuggaggagagggguguguaacgggcaauggcagaaccacgugacgugugcuacgagagacgugcacagguaccacaggcccacacagguggggcaucucaccaggacugggugucauuaaaaguuuccugggguaagugguuucuaggcagggaucugaacaaugagcaggaguuugcuagacaaaaggcagguaagaggugagauagcaguggggcagggcuagaagguggaacaguauucagacagaaggaacaacacggucaaaaacccaaaaggaggccgggugcgguggcucaggccuguaaucccagcacuuugggaggccaagauggguggaucaccugacgucagcaguucgagaccagccuggccaacauggugaaaccccaugucuacuaaaaauacaaaaaauuagccaggcgugguggcgggagccuguaaucccaguuacucgggaggcugaggcaggagaaucacuugaaccugggagguggagguugcagugagccaagauugaggcauugcacuccagccugggcaacaacagcaaaacuccaacucaaaaauaaaaaaacucaaaaggauaagucugaggauauacaagaacuacaauaugacuagacaaagaaguucaacacaacagacaaaggucugucugccagcaaggucuuguacaaaagcaguauuugggcucaaucccaugagauucccagagaagacucgagcaggagauggauuguacaggaccuugcuggcuauguaagagauuugggcugcauccuaagaggaaggccggggugggguggagggcucaaguuucuaacagaggaauggcaugauuaguuucaugcuuuggaaagaaacuagggcugcagugagaauagaccggggaaugcaagacuaaaggcagggaccccaagcaagagacugucaggguaaugcaggaaaaagauaaugguggccagacuagggcaaugacaccagggaugggagaaacugcaaagcguaacauaauaaauugggaaaugcagagcaaggcucuacugcuacucaucaaauacagacaaggucugcgagugacccuugcaggacuauagcaaugauggguguggacaagcaaaaaaaaaaaaaaacccuaugagaaaagagcaaggugcaugugcaugaagugaggaggaaagcagcugcacucacucagcugacaaaggaaagaaguccugccaacacagugaguacacagggguugguugcuggcagccguguacuugcccacccugcaaucugucagauguuucaaacaccuuguaucuuuauaguaaugugaguuaucaugacuacccuguaacugaaaguaauuucaagcuccaaucauuugaugcuggcuaauuaaaacccauauuucaaucaaccacucauucaggggaagcagggcauauagaaccagaauauugucauaagcaugccauagcaauucggugauaaaguuuggagauccuucuauaaugauccacauggguucccgaggcuuuucaaggaauacucaaguacagugacagcugucaacaaagugucaaguagcccugggggcagagaagguuuaaaagggggacuuaaaagcacuuacuguucccugguagcacugauuuggccuaauacagaacacuauaggagugacucugaauaaaccagggaggcaggagaggguaaaggaaagaaaugaaaugcugggucagaccuuacuuuuaaauuuuuuuuuuuuuuaacaaggaaaaacaagaucaucaacaacaauaaccuacuauuuggcugacagcuggaaagucaauggauugauuuugaaccucucugcuugcaauaggaaaauguacauuugaaacucccuugggcaacuuauuauaagagauuugggccauccagaugaugcucucaaaucugucaaauuccaagaaaggcaaaaauauuguuaauauuguuuacaacaaauguaugaaauuuaaaucaaaaauaguauugcuaaguauauguccuaugcuuuauauucuauuaguuuugcuugacuaaccaaugccguauuuuauuucacaaaucuugaagcaugauuacaaaauuuauaucacuguuuuaucuaguuuucuuaauauaguuuuggugacacccaugauuugcuugguuaugacaaauaacaacacuuguucugugagaaaauacaauccacuaucccauaauuccauuuaaaguuaguguccagaaucuacagcagcaaaaauggggagcuucuuuaaaacagcgucuuuuuucucugcugucauugaaauuacuaggucauaacucccgaguuaacuuccagcuccugaguacugugacuccacgacauuacuauauuucuaaucuacauuauacaaccuaccuaagaaaacaguugcuucuuucuaguaacuuaggggcaaguagggaguguccggcccacuugauuucauaccaccuagaagcaccaaugcaaagucccugcaguaacaagggcagggaccucugaagacauaauauaaagcagcugaagccagugguuaauccguuaacuaggaaaucaauggguggaaguuccuagucacagaaaacgaucggaagauguaacucacugauguuucagaaccuaccaagcuuuaucucuaguucauucucucucccacugcagcacuuucuuugugugacucccuuuugaccauucuaaaauaccacggaauacaaaacacauugcuaaugacaagaaaggaaguuuucuaugcccu
